United States Patent 11,001,841 (CCCTC-BINDING FACTOR (CTCF) RNA INTERACTOME) - sequence listing, part 10

SEQ ID NO: 23764 - DNA, 1023 bp, Homo sapiens
ggaggacaaatatacatggcttccagtagttcaaatgttacttgaatttcttacaagttttttttaattcctagggctaaactgcctttcagttataaatttgcatatgtagtcacaaaaattccttcatggcaaatctgactgaactgtagtaaaatgctagtactactggcatgttaacagttaaacagataagaaatcacttggatgcacattttgttataactgaagacaaatatcaccttcttttctatgttgaattttttcaatatggtgtttttcttctttttctgattttcctttcagagtactttactaatttcattgttgtcttgaagataggaatgtacctttatgtgtctatgttatatttgtgtgtgtgtgtatgttgcttctctctgtctatatatataaaacatatatatatatcttatatatgtatgttgtttctcagaaccaaatttaggctaaataggagaacagattttaaataaaacataaattgtgtgtcggtataaacttcaaatctgaaagataatcattttactaaaagctgaggctttgatcaaataagtgagcctgatctcctgaaatctaaaacaagagattttctattctcccttttcaaaggaccgccctgaagctctttatgtagtagatgacattcttgtaacgacctcttgatgagaaaattatttatttcagtcaggaagagcagacttttacttcacttacgtactgagcaatgatgccagcaataaaagcttaccctataaaaataagagccatttgtttgtactgtcttttttttttttttttttttttgaggcggagtttcactttgttgcccaggctggagtgcagtggcatgatcttggctgacgacaacctctgcttctctgtttcaaacaattatcccccttcagcctcctgagtaactgggaccacaggcatgcgccaccatgtccagctaatttttgtatttttaatggagatggggtttcaccatgttggccaggctga

SEQ ID NO: 23765 - DNA, 1120 bp, Homo sapiens
tgtgaaatacaaggagagcagctttgtgggaggttggatgaggtaggtactctgtttggttatgtttgaggtatctatggagaatcaaggggaggatgagagttacaggtctggaactcagagagagatctgagctggagataagaatttatgagtcaccctctgagggagactgtggtgtctaatgactttttgagtacataaatgatgtgaggagtatgagcatttttaggaagattaatgtgacagtaatgtgcataatggaggaaaaaagtgactggcaatgttaacacaccaagagtgataccaagtgtatcttatacaaaaggaccccgtgcagggaagctggcacaggaagtgactcctctgttagcatggtagaagaaaatccaagggttgctactgttagccaagtgaaagtctaaaacacaattgccagtgcccatgatattgagatgtataaaatggaatacattattttaattaattgttaattgattggttgactaatttatactcccttgttcaaaaaagcctttaaaagtatctgactatagtagagctggtcagacccacacctggaattagggctagttcagagtagaagcactgaaatgattaagtaattggatagagaggtcaagaaataggattatagtcatagactctttcagtccagaaggtactcagcattctctacaagtaccttccgaggcgaccgctttcagtttagagctgctttaattgttgattcattcatgcatttattcatgtattcattcaaaaagaatgtattgagcacatgccatgtgccactacacctcagattcactagggcaaatttagtttgcttttacctgaggactattttctaaatgacctaaattgcaacacattttcaatatactatgggagcttgctttgtttttttgtttttatattttgattttacattgtatggctatgttctctgaaatgaaactaatttttacacaaagacttctgttttatagccttttttcttttcatttttaaaagcgcagataacagttgcctcagatcattaacttaattatcctgtactctaaatttactatttcagtgctacctaaggaaatgg

SEQ ID NO: 23766 - DNA, 1051 bp, Homo sapiens
gtcaaaactgttttctttgtgaaagaaggcctggtgatgggagtgcagaggaataacatgttcctagaaagtgatgattctttaccaaaaaacagaaatctgggaccaattaaaaagccggcatgctgtatttggcaatagattgaatctctgaaatgcatagtccagaaccaagaagagcaatttctggaaatacctcagtgagtgtactggccagtgtaaaatttcactttctgggacaattatgatccatccgttttttataggaggcccagtaatgatatcttgactgaattgcctttttgagttacaatcattaatcttgaaggtcatttgagatgtctcaagtctcttatttaagtctttgagatcaagtaaaatccctagcatgtatcaatagccacctgtatcaaacattgtgtatgttttttaaataaagaatatctggctataggattcccttagcctctttggaagaaattatcttgaatagggaagatagtgaagaactggtatgtccaagtagaactaggaattagagcaatagtctggatcctggagctcagaaaatgggcagtaagtcagggacaaaaggtggcttcttaatctgttgttaaaaattacttagagtagaaattcacattgagccagtccatcaagctcccagtatcactaaagaaaacctgtggtactaccactcccccttgtttatatctgacctcccacaaggctccttttttgtatgtgtagtgctttccctattccagacacatttttatgttttttaattataacatggacaaaggatagcattgacataaaccccaaattttaataaatgactttcctgaaaatgagagtagcagtgactttaaaaatggtaagaaaaggagccgtgcgcagtggctcacgcctgtaatcccagcactttgggaggctgaggcgggtggatcacgaggtcaggaattcaagaccagcctgactaacatggtgaaaccccatctctgctaaaaatacaaaaattagccgggtgtagtggtgtgcgcctata

SEQ ID NO: 23767 - DNA, 1034 bp, Homo sapiens
acactcttattgcacataacacaaattcccaactactggcatgtggctttgtgagagctgtttcaccataatctgttgagacttatttgtggaatcatgatgtcccgtgacatttgaaaatggaagagaatcctggaatatgggagcaacactgacgcagaacacagtgttcactttggaagcagtcatgatctcttcttgctgtggaagcctcaacagtttgcctgttccctccattgtactcctctctgaattctctctcaggcctagatgctgggctctgtgtgggttgctgtatggtatagaagaggatgagattggcggggacggctcttgttcaggtccatcaagactgtcgctgtcctctataccttgagccagctctactgtgcatttatagaaaagagagaccagcacacagaaagagagaaagcagctgtttttagggggaggagagaagatggtggagcttacaagagactgatgtttgcaagtggatatggtataaagtagtagttctcaaagcacggtgcctagacagcagcatcaggagcctgtgaatttgttagaagcacacatcctgaggcttcacccaagaccaggggataagatttggcaatctgtgcttaaaaaagcgtttgccttgctcacttctgagaaccagtggtctaaagagtgttgggaagcctgacagtggtagttacaagggtgtaccctgatgggagtcctgggatcaaaaagacttgaactagaagtaagggaccaggtgagggagcattcccttcagagagagttgttaaaataagccggggttctcatgatgctgctgaaaggagtgtaagtactgtacctcctgtgtttgggaccaagggtgtatctagccttaggcttccattccagcacatcccgtcagccagatgtgcaaaagttcctccgtatacacactgtactgcttaaattgctggtattttgaaatagaaaaaggtgcttataaacccatactgactgtgatgaacagggagtactttttccac

SEQ ID NO: 23768 - DNA, 1026 bp, Homo sapiens
gactgtaaggaataaatgaaataacacatgtgaagtgcttagcatggaaataactgaaccgtaccaagtattctgtaaatgagagatctgaatccgagacagttcctacacattcacagaaatgccagaagaggcccctgttctcatctctagagtgggagtcccctccctgtaatttaatgatcttattgaattctcttattactgttgacagacttaaaccacttgaacctcacgtcctaatattagctcttttgccattgtcttctgtttccatgcatggaatattttcttcactattctcttaataagaatagagcgagatgctcttcacagttcatctcttctatcccttaaagcaaacagcaccaggctttcaagagttggaaagattgcagatgaataatgtgttctgattttgtgtcatttcccagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacaggtaagcgacaccatgccttgtgggtgcttggtggggaaggatgcagctctgggtgttgtcattctgtgggacccacagggcaggatcagccccatatgggagtgtgccaaacccagtatcccatcaggaacagctggcagcctgcttcctgcatgtattctctttatcaaccacctatttatgcagtcagcatgcctcacacctgagatgactgtgaaacaaaaaaggagactgttgctcttgccaatttttttccttaaccctgcatctcaaactcgaggcgtatacctaagtagagaaagtcccaccgcaccaaattaaccaaacgattctgttactgtgaaaagtcatctttatgtaacaaatgagaagaata

SEQ ID NO: 23769 - DNA, 1030 bp, Homo sapiens
atatctgtgtataattttgtataaataatgtcgcatgcctcgtttggcagacaactgagttggctgactatgcaatacaccttaaaaacacatgaatttcatttaaaggaggtaagatacactctatacatatttttgacctagaactctagtctcaaacataccgacatctggccttcttcccccaaaaatgacatcttgcgacttagacttttagaattagagtcacatattttagtttagttattttcacaagcagattttctacacatgcaatacattatgttaaaatgttaatatttgtttaaaactaagagtgaaaaatggagctataaaacacgtcttaagaatgcatttaatctattgtcgaatttgaaaaatgctttttcctcaaagggaaattctgttcattatcaagactataaatataatgaacttttataataaacttttatttctctcgttaagcaatggtcttagtaaattagtaaactaccagctttcaggatcttcacttacacagaaaatgaaaaagcagagaatgaggaaaataaggataaccgagcacctgtttctctccacctgaatttccaaaggtgtggcggaggccattctgaatgacatttgagatcccttccatgctgaagcgctaaaggcggcaatatacggcccagaagaaaaggacagagaaagaagttcaaagtctattagtaagaatgtaccatgatgacttatgtgcccaagaggcaagcagttagaaaatgccactactcatccagataaagcacataaacccatgctctttttaaaatgctgttgcttccatttctttgcaagttaaatgcaaaagcaactgtttttatgctactatattcatgcaggcatttttctgatgtagctaattgttccaatgtaaatgttgtaagttgtacacatatttgttctatacaaaatttactgtgtaatttttaagatactttttgatattatttacctacattttatcagaagtctgaaaacttaagatgaa

SEQ ID NO: 23770 - DNA, 1053 bp, Homo sapiens
gaccctaaagctagcattaaattgtggctgtgttaatataatgaatttctgttcatatctaatttcaagacatccttttttccatcagatttcaggcaaacaatgagcaagaaatatcccttcatcttggaaggtatgtttttccttaagtaaaaataagtataaaacaacttcttcaggtaacctataaattatgtagtaatttctttacaaggaatttctaacaatactattcacatgtattttagttcttctgagactaaattctcatctattctagtgagaggagaattaggtaatgggctggattctgaattcttctagtggttaagaatgtaaactctggaatcattcatatatgaggtgatagaatcaaaccacagtttaaacctttggttttaaaagatcagtttcatctcaggtttgctaacttcttggagctgtctctttctctgtcaagtagataaagactgaacaagatgacatcatgtagttagacgaaatagtgctcattacaatgatcagagatgccaggacttatatgtgaagtctgtaatcctactgtcctctttttcattttgttatgtagcaatatggaaaaaagaagttgtttttttcaatacatttaattttaacaatgcttccacatgactttataaatgagagctatttttatttatagtttattacaaatccactgagaagtctggaatgtatggaatcagagagctagatcaaaaaacatggttgaacagcaaaaattagatgtaagtagaattttaatctataatttacattaataactcatttcctttgttttttagttttttgagtggttttaatcctcttctttttaaaatgtttctttttcttgatgatactttttgcatctctgttgtgtagccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtgg

SEQ ID NO: 23771 - DNA, 1030 bp, Homo sapiens
tgaggttagagttctcatcatctcaaagatgagattacttcctagacctagagatgttatcaaatcaaggctgtgtacattttatttccttggtctttttttagactccataatctgaatcattgtttttatcagatgccaaatcttttattttcatttgttaatcataatttatcattaggaaaccaaattgtgcattgttcatttcttatttagattatgcttaataactagtaggttaggattcttatagactgctggagagtggcttgggtaaggaacacatctctctgaaatattacctctattgtgacatgactaaatcattgatgtaaatgattaggaaacttaaaacctacttaacacattgtatttttttttcttcttttggtatttaggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaaggtaattacctttatgtggattaatgaaagaattttgatcacaaccctcacagtattgatgggactgtaactttttacagcaatataatagattgagttactgctgccaagtcccttatccatagagagtagcctacttttttctagaaaagagcatcttaatagaaaataaagttgcctgacattaagtagtagtttatttcatgaagctttgtaaaatcccaaacaaaatgtaaatctcctttgtacttttgagtatttccctatagctagggttgtaccgatgacggagcagcccaaggcagctggggctgatggaagcagtgttagtaggtgggtttagttcagttatagagtcttttaaaaaatccttacttgcctaaagacaagcaaggtgtgggggaaaatccctgtactag

SEQ ID NO: 23772 - DNA, 1048 bp, Homo sapiens
gtaatggtattgtccacaggaagagtttacatctgtgaaagcaatgtagtacagactatagtaaattaacaataacagctaacgtttgttgagtactttgtgttactctgttttctcatttaattctcaaagcaactatattaggtaggttctattattatccttctttgggctacagcatggcttttatcccatgcttccacacagatctcagtttgattcggccagaatggtagaattactactgctttctgttgatctcaaggaatcattgcaagagcctgtctattgtggcttgtttaaaggtacaaaaaaatccctgtacttctcaggaacgtccaggcttcagactgcctctttttttttaatcctttttttccagctcagaagatgatttttactttctggaccttaactgagaacttcttacttagaaattatcagttttaaaagcacaagagcttttaaacttaaatgtatgaattaagttttgttaagtataaatttaaatgtcagactgaacacttatgaacacctgttttttcatagtatagcaatctaagtttacctgaatgacatattcatagaactaccaagaactaacctcctggccctgggagttcatttagttcttgacctaattagtattcacttaggaagggagggagcgaatattctctttcacttgaatgagatgcgtggtaatacatgtcatcttgaagagtagcctaagatagaatgtcagcatgatcagcgtgtccactgatgcctgatgaggctgacttcatggtttttatagttaagccacagtaatttgattgcactattagctaaatggttagttatatttaatcctcacaataaacctacaatatctataaggaagaaaacaactcagaaagtttaagtaacttgtctaccagtaagcataggaagagctgagatttaacttcatctgactctatgcctgttaccataggcagacatcagggcaggtcattactgcatttctataataaggtgttaggaaggagtacaagttaatgta

SEQ ID NO: 23773 - DNA, 1053 bp, Homo sapiens
agacaggagaatcacttgaacctgggaggtggaggttgcggtgagctgagatcgtgccactgcactccagcctgggcaacaagagcaaaaatccctctcaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaacgaatacactagtgtacactggttgttttctgtgatatgtacttgcatacaaagtaaggaatgaatgcacaattttcccaatttggaagtgactttgaggggcagggtgtggctgggtatttgaatttcttacattgtgcatctgtgcattttttaaaaaattatgaaggtcacagtaagaaacagtaaatcttgacatgtagttcaaatatgagttggagaccagcctggccaacatggtgaaaccccatttctactaaaaatacaaaaattagcctggtgtggtggtgggcgcctgtaatcctagctactcacgaggctgaggtaggataatcgcttgaacccgggaggcggaggttgcagtgaggggagattgctccgttgcactctagcctgtgatagacacacacacacacacacacacacacacacacacacacacacacagaggggagatcgctccgttgcactgtagcctgtgatagagacacacacacacacacacacacacacacacacacagcctaggaggaataattttcagataaatgtcaaattttagttctgtattatgttttcattttttggttgttagaagctgtgtgttaatactggaaacaaagagttagagaattattaattagcaacacagatttacaagggagattaaagggaaagaatactttcccttgatgtcttgaatttacggctt

SEQ ID NO: 23774 - DNA, 1051 bp, Homo sapiens
ggccctgccggcccaggcaatgaggggcttagcacccaggccagcggctgcagagggtgtgctgggtcccccagcagtgctggctcactggcggtgtgctggatttctcaccaggccttagctgcctcccggcagggcagggctcgggacctgcagccccccatgcctgaacctcccccgcctccttgggctcctgtgcaaacggagcctcccccacgagcgccaccccctgctccacggtgcgcaattccatcgaccacccaagggctgaggagtgcggcgcacggtacgggattggcaggcagctccacctgtggccgggtctgggatccactgggtgaagccatctgggctcctgagtctggtggggacttggggaacctttatgtctagctaagggattgtaaatacaccaatcagcactctgtatctagctcaaggtttgtaaacacaccaatcagcaccctgtgtctagctcagggtttgtgaatgcaccaatcaacactctgtagctactctggtggcaacttggagaaccttcatgtccacactctgtatctagctaatctagtggggatgtggagaacttttgtgtctagctcagggattgtaaacacgccaatcagcaccctgtcaaaacggaccaatcagctctctgtaaaacagaccaattggctctctgtaaaatggagcaatcagcaggatgtgggtggggccagagaagagaataaaaggctgccggaaccagcagtggtaacctgctggggtccccctctgcactgtggaagctttgtttttttgctctttgcaataaatcttgctgctgctcactcggtccacactgcctttatgagctgtaacactcaccgcgaaggtctgcagcttcactcctgagccagcgagaccacaaacccaccagaaggaagaaactccgaacacatccgaacatcagaaggaacaaactccagacacgccgcctttgagaactgtaccactcaccgcgagggtccacggcttcattcttgaagtcagtgagaccaagaacccacca

SEQ ID NO: 23775 - DNA, 1072 bp, Homo sapiens
gtaatcccagcacgttgggaggctgaagcgggaggatcacgaggtcaggagatcgagaccatcctggctaacacagtgaaaccctgtctctactaaaaatacaaaaaatcagctgggcatggtggcgggcgcctatagtcccagctactcgggagaatggtgtgaacccgggaggcggagcttgcagtgagccgagattgcgccactgcactccagcctgggtgacagagcgggactccatctcaaaaataaatagcttctctcgccaggcatcctcgtggaagtgacatcgtctttaaaccctgcgtggcaatccctgacgcaccgccgtgatgcccagggaagacagggcgacctggaagtccaactacttccttaagatcatccaactattggatgattatccaaaatgtttcatcgtgggagcagacaatgtgggctccaagcagatgcagcagatccgcatgtcccttcgcgggaaggtcgtggtgctgatgggcaagaacaccatgatgcgcaaggccatccgagggcacctggaaaacaacccagctctggagaaactgctgcctcatatctgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtattcgacaatggcagcatctacaaccctgaagtgcttgataaaacagaggaaactctgcattctcgcttcctggagggtgtccgcaatgttgccagtgtctgtctgcagactggctacccaactgttgcatcagtaccccattctatcatcaacgggtacaaacg

SEQ ID NO: 23776 - DNA, 1033 bp, Homo sapiens
acaaattgagttacatcttttgactcaactttcattatctgaatagtcctgctgggacaggtaatattctccatttggggctacaaatgtttgcattagaaatcaatctatttgtaaatgttgtattcaattttacatgatcttgatcttattttgtttaaatttgttgtttttttcaatgacaagttgatgcttccataatacatttaaaaacataacatacaatcctgtagttctgactgaactttcgtcaggtttcagcactgtaaaccaagaaacatcaacagatgaaaagttctcctcccaaaagggttaaaagtctccggggtttctaactagattgacttcagtatattctagacattcttttgctgttgcttggctcatttccttcttgataagattctattttccttcctcttcctcttctctctgttacttaatatagctccaaaatatggtatagtcctccaaaccattgctttcagtgaatgtgtttattatgagataactgaagattctgggggcacgtgtgtttcttatgttcctgttagtttgttgcttcccagtccacttctgatataatagaatttggaaccagattttttttttttttttttgctaccattctgacattgtaacagccttttccattctctttgaaccaagattaagccacaattcagtcttaaaacaataaatcatcatttgctccacattcttgacccttggcttaataaggagaaaccttaggaacaaacaagcctcttttactctttcaagtattatcactgtgatttgaatttgtcccccaaagttcatgcattgtaaacctaatccgcaacgcaacagtgttgagaggttggatctttaagaggtgattaggttgtgagggctctgccctcatgcatggattaatgccattgtctccagagtgggtcactgattgtgggagtgggtcctgataaaatgatgagttcagcctctgatgagttcagcctccttccccagtctctcttgctctctccctccc

SEQ ID NO: 23777 - DNA, 1052 bp, Homo sapiens
tcctccaggctggagttcagtgatcttggcttactgcaacctctgcctcctgggttcacgccattctcctgcctcagcctcctgagtggctgggactacaggtgtgcaccaccacgcctggctaattttttgtatttttagtagagacagggtttcaccatgttagccaggatggcctcgatctcctgacctcgtgatctgcccgcctcggcctcccaaagtgctgggattacaggcatgagccaccgtgcccagtgaaaaagctttgatcctttgtcttcaattgcacctatgaaaaggaagtttcgtataaaagctgatataaatggctaataaagcagagaaatagcttaaaatttgactgtagacatttgctatgtatgattaatatgtatcagtttacagttaattttaggaaaacttaaattttataaattgccaagaaatcacccatgaaaaactaattttcacttagcggtttaattttttaacattaggatttttaagtttcgctagtcttatcatctgggacactggaattttgtcttgttggaattgctgattaaacaaaataattcttcaaaagtgcttagcacaatgttaggtaaatagtaagcactaagtaaacattggctttattattattaggtggtcctatactatgattcctcctatttatatcacgtgtgtcttgctgcatatttaaggacgctcccatctatatgtttggactagtgcaatagtaaagctgccagctcaggtgaagaaaaccatttaaaaatttaaagttaagcacatgatggaaaattcttgaatatgtggtgagttaggtataaaaaatatagggggattgtattgttgaatacaaaaaagccattagactattttaagaatgctctcttctgtcattagggcttggttatgaatagtatatcacatgcatgaaaggaggtggtggctagtttcatttccctaaaacatgtttcaatggtaaattagaggcagctgtggtttactgacgcataaacccagtgaggtctatgataactagt

SEQ ID NO: 23778 - DNA, 1032 bp, Homo sapiens
tgtgaatgagggttgctctgaacccttgcaggccacactggatgctggttagaagtacagattctcagttctaccccagacctacagaatcagaatcttcatttggttgggcatggtggcttacacctgtaatcccagcacttcgggaggctgagatgggaggatcccttgagcccaggatttcaaggctgtagtaagctatgattgtgtcactgcactctagtctaggcaacagagtgagaccccatcaaaaaaaaaaagaaaaaaaaagaaaagaaaaagaatctgcattttaacaagagtccttggtaattcacatgcacattgaagtttgagaagcctggctccaactgtctaaaatgtcctggcctcagcaattagcctagacagctgggactccatgtgtccctgtatatgtctgtacccctttcatgtgcctgctatcttgtactgcctgaccaagctatgtgcccttagatttgggaaatatgtatctcctgaaaatcaagtctgtgctttgtctttattgagcagtcagccctgtttcaacagtggtagctgccttcatctgcgtgctagagggctgggctggacttcagctttcacctaggaaatgagtcttgctgccctttccagaaagtgacacatccttgggcactcaaacctgggcatacagaattctcattttactccatccccaacccacagagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtgagccagtgggagaagcccttccaagggagatggcaggacctctctggaggttgatagatagtgatcccccatcggaagtcagagggggtgctgaggtgatgagagagaggtatacgtgtcttcaaggcagtcaaattagggagaatg

SEQ ID NO: 23779 - DNA, 1424 bp, Homo sapiens
ctttgtggaatggagaaagggaagaggttattaaataggctgaagtgccttttcagtgttcctttcaccagatgaaggtaatcttctggctaggaaaatcaaaactccaggctagtattcgctgccctagaagctgaatctggaattactattcttcgaggccattgaaatctagtaaaagattaagttcaactgttagaatggtgagagaaacagtttcagctttggctgataacgcagttgtgtgatacctactgctggaactgtattttgagttttttatgtgcaggtagcttgtattcagacgcctttcttttacatttcttgataataagtctctacttggttaatgttcactgatcagtgagcagtctggccataggccgtactatatccagataatatcgagatgagatggatttttaaaatctaaagtaaaaaagtaagtcaaagagcaatgggcctattatagatattaaatagtaaaacctataattttggccttccctttttcttgggcagaaaaaattgtcgttatattgctttcagagtggaaatcctaaaataggaggcaactgagtgttgtgttactctttcctcctcaaaggcacctgttgtccattatctaacctttgatgtcttgtaattccttacttaggttgggctctttttagagagacatccatttttccctggttcttttttagctccatgcgttggtttattcacagtaagtgttggaccgaaaaacttgtcctatatgtccgctgaagggctgatcttatactaaagtaaaaattgagtgtcttcttaggggatgttgtggagagctgtgctatctttatactgtattgggtcctcatcctgtaggagtggtgagatcactttaacttctttcgtgttggctctaaagatttctggagggcttgttaaagcttcatcttctgtaagtgtttaggaggagtctttctcaccagttggggcacttaatgtttattttcaaacattgattatgctttgtaatagctttcttctttcttaaccagtttatgaggcaagtgatacaaaagaccgagagatgaagatgaattgcagttggggctcacacttttcataaagagcgtcattgttgaccctaatgttggatttaaaaaattcatttgatgccatgctttgggtggtatgtgatgagactttcctttagatatggtgttaatcaggagcagaggagatatgcctatcagaggaacctgcatctgcagagagggaaggaaatggttcctggcagtatttctggagctgttcttgatgaagatacttctcagtgggagctctgtgctttctctttctgtcccccttgcaagagtaaaactaggccccatcttaattgaaaccttaaaggggtgggggaggagtagtgctgg

SEQ ID NO: 23780 - DNA, 1031 bp, Homo sapiens
agcctgggaggtggaggttgcagtgagcgcagatcacactactgggctccaacctgggtgacacagcgagaccccgtctcaaacaagcaaacagacaaacaaaaactcattatgttcttatttctcatttcacctgaaataagtgaaatgttctagactttattgggaatctgataaagaattctgtgccagattctagggtattttcaagtacaagtcatgtgcatgacctgttaatggtttttgaaatcagtttagtcgtggtcaggaccaacattagaaaaatgaggagaagaggaagagataatgtaaaatatcagtacttcgtgtgatattgcttcatggaacatttaatttcagttacatatatttgtcttagatttcagtgtaaaatttctgttggtcacaatcagatgaaagatacatttttagtggctaatccctatctttgagagaataggtggaaaggttgacatacatgaaaaggtggatgaacaatcagaagtaatcattgcgggctatgtctttgacaagtttttagaatctgaatataattagaatatgtttaacagcagcagcagcagaaagatatttattagttgtagaatcagtgtaattcaggcaaactcagtatgtaaagaagtgattttataaaattggtagggctagggtatgtttaccttgcaaatcaattctttactttgaaagagaattttcaggccaggtggtatagctcacacctataatcctagcactttgggaggccagggtaggaatatcacttgaggcctggagttcaagaccagtctgggcaacatagtgagaccctgtctctaccaaaaaaaaaaaacaaacaaaaattagctgaacgtggtggtgcatgcccagctccttgagaggctgaggtgagaggatcgcttgagcccaggaggtggaggctgcagtgagctatgatatgccactgcactccagcctgggcagcagagcgagcagcgagaccctgtctcaaataagaaagaggattttccttg

SEQ ID NO: 23781 - DNA, 1023 bp, Homo sapiens
tgacctcaaatgacctacctcagcctcccaaagtgctgggattacaggtgtgagccaccgcgcctggccaggtttcatatttttttgatgggttatagtccattactatttattttgatgcttaaattgaccctgttttggcaagtagatacccctctaaactgtcttctttgttcttttgccacgttctcatcattctttgaagactttcttgttttgtgacacaataagatgatccaggttcatcttgtgccctttttgctccagccctagaatcagccatttttgccaaggagccctagttcttttatggagaaaggtatttagaaaccaagctctatgtgctagttgtgttcagtgctgctggagtcctcgtcacagtagttaaaattaaggaatatatttatgtacatatgtgtgtggcaatatatagatatagttacagctatatttttacaacagcgtagggttaatttttgtttcctccttttacatatagttacttccccaacagaaacctggcttccattatgcttaatgtatttatttatttgatgagtcctcccctacataatcaatctcctgtctccactggtttcttttttttttttttttatgtagaaaaattcttcttttttttttttattatactttaagttttagggtacatgtgcacattgtgcaggttagttacatatgtatacatgtgccatgctggtgcgctgcacccactaactcgtcatctagcattaggtatatctcccagtgctatccctcccccctcccccctccactggtttctgcttccttgcttgttcaggttctgattgaacctgtgctgggctgccccctcatcttgtgccgacattctcatcccaccagggctccagcatcctatgccaggctgcctttctcatccacctggttgttgataccctgcactaaactgacaccccgtactgtgctgctcctctgccagaatgacctccttacacacttgccttgcactggctgccttgatag

SEQ ID NO: 23782 - DNA, 1063 bp, Homo sapiens
tatcttcacctcctctcatcttcttcccttcattcttagataaaagtatctcttctcagaaaaggctcattctttgtcttgttttttctattttagcccttcacatctctaacgctggagctctgctccatgtccttacgtgttagtataaataactctgttggttccttccctcaaccctgtaaatctattactcttacatttaaataaaaacaccactgtcagctttgcagacactctcttcacccccgtctggttaaaccctttccatcttcaatcacattccttaaaagactgccttacctcccagcctcacttcagtgcattgcagttatgcttctgttcccatgactccactgaaacttctctggtaaagattccttaatactggccaaatcagatggaccatttttagtcattgtcttttgatatctttgcagtctaacattatgtctcctttcctgaacctatgactagctttctgacagtttttattctgtcttctctgctggataactttggccctattcctttctcactccaagtcatcaattctcacaactccagttatcagatatgtcctaataaagctccgaagtgtaatctctaattcaggcctctatcttaagcccaagacctagttatacttttgttataatgacctcaaactcagcagatccaaaaccacacatctttctgctccctcattccccacactgttttttttcctttgttctctatcagtgcatgttattgaaccatttattcagtcatccaaatagaaaaacagggatcttcctgtactttttatcctcttatgtaatcaatgaccatattccatcaattctgtcttgagtatcatctattaaaattatccctttatggctgggcactgtggctcacacctgtagtcccagcactttgggaggccaaggtgggtggatcacgaggtcaggagatcgagaccatcctggctaatatggtgaaaccctgtctctactaaatatacagaaaattagccaggcgtcatggcgggcacctttagtcccagctactcaggagg

SEQ ID NO: 23783 - DNA, 1033 bp, Homo sapiens
gatagacttgaacacaaagataggttgaggacaaaaaggcagcagagaggaagaccaatacggggaaatggggtggtaattgatgaggcaagtgtcctgagaatttgagaagggatctttgagaaccacaacttctagccctgataactgtgaatatatatcgagataatgataacctttaggtgcaaagataggtcgtcagtggtagaaaaaaagagaatgcatgtttgaaatggttaaagcggagaatggaagaccgtagacatttgaaagagatgctgagagaccctgaggctatggaggcgggatacttattgtggaggaaaggtgagtatcattctgcccggttttgtgattcccactcttttccctcttggcctcatgtactctgggtctgtgtatttacagtggagagttagatggaagaaaggattgatctttttcattagtgatagtgagataaatatgtcaatgacaaaggacaaggggcctgagggtttggcaaaagacttgataaaaaccactttgactaataaagtgttatattatgcttgcttgcttgatttatttatttatttatttatttatttagagagtcaactttgaggaccgccaagatcaagccagaaaacaattttgtttggttatgaattgatttttataggaggattttggatttttagagtaggataaggagctagatctgttaatgtatatgggctttatagggaatataagctttgtatagagagggaagaacaaatttcctatatataatatacagactcagaacccgagggtacatataagtattttaaaacctataatagaaaatgataacgatgtttgattgctattcacatttttaaaagcttattttaaatagtttatattagtttttttaaacttttttaggagacacggtcttactctgtcacccaggctcactgtaacctcaaactgctgggcacaagtggtcctcattcctcagcctctggagtagctaggactacaggtgtacaccaccatgccc

SEQ ID NO: 23784 - DNA, 1044 bp, Homo sapiens
tatttgatacagcatttttaaaggcaaaacagaatcttcgatatatctatgttagtgggaggtcaaatgctattataacttttattttttaaccataactataaaattaaggcttatttcaaaaatatagtactatctggggtgtgtgggggtgtatgtgtgtgtgtgttaggggatggtgggcaggagggctgtggaattacagcaatataagtttcagtggattacagatttgcattctttatgttcttttcatcagttaactaatttactccaataaaagtgctcacaggattttcccccttttgtaatttctagcaaattattcgatgtagagtttggagagaccataggtgatcagctacaaaatcttaaaaccgttttcttcaaagaatgagtgaggaaaaatcttaagtaataagatcatgtgtaacaatgtactgatggaaaatgcttacctcaataaactaatgctagtgaccgaattattcattggtgtggattcatagatacttaaccaaacagttgatgacaagaatgttgaagaaataccaagatcttcagcccttttaaaaattccgtctagaggccgggcacggtggctcatgcctgtaatcccagcactttgggaggctgaggcgggcggatcacgaggtcaggagatcgagaccatcctggctaacacggtgaaaccccgtctctactaaaaaatacaaaaaaaatagccaggcgtggtggcaggtgtctgtagtcgcagctactcaggaggctgaggcaggagaatggcgtgaacccaggagggggagcttgcagtgagccacgattgcgccactgtatcccagcctgggtgacagagccagactccgtctcaaaaaaaaaaaaaaaaaattccttctggaactcaatctttgtcgtcgtcattacagaatctagactttcccctacaaaggatgctaaactttattacctgtactccactttgagtagaaaaagggaaactaagaaaatgttagaaaattttagtacaattttaaataaatttcc

SEQ ID NO: 23785 - DNA, 1046 bp, Homo sapiens
actttatagaggcagggtgtcactgtgtttcccaggcgtgtctcaaacttttagcctcaagcagtcctcccatctctacctcccaaagcgttaggattatagctgtgagccgccgcacctggcctacattttttagagatggaaaataagtgtcacatgatctcattatttctggaggagaatctgaatgtcctcaaaatgtttttttcagacttgaataatcttaaatttaatttttctcttgtagaacttcaaactaggcctgtttagatttaacacataattacctggtcatgttgagaaactgaatgactcagatctctactggaaagaaatctgcttattttgaggaaaaaggaagtcatcaatcactaaatccaagtcttcctcttactgtgctgcctccctgctctaggattagattcattgttatttaccatttcagtacagtgatatcctaactgtacaggtatatcaaaatggaaggacagttataatatcttagaaaattgagaagtaattgactgttagctacctgtccaaaaatggcttcagattaaaaatacttgaaaagtcattttgaattatatactgtctaaaatccctcagtaatttattgtagccaaatgctttatcaaataatttaaaaataaataaaacgaactcatttataaaattggggaaaggaaaaaccctgaataatcttgtcattctaacaggttacagttctgatgtgtttctttattgttctttatcagatatacattttatacattcattcattcatttaacagatatttactgagtgcttattttgtcagaccctatcctaggcattcagagttacagtagttacagtgttgaactgtgtggaacttacattcatgctccatagacaaaacagataaatacttcatatgtcaggaaggtgatatatatgaggaaagaataaggagagcagagaattgctattttatatagagtagttagggaagacatttctgatatggtgacctgaaggaagtgaatgaaatatgaagtatgta

SEQ ID NO: 23786 - DNA, 1047 bp, Homo sapiens
taaagcaagcttaaaaagaaaatcactggagcaactgatcttggaatggagtatgcccagagccatctcccttctccactctgcctgaatttttccttttcctttgttacaatttgtgaacgattaatacttttttataaggatcttaaattactttaaaaaccattatttatacgtgagtatgaaccattttgaaaatatggctttgctcagaacacctgagataactgtcccaaaagaatgagagttttgattagggaatatgataaccactttgcaatttgggacacctcggagtatcagatggcctaagggagatacaaaagtagaagagcaaaacccaaggaaactgaagggcaagcattaggaggaatgggtgaaggacacagaagggaaagtgcaacatcaagtatttcaattttttgcctaacaatcactctttccaaagatagtagagcagaaacatcttcctcttctactgtactccctgatttccagctgttgggattcagagctcaagctagtactatttggattaaaaggaagctgtattgtcacccggtaactggactagcctgaggcccttagcagtatctgaacagcactgcctaatggaaatacaatgtataacgcatatgtaattgaaatttttctagtcaaatttttaaaaagtcacaagtaatattaagttttaatagcatatttttaactcaatgtagccaaaatactgtcattttgatgtgtgatcagtataaaaaaattattagtgagatattttacttttcctttcatactaagtcttcaaaatctggtttgtatatttccagtatatctcaattcagactagccacatggtaagtgttcagtaatcagtgtcttgtcattttagacagagcaggtctagatcatagttttagagtggaaatgtttcccgagttctaagtaatagaattttggaacaaagtctaaaaatttatttaacctctctgagtgttggtttccccttctgtaaaaggaggttagactaggagagctataagatttcat

SEQ ID NO: 23787 - DNA, 1035 bp, Homo sapiens
gatctgcatttctctgatgattagtgatgttgaacagttttttgtatacctgttggccatttttatgtctttggagagactacaaaagaaaagatgtccttagtccattttaaaatctgttatttaactattgagttccttatatatttttgagattaaccctttattagatatatggcttgcaaatattttctcccgttctgtaggtggcctttttattgttgattgtttcctggcataagaaaaagttatgccgtttaacatctgtaggttcatccagtagcgtggtagacatggttgttgtctatccaaataatctcactcttcttttcaagtgttagaaaaactgctgtcacaaaattttctttagcatttttctactcagccttcctggacttcttgtagaaatgtgtcaacttagataaattatattttaattatcaaaaaattattctcagttaaggaaatggccattggtttatttttccctacaatgttttagactaggactttatagtatcactttgttttctgtatgctgtgtaatgtagttggccctctgtatccatgggttctacatccacagattcagccaaccatgggttgaaaatatttggggaaaaaaattgtctgttatactgaatatatgcagacttttgtcattattttctaaacaatacaacaactatttacatagcattcacatcatattatgagtaatctagagatgattcaaaatatacaggttatatgtgaatactatgccattttgtatcaggaaattgagcatccatggatttgggtatctgaggaaggtgttcctaaaatcagtcccccgtggatacaggacaactatataacaaaaacaattgtatataatgagactaaaactttgaagtagtcatttttgtcttgtttttattgtatcacgttaataatccacttttgtatgactatacagaaaatacgtatgacttaacttttgtcttgtgtttcaacagaaggagaatatattaaaatgtttatgcgcggtcg

SEQ ID NO: 23788 - DNA, 1027 bp, Homo sapiens
tagaaaggaacttcagcaaatgaaaacagttcgttagcatgccacagttataaatattttctttgaacttagtgtttcattaatctgtgcagcttaacaagtaaaaagtacagctgaaaattcagaaatcttcagatatttgatgattgtttgatttgctgaagaaaacagataaacgtatgttttttaacgattaaaaactgcttatttgaaaaatgtcagtacaaaggtattctgttgtttcatgtttcctgtgtttaaaatcattcttaatactgctttttagccttgctatacatcctgacaaaattaggattgcaactggacagatagctggcgtggataaagatggaagggtgagtggcatagtgttatgccttctgtacctagagacattgctgttagagtggaatctattgtaattttaaccacaactcatttgttttattcttttaaaatttaagtactgaggaatttctagtataagcatggaaaaaacattaggatataagaacactttaaaagacagagtcatactaataaattttgtttttaaaaaataagtgttctcccttaagaagctatttactgtaaaaatgggaaaactgatacgctcgttacattttctttatataaaataacatataaagtaaccagtgtctgcgggaaggtactgcagtttcccttagttgatgaacctgttgattcttatttactttcttaattaattaattaattaattataggggtggaatctcacttcgttgcccaggctgggctcaaactcctgggctcaagtgatcctccagccttggcctcttgagtgagtagctggactacaggtgtgtgccaccatgcccggctaactcttgattttatgtgtgactagaactgatacaacttaaagagttacagttactatttaatattattcagttggtttgtataacaaataccttatttctaaggatcaacagtgactattaatggtgactgagtaacgtatgtatgactatactcatgacat

SEQ ID NO: 23789 - DNA, 1032 bp, Homo sapiens
tagagacagagtttcaccgtgttagccaggatggtctcaatctgacctcgtgatcctcccgcctcggcctcccaaagtgctaggattacaggtgtgagccaccgcacctggccgctaaattctttttatatgttactcttcacaagaatgtaacatagtgtttattaatatcgtgattgcacagacaggaaaccaagacccatagagttctgttacctgtgattgagctcaggttctgcatggttccaaagcttgtcctttcctctaatccaacagtactctttgagatatttacagcattaattagaaatattgttaggaaggtttatctttgacaattaaatcactgattgacattgttaaagcatactatgtatacaagggagttaaacactaaatgggcgattgtaaggctagcggggtttgaatcatgaagataaactgctttggttgaagaaaacactgtgtgtttacaaatagacatacacggccccaatttgtagggaaaattgttctgaaaaactcactgaaattactttccagcatttacatagctgtgaagtcatcattgacaagcttaaaatggaaagtcactcaattttagtgacttaaactaaaggtaagccaattggtttctcttggagttgtaagtagaaaacacttcatgagagtgatgtgataactaaattgaaagtgctggcagtccatttggggattgattagaatctaggggagatgtagttgtcagtgttcattctgtatgtaactcctgtctttggtttcagatctggttaggttctgttgatccttggggaactttctcatttgtttttatttttgccttggatctatgaatacctgaatgtattgtctaaaatggaaaaatcttaatgtagccattctattactatcactgaccctaggcctgaaaaaagtcacacctagggttaagaaatttttattttattttattttatttacttatttagagacagtttccctcttttgcccaggctggagtgcaatggcatg

SEQ ID NO: 23790 - DNA, 1049 bp, Homo sapiens
ttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcc

SEQ ID NO: 23791 - DNA, 1038 bp, Homo sapiens
tgagccaagatcacgccattgcactccagcctgggcaacaagagtgaaactccgtctcaaaaaaaaaaaaaaattgaagggaatttgtaaaattctggactaggctggctgggcacggtggctcacgcctgtaatcctagcactttgggaggccaaggcaggcggatcacggggtcaggagatcgagaccatcctggctaacatagtgaaaccccgtctctactaaaaatacaaaaaaaattagccgggcatggtggtgtgcacctgtagtctcagctacttgggaggctggggcaggagaatggggtgaacctggggggtggagcttgcagtgagccgagatcgcgccactgccctccagcctgggtgacagagtgagactgtctcaaaaaaaaaattctggactaggctaaattgtctgtggtagctcacacctgtaatcctaacattttgggaagctgaggcctcaggatcctttgagtccaggagttccagactagcctgggtaacatagggaaaccctgcctctaccaaaaaaaaatagccgggcatgatggcacatgcctgtagtcccagttacttgggaggctgaggaagattgcttgggcccaggaggtcaaggctgccgtgagctgtgattgcatcactgcactccagcctgggtaacacagactgtctcgaaattaaaaaaaaaaattatggttttggtgtaataaatataaagtagctttgtacctttggcccaattaaaattttcacattaagatttgtccgagatggtcgtttattaggacaaaagaagccttatgattgcaggagaagaaacttttgttttgttttgttttttgttttttgagatgaagttttcactcttgttgcccagactggagtgcaatggcgcaatcttggctcactgcaacctcttcctcccaggttcaagcgattctactgtctcatcctcccaagtagctgggattacaggcatgcgccaccatgcctggctgttttttgtgtgtttattagagacagagtttcacc

SEQ ID NO: 23792 - DNA, 1042 bp, Homo sapiens
tgtgaggtggagtctcgctcgctctgtcacccaggctggagtgcaatggtgcgatctcggctcactgcaacctccgcctcctgagttgaagcacttctcccacctcagcctcctgagtagctgggactacaggtgtgcaccaccatgcctggctaatttttgtattcttagtagaggcagggtttcaccacattggcccgactgctctcgaattcctgacctcaagtgatctgcccgcctgtttgctttttttaaaactgtgttccagttttcatgactgtgtgttattccacactttgaggtactgtaatttgaccactgtgtactggtagaggattagggtatttttcatcgtttgctactgagcagtctgcagaacatagccatgattgctttgtgacaaggatatgttctgagagatgcgtcattaggtgattttgtctttgtgtggacatcatagagtgtacttacacaaacctagatggtatagcctattacacacctaggctatgtggtatagcctatttgtacttagggtacaaatctgtacacatgttattgtattgaatactgtatgcaggtgttacccaattttgggtatttgtttatctaaacatatttaaacatagaacaagtacagtaaaaatgcagtagaaaggataaaaagtgatacacctgtgtagggcacttaccatgaatggagattccaggccttgaagtgagtcagtgagtgagtggtggtagaatgtgaaggcctagtacatactgtacaccactgtagacttactaaacactgtacacttaggcaacactaaatttatggaaacgttttccttcaataatgaattaacccaatttattataactttttaacttcataaaccttttaattttgtttagctttttgactcttgtaataacaacttaaaacacaaacacattgaatggctatacaaaaatattttctttcatcatatatccttattctataagctttttttctttttattttatttattttttatttttatttttttgaaac

SEQ ID NO: 23793 - DNA, 1050 bp, Homo sapiens
gctgactttttattttttgagccaatttgaataaatgttttactccatgacatgttataacagagcttccctttccttcttttttaccccctgcacaggctattttttttcttgatttcatgataacgacctgtttatagtaaattggcttgtcaattattatatcttatagagtgaaaattctttttatttgatgtttgattctcattcagaaacttgtttttgcctcttcttttacagttttttatttactatccaaatgtgttttttaaaacgttaaaaaaacaaaccaaaacagatacttaattcttccttattgtgtttgtggtttattcagtgctgttgggacattcgccagagccctggattgcagcagttctgtgaggcagcctagtttgcatatgagtgctgctgcagcttcccgagacatcaccttggtaagacatggtttgaaattttgtgggtatttatccttctgttacttgtttaattttaaagccattgtggcaatactgtagaccgggagcttttgggctcttagccttcctgactgctaggttgatttggcttggttacttggttgactgggttatgataacactcgtctgtgagttgagagttttttgtgtctgttcattagaaagaggggctgtttttttttttttctttctttttatatttggagatggagtcttgctctgtcaccaggctggagtgcagtggcatgatctcagctcactgcaacctccgcctcctgggttcaagtgattctcgtgcctcagcctcctgagtagttgggattacaggcacgtgccaccacacccagctaatttttgtatttttggtagagacggggtttcaccatgttggccaggttggtctcaaacttctgaccttgtgatccacccgcctcggccttccgaagtgctgggattacaggcatgagccaccacacccggccagaggggctattttctatataattttattacattatagttgatatcttttaaatctatttacttttttctttcggtgatcaaatgaagc

SEQ ID NO: 23794 - DNA, 1985 bp, Homo sapiens
gggcgtggtggcacatgcctgtaatcccagcgacttgggaggctgaggcagaagaatcgcttgaacccaggaggtgcaggttgcagtgagctgagattgcgccattgcacgccagcctgggcaacaagagcttaactccgtgtcaaaaaaaaaaaaaaaatcttaaaactttgtattttgtggtaatacaaaaatagtgcaaagacttcctgtattcacttcatccagattccccagttgttaccatctttaccacatttgctttattattattattgtcaaatgacacaaattagagaatttagtttaagcatctaattggctttcatttattctatctataaagtagaataagcattctgatgagctgagcagaggtgattggctttatagacaggaaagggctgaagaaaagcagaaacagggaacaagaagcagattggttgtttcaaagttgctttccttaaaatagagaggacttccttatgcctactcaggtaaactggccccttctgattggttgctgtgaatcttggcactaagcacaagtgactgctttctagtctgatctgctggggcctagtgcgagagctcagtccaaaataatggccttccataaactctaacactatatatatatatatatatagttcttaacagtttgaaagtaaaatttcagaataaatgtccctctactgctaaatatttgaaagagtatttcctaaaaataaaaaccaaggatattctcatatattagttcagtataataatcggactcaggaaattaaccttgttacagtactgttgtctaatctagagactttattcagatttgttagttgtcccagtaatgttctttatggcaaaagaaaaaaaaaattctggcccaagatttccttgtgaatcacttgtgacatttagttgttgtatcttcatagtctctttcattcctgaacgattcgttagtctttctttgtgttttatgaccatggtattttgaagagtgcaggccacttattttgtagaatgtccttcagtgtgggttatggttataatctgatttataattagaataaatttttgttctacttaagtccattttggtcagttatgtccatctaggagattatatatttccccctaaaattttcaaatttaacatttttacagtatttttaaacagtttgccgtatttgtagttacaaatagattttcattcttgttattgtttatatgtatcacataacctttttttcttgattgttttgcctgaggtttctttattagttatctaaaagaatgggaacttaattttggtaattaaaaaaaagtggtacatattctgtttatttttactcttattttcttctgcttttctttaggtttactctaatattcttttgctagcctttttaagacctttttaaaattacttttcatgataaacatacaagattgtgaatgtccctctaattatcaccttggctgtagcacatatcttttagtatgtagtatttttattatcatttggttctaaatattcactaatttgccttataatttttaatttaacttgtgagttaatttagaaggaagtgtggctcatctacctattttaattgcctttgagaatgtggtcagagaacatgtgtgctaccaattgtttccatgtcttgagatttctgttagggcctggaataggatcctccccagtattttgctccctgggccttactgactctggcaacatcaaggtctgatgcttgtcacatcagactagtaaaaaaggaaacttgctgtttggctcgatttcaccttatagcagtctagaaaataccctcatgataaaggccaagatcagtgtggaaactcaactattacacttttcagagggatcatcacctctccttgcctgtattggttctccagtgtcttcacacagttgttttcacatatttgtctggtttgtgccaagaatcacagcc

SEQ ID NO: 23795 - DNA, 1872 bp, Homo sapiens
aagtggctgggattacaggtgcgcgccatcatgtccagctaatttttgtatttttagtagagatggtgttttgccatgttgaccaggctgggcttgaactcctgacctcaagtgatccacccccgcccccctctgacctcccaaagtgctgggattacaggtgtgagccaccacaccagaccagcatatgaaaaactttgtccatatcagtttgaggtttactcatgagagtttattataatcttcctctgcttggaaaaaaagaatgtggttattaatttttaaatagatgtgatattctgaatgctgtaattcctgtaggaggtatatatgtgaagtttttgtgaaattgtaactgaacaaatcagtacagatggccctcgacttaggatgttcaacttaacaatttttgctttgttttgttttttacaatgggtttatcagggtattaaatgcacttttgacttatgatattttcaacctatgatgagttttttgggacgtagccatcagttgcagagcatttgcagttagtattgaatatagtatatgtgtatcagttagctgttgtcataatactgcattttacaggttgggttccctggaagcagattctgatagcagtttttatgtgggaaatttattagggattccccttgggatcagcacttgtggaataaaaggcaaggaggcaggattgactagtgggaggaggtggatacaatcgaatgaaggcctcagctgactccagctgatttgtggcatcccaaatcagggtgaaaagctgggcctttacagccctgcattattggatgcaggttgctccaggaagagtgtgtggactttcacgatgaattgttcttgaattgaaataattccgaaaaagatcagcagctgaggactgtcttattcacaacacttctggcaactaggtgaattaagttctttagtctcaaagaggaaaacacatctattacactgcccaaatttcagtggcttataacaacaagcattgatttctgatacactcatctgcagattgtctaggattctgctgagctagactgggctctgatgtaggtgccaagctataggttgggtccagatctgctccatgtatttctcatcctccatggacaaaactcagtagcacaagagggcaaggccaaatgtgcaaacacttgtcaaggctcagttatgtcacatatcctaacatcctatttgccaagcaagtcacatggccaagcccaacatcagtggagtggaagaatactctcctgtggaggtgtgggggagggaatgaatatttgctgaacaatagtccaatctacccatagtgtggttctgcttaacaaaagatgagaattccattgccaagatttacttgtcagtctttctcctaaaatacttctttttgtcatctccatctgttatgaatgagatgaaatgtgacaacaccttcactgctttttggcagagagaacagcttgtgctgggttcttaagatttttacaatttagatttgaatggatcgtgcaatgtgtattggtatctctattgaaaacatggtatctttgcaaagtatttaatctggagggaagacttttagtttagttttcttcttctttttttttttttttttttttgagacggagtctcactccatcactaggctggagtgcagtggcccgatctcagctcactgcaactgacacttcctgagttcaagggattctcctgcctcagcctcccgagtagctgggactacaggcgcgtgccaccatgcccggctaatttttgtgtttttagtagaggcgaggtttcaccatgttggccaggatggtcttgatctcttgacctcgtgatgatctg

SEQ ID NO: 23796 - DNA, 1048 bp, Homo sapiens
atcttactgataaaccgcaagtcgttggtcctgtgttatgttactgtgtcttttcctagcttattttctttatttaccctacattttctctactggattttgtctcttctgttatagaaactgtattcatgtaaagctcttaagggtaagattagactacgtaaagtccattcaaaagaaacttctgtgtgtatcagaaagatggggtttatatggacttctggcacataatatgattctctggtttcctttatgaagttggtcagtttcaaaggaattatttcctagtaactccacagtgtacacacctgatgagtgtttactttctacacattctgagctttactctcctctcctttggtctttggtataaatgtgcgctttggaggtttcatatctcctggtgaacagtaattccaatgtattctttctcatttgatttgagacagtacaggagctcctcctctgaaagcaaatggttccttcagtgttcaggaacacaaactaaacactaaagagtagaacctttgaaacaatgaatataatcattttttgtcataatcacttgatgaaggctaagatactacttcagttctttgaagccctttaggtaacagcccatcatcatttaaaaaagtatccataagaaaagcagtttcactcatttaacatgaacacaaaactgaaaatccattcatgatttgagtggttggtgtagcatcagctgagaaaaatgcacttaattctgtgactggtttcagagcccctgttaattataaaaatttcttttggctagatgcagtggctcatgcttgtaatcccagcactttgggaggccaagacaggcagatcgcttgagcccaggagttggagaccagcccgggcaacatggcaaaaccctgtctctactgaaaatacaaaaattagctgggcattgtggcatgcacctgtagtcccagttacttgggaggctgaggtgggaggatcatctgagcccaggaggcagatgttgcagtgagctgagatcatgccactgcactccaacctg

SEQ ID NO: 23797 - DNA, 1035 bp, Homo sapiens
agacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttgtaagtagaaaattatgagtaaaataaaatgttgagatgggaatattctgttttagaaatctggtaaaccttacagtattcatttagcaagtttgtgagttaatagtttttatctgctcaaagtaaaatgaaggttagtcttgtaaagggagaaactgataattgtttggaggagtagttgtagtaagacccacgctatcaggccgggtacggtggctcacgtctgtaattccaggactttgggaggccgaggtgggtgaatcacaaggtcaggagttcgagaccagcctggccaatgtggtgaaaccccatctctactgaaaatataaaaaactcgctgggcgtggtggcacgtgcctgtagcccgagctactgaagaggctgagaaaggagaatctcttgaacccggaggtggaggtttcagtgagccgagatggcaccactgcactgcagcctgggcaacagagcaagacttggtgtcaaaaacaaaacaaaacaaaaaaacccctacactatcaggaagtcctgtgtttttggtgtaaaccttggcaatattaatttatcctatttacttctctctgagttccaagttaaaatctggtcagcttttctcaccatttgcgctaaacagtctgatctctgcttttagactagttgctctgctttaagctttctgtatttttctagttgtcttactaattgttgagcctgaatttgatctggacccttaatgaaatgacctctgctaagcacagtaggagaatttgttttatgggcttttgatctttgattcttcttaatgatgtagaggagtggtccccaacctttttggcaccaaggaccagttttgtggaagacagtttttccatg

SEQ ID NO: 23798 - DNA, 1052 bp, Homo sapiens
agtcattttgtttaatagatacaggtcttttattgttacctctttcttcttgagtgagtttggtagtttgtcttccaaaggatttgtcccttttatcttaagttgtctagtttactattataaagatgtttataataggagtttagaattttctcatgttatccttttatggtctgtagcatggatctgtatttacatctactctctcgttcctgatactgataatttgtgtctttttttttttttcttttttcttgatcagtctggctaggagtttatcagtgttgttgaactttgcaaaaaaaaaaaaaatccagcttttggtttgattgactttgctctattttctgtttcagtgatttctgcttgtgtctttattacttctttcctttacattgctttggacttaattgctttttttttttcctagtatcttcttattgattgaagcttagggctacagatgtggtaacacaccctgtagtcccagctacttgggagcttgggaaactgaagcgagaggatcacttgagcctgggattttgaggctgcagcatgctatgaccatgcctgtgaatgaatagctactgcactccagcctgggcagcatagcattacactatctcagttaaccaaacaaacaaaaagattgaagcgtgcatcattaatttgaaatctttcttccaatataagcacttaatggcagtacaacgatgaattcagctttgcttgaaaaactctgctattacttaaaacatatttcattttttatgtaattcacttttatccttttctttttcagtactgtaaagctgtctctttatctgatgtacctagtttctgatgagaagttcctatgatgtgatgtttctttttctttgttttcaaaattttctgtctacttttggtttttagcatttttacttccacagtgtgactgagtatgttcttctttgtaattattctatttgtaattctctgagcatcctagagctgtttttttgttttccattaattttgagtaattcttagccattttctttttaaacatt

SEQ ID NO: 23799 - DNA, 1057 bp, Homo sapiens
gtacacttaaagcccatgggctcttcattttagtcagctggtggggaatgctgtccggcctgggatcacccttcagggcactgggctcccctctggcccaaggcaggtccagaaattctgttcaggaactgaggcctgaacctggggaccccaaaagcctgcttattcctccaccccactgtggctgagcagtaactaaggtgcaaaacaacaacatccctttacttttccatctttttaaacagaagaagcctttcaccatagccacctatagctgggaatgtgcttgggaatgtgctgggtcacactgtagtcagcacatctcagagcccaaggcccatggtgtactactacccaggcattgctgctggttactcggggcccatgggctctttagtcagcagctgatgaatcttgcagggactgggtccttcctttaaggcagcaggttctgttttgtccagatggtgtctagaaatgtgtataggagctagggcctggaatgggggcctcacgactctgcctggtgccctgtcctactgtggctgagcaggtatccaagatgcaagacaaagtcctctttactcttcactttccatcccttaagcagaaggaaggagacatttttgcccctgagctgtactgcctaggtttgggagaggggtggtgcaatcactcctttagccaccctgggtgtctccctaggtcacatgccacccgaagtcctctggctctgagtccagcccagcactaggagttgtttaggagttgaagtccttgtgtacctaggctgtcttctaagtttacgtaggtcctcagagcacttcagcccatggtcatgaggcttgttgagaaactcaagttccaaccgataggataggtgattaccctctggctaggtctggtacagattctccctccctacacaggtactggctgaccccagcatggatttattctctgctgtcacagggcagcactaagttcaatgtaaagtcccctggtcactgtgatgttcttcctccatatgcacagactctggcactgcaaggcctct

SEQ ID NO: 23800 - DNA, 1023 bp, Homo sapiens
atgcttatttagttctacttagaatagccacagtcactcctcttgcctggattttggaaataaataatctctgaatatttttctaaaagcagagagagagagagagagtgagagtgtgtgtgttttcttctagagaggcaaataagtaataaagtagaaactaaatttggaaagtaaaaatggttactttttaaaggtcctgtttattcagtcatagaggaatggaaaatggagttgctcattgctttatttttttaaacctatgcctaaaattgtattaatacttaaagttgtgtaccacagaatctagtgacttttcttagacattattgcagtttaagaatatgcatatgaaagaaaagcttaagatggtaatttttgaattacactttaatacgtattttcttgtgaatttttaagacaatgaacagtagtaataattaggcattgcatgtaaaatgttttattcatcttttgaattagaaacgtctaaaagcagcagaagctgagagtaaactgaaacaagtatatatcccaacctagtaagtaattgaaatcttttaaaatatttgttttggtcttaattttatcattgcagaatatgtcattttgttcagtttcagcaaaatttgaacttttgtgtatctttcttcttctacaaagcatgagacttactattataccactacaataaaaaggagccagtgagagaaacctcaaatagactaacctgaagactagaggaagaaatgtactatgtactatacttttattaaatcaaagctgcagggaaagcgtcagaaaacctatgaaatgctgtattatttgaagcaaatgtgtttcagaaagctagcagcttttcaaactatagattttgtttgggtaatgcatactgctctttggaggtttgttgtttatttggttgaggattttacattgttttcttggttccaatggcaattagaaccatatttggtaaatgtgtgataaataatggagaggttttgattattttgtttgtct

SEQ ID NO: 23801 - DNA, 1028 bp, Homo sapiens
taggtagtgccacaatgtaacccctaaggatgctgttataatgagactccataatcgagacagtacagtccagtcttacatggattcattaggtttaaataaaatttgccaatttacactaattagagactgtatgtctttgtaaacctctcgtttttctcatgaaccttttacaattgtcatacaacattatggaaattcacccttgattcataacaaatactatatttattagaaggtctagcaaattacaagtaaattttaaactcatttttgggtgagttttctgaaattacacattgcattttcataagctagcatctaaacatatggttgagcagcctgtttgtccagtttggtttccatttcatgatcatgtatcatatatatcaccacataacatttacatgacttactactcttattttcaacacatttggtcttgcttatcttttttatttttatttttgttagcacagagatcatatgtgtccatgaattgtggatcgttttgtcattaccatgtctctgacaatatgtgtataattaatatgttagctctggagtcacattccaggctagcatgttagagccgtgcagcttttgttccttaaggggtgacaaaacttgctgtctggcctaacagataggaaatcctaaagccattctaagaaatctcttactatgaaatgttcccctttgatttaaagaggatatcaataaaaggaatgatgactgaaaaaaacattttttgttcctaaagataatttttagcagaatagttgaaaggctttaaaacttaagtagcagctctataagaagaaaaatgctttgtaaagggagttgagggctgggcgcggtggctcatgcttgtaatcccagtactttgggaggccgaggtgggtggatcacctgaggtcaggagttcgagaccagcctggtcaacatggtgaaactgtctctactaaatatacaaaaattagccaggcgtggtggcaggcgcctgtaatcccagctactcaggaggc

SEQ ID NO: 23802 - DNA, 1070 bp, Homo sapiens
ttgagattcccactcagatgtgactgatttcagaatcttctcgtttaaccactgttatgaatgaaatcgtggctctcaaatgcactgtattaggttctatcagcaaagtagaaactatataagttatttcaacagctaatttcataaaagaaatcagtatgatggatattggaggacagaataaatcaacagagaacatggggcaggggcacaggaaacagccaccattctcagggttgggagagcacaaggaagaagctgggcttatcacaacccagaagctcaaggagggcctcagagccagaacgcaacccagaggagagggcactgccctgccggtgcaggcacctctcaggaggtgtgatgaggctggttctggtacaagcttctgcacctacctggggggacactgacagggacaggaccgagcagttcctacctccctgctccagcactgcagaatccttctagcgccctgctggtgtgacacagagccagacagcaaaggggaagtgtgcttgtagagtcccacccacccccagcatcatggagctgagaaacaagagtgtaatggaggcacacatgttagaaagtgcccacattcttgtgttacgaatggaccttttcattgggataatgggcctgtttcctatgtccacagggtataggatcctgattaaccagagtttccaagatgaactcaaagtactggaaaaaatgttctgttaatacttttcatgagctagttattaccatcatatactgaaatagatacaaactcatgggaaagccttgttctgtgtgatccaataataaaatcaattagcactgctacttaattatcagcatgtcagacagatgagcataccaaacagagtgttgatgggcagaagaaactgaattggaaacaacacccggggctgctgagatgtttaggcctcttagctttagggcagcctgcccccttcagtggcttgcctcctccactcaccctctacctttgcattgcaggttctttttttttttttaattttattattattgtacttcaagttttagggtacatgtgc

SEQ ID NO: 23803 - DNA, 1065 bp, Homo sapiens
cttccacacttccctagcagaggttctccatgagggccctgcccctgcagcaaacttttgcctgggcatccaggcatttccatacatcttctgaaatctagatggaggcccccaaacctcaattcttgacttctgtgcacccacaggctcaacaccatgtggaagctgccaaggcttggggtttccacactctgaagccacggcctaagctctacatttgcccctttcagccacagctggagcagctgagacacagggtaccaagtccctaggctgcacacagcacagggaccctgggcctggcctatgaaaccactttttcttcctgagcctccaggcctgttatggaagggactgctgtgaagacctctgacatggcctagagacattttccccatggtcttggggattaacattaggcttcttgctacttatgcaaatttctacagccagcattaatttctccccagaaaatgggtttttcttttctatcgcatagtcaggctgcaaatattctgaacttttatgctgtttcccttttaaaactgaatgcagtacccaagtgacctcttgaatgctttgctgcttagaaattttttctgccagatatgctaaatcatctttctcaagttcaaagttccacaaatctctagggcaggggcaaaatgccactagtctctttgctgaaacataacaagagtcacctttgctccagttcccgagttcctcatccccacctgagaccacctcagcctggacctttttgtccatatcactatcagcattttgggcaaagccattcagcaagtctgtaggaagttccaaactttcccacattttcctgacttcttctgagctctccaaactgttccaacctgtgcctgtcatccagttacaaagtcgcttccacattttcgggtatcttttcagcaacaccccactctgctggtaccaatgtactgtattagtctgttttcacactgctgataaagacatacccgagaatgggaagaaaaagaggtttaattggacttacagttccatatggctggggaggcctcagaa

SEQ ID NO: 23804 - DNA, 1030 bp, Homo sapiens
gttggtgtgtgtacactcacagttttttatattgctggagttacagtgtgcatactacttttttaaactatagaaaataatcgtttcccctatatccttagacattcttcaaaacattaatggtcatgttaacattaagtacgatacatttctatattttttcctataataaatacctctgcagtagacatctttgaacctaaatgagatggagtttcgctcttgttgcccaggctggagtgcaatggcacaatgtcggctcactggaacctccgcctcccgggttcaagcaattctcctgcctcagcctcccaagtagctgagattacaggcatgtgccaacactcccggctaattttgcatttttagcagagatggggtttcaccatgttggtcaggctggcctcgaactcctgatctcaggtgatccgcccgctctggcctcccaaagtactgggattacaggtgtgagccaccgcgcccaccaggaacctaaatcttgtggacaggtccagcgaattcctttgaattcatttttagaattttcctatatcttcaacaacattcagtatattttaaattcttaccaggcaaaaaaaaatatttcactattgactcaggatgcgtttctttattagtgcagttgaatatatttttcaggtgtttggtagtcatctgtgtttactcttcaatgaacacctgtttttatctttgtgtattgactgcctgttagccacaggataaatcagaaatttcttaccttagcatataggactgtcggggttggatctaggttttgtgagaccgaagcttatacagtttgggaaatgctctttaagacaaagacttgaaaatggattacttttgcacattttagaaatcatatgaccatgtaaacacagttaataagcctttcccaggacctgtgcccaagagggaatctgaagcttaagcttcatctgcatcaagaacactttgtcatctggctccactggcccgctctttctccacttcctgcctccagcagaca

SEQ ID NO: 23805 - DNA, 1048 bp, Homo sapiens
agggcagaaaagcttctctatcttttcctctctgcccaacttttcccaccctaaatcatttcttggactcattaggtgaatcatgagtcctaaaccacagctgaactctgcattcttctgttcattcattcatccatgcacatgtttactctgtcactcatttgctcattagtatttactaagttctgtctgctaaacattgagctaagctctagggatacataacctattgtttcagatggattgtacatgaacttccaggactattttactttgtaacaacaggcctataaacaaaccactgtatggcaaatatcactatgagtcacatgaacagactgctgcaggaacactgaggaaggagacccaccctgcccagggatggccagccctttccccaagggaaaaattatgccttttgattccttttctttctgttgaaacatgtctctttgtactttctcaggctcttaagatacatcttgccttgtgttatatttttctgtgtgtttgttttatactcactattaaattgcatgctccttgaaactataaactcactgatcctaaaatcttcctcttgtacctactgtagtgctttgcacgtaattaataattatcacttaataaatattgctgaatagctgtgcaactttgggcaagtcaggttacctctctggacctcacttttcctcatctgttaatgaaatacttagattagaaaagtaaaatctaaggtatcttctaactctgattctatgagtgactatattattgataggtgagaattaatttttttctagtggaactgaaagctgtatactaattaagaaaaagatgataaagttagtattcttaaacatctataaaattaatgtacttacgggaagttgaacgttactttttaaaattacaaggaatagatttgaactgtagagcagcatggattttaattctaacttcagcattggaagtaatattaaatacccttttctgttctgataaaatgtgcttgctggcacaaaatattattaaataataatattgc

SEQ ID NO: 23806 - DNA, 1200 bp, Homo sapiens
agatggattgcttgagcccaggagttcgagaccaacctaggcaacgtggcaaaacccagtctccccccaaaaaaataaaacaattagccgggtgtggtggcactcacctgtatgtagtcccagctacgtggaagactgaggtgagaggatcacttgagcccagaaggttaaggctgccgtgagccatcgtgattgtgccactacactctagcctgggcaacagagggagaccttgtttcaaaaaagaaagaaaaaagtatctgattctgcttcatggagaacattattttggaagataaagagaagcgattaatgcttctattgttcaattaatagtaatcaccctttaccaaagaagcccactgccctgctgccttctctttctccttccaaccatctgttcatccattcggttgacattgatcgaacatcttttatatgctaagcatcctgctagacactgtggaaacaggaatgaaaggcattctccctgggaagcaacttgtgtatcaggacttgtacaccaacaatgacaataccatgagacaaatgctgtggtggaaaacagagagggcacttaactcaccccagaaagttgggagactaggaaagcctcctgaagagagtgatggctaaagcttgaaggtgagaagtaaggaaagagaagtaattcaggtgaagagtgtggagtattctaagatgatcaagaaaaatgtatgaaacagatattccaacaaatgggagaaagatcatactagaggaatgtaataggattttcagtcattgttgactgccattttgatgatggatgttagtttgatactaatctgcccagagtacatggtttttctccaccatcactcacttgcatgggtgcaggcatggaggaggaaggtgattacctggggcagtctttgctggttgggtacagtgcaaagtgagggagctcagggcatgaatggtatttaacagagatgattgtaatgataaactatgggctctgagatggaaaaggagaaaagtgaaggtaggaagaggctgatggagtaggagcgactgttagtggggggaagaggggtgtcaatggacatttgagacctttcactaaggtcaaagagttattactgtggggatgcctgaagaagtggttagagaatgtgttgtttgtacatgtgattttggaagcagtgcagtttccag

SEQ ID NO: 23807 - DNA, 1025 bp, Homo sapiens
ttccacatcatgtactcattaagtttgaagaacgagttaaagttaccaagatttctttattcaggttttgttttgtctactcaaacagaagtatttgctgggcaacaaaacagtgattctctttgtaatctgtatttgttcaaagccatatttattttacctgtttctgtgattggaaaatagagcatgtaatttgttctcctgatttgtttaaagtttaccagtaaatcagaagctctattactaaaaatacgtggagttatcaaccagttggcatttggcattgacaaaaggtactgctaagatattttttatatcatttattgagtgattgatttagccaatgttgtctcatctgattattgttctactcagtctcttgtgtcttgaccaggaaagtgacccagatggcttttcttaaagggataatttctttttaaattattattattttatttattttattatttattttattattatttttaattattaatattattatttattttgtcaagactcaacataaaggggataatttcatattatttcctgcttcttatattctttaaatatttcttaaattttacaaccaaaatgttacataacatttagtttgaggctggaataaaataatgataatattatactagctccctgatttcttttacttcctttcccacacttcagtagcttccctctactatcactttcttttactgatttgaaatggaattgaaaattttggtatgtatcttcttagccttgctacttctcttggttttgatttaaggtaatagggtctgtcactttttttcctataaaatgtttatttatgctatatgttaatttttgaaatcacttaaattgatagtcactcattcattcggggcaatgctctcattagtggctaaatgtaaaactagccgataatattgctgtcatatttacaggagagcgtggcagcaaatctaattgctaaactaatttagaatctttctcttctccacgtagcaaatcaatat

SEQ ID NO: 23808 - DNA, 1056 bp, Homo sapiens
tttaagctgacctatttttttctgtgcctagaacaaggaaaaaaaatagtcacacgagtctcccataggtttatgaatattatttacattcttgggtccgctcagtcacaatttccaaataaccacatgtccctgcaagttgtaagagcaagggactataaaccacttccattgcattcaaggcctgcttggatccaagaggcacaaatggagtcttaatggttaaaagacttgagatgtcctgtcaagaaagaaatacatggcactctcatttcagacgttcagagcagtcatgcacagtcggcagcttcacttccattttcccagccatggctttcactacctgctaatgagatgatcccttattttgaaaacaactattcctaggatgacaagagctggaataaatgaatacaaaatcagaaagttcattgtgaatctagatgttgcacctgggcaggttttctcaatgaattgaattccttgagtgaaggcacacattggattagttgtcacagaaacatttgagctgcctgtcaaggaaaagattgacagtgtcaggtgtggtttatctcaggtaatttaatcaacaagtatttaccaagcgcttgctaagtacccttaatgaaaaatacaggacactttagcaagcccagagtttacaatttgatgaagcaagagtgagcagttctggcctttggcttcatttgaagatggacatgcttttgtttctattttgggtatagattcattaccatatttgtgataaaaatcatgatcccttagcacagactatcctaaagttactgacattatcacttaaaattatttaaaacactactaaattcagccatattctttggttgtctttggagtggccctgagatttttttggttgttttttttttgttttttttggggttttttttttcgttttttttttttttttttttttttttgagacacagtttcactctgccgcccaggctggagtgcagtggctcgatctgggctcactgcaacctcagcctcccagattcaagtgattctcatgct

SEQ ID NO: 23809 - DNA, 1056 bp, Homo sapiens
cattcttttttatttttatttatttattgattttcgagagcctctgttgccaggctggagtgcaatggcgcgatctcagctcactgcaacctctgcctgccaggttcaagcaattctcctgcctcagcctcccaagtagctgggattacaggtgcctgccaccacgcctggctaattttttgtatttttagtagagatggggtttcgccatgttggccaggctggtctcgaactcctgacctcagtttatccacctgccttggcctcccaaagtgctgggattacaggcatgagccactgtagcctgcccattgttttttattaatcactgcttctatctgctttatggcttccaaaggcttttgatatctctacccattgatggcatacctcttgcccccatttcctgctcttaatttttcattgcttcgtgttttacacctttttaaaatttttcctttactaacattttgatggcatgttgggagggattagagataaatggctttgttccacctgtcttgaactagaaacacttttatcatgtggattatatcgtgtgaatgtgaatgttttcattacaaaaatatttcacaaaagattaagctaccattgggcattgtggacagatcattatttgatactagtagagtggacagatcattatttgatactagtagagaaatttgagtttatttgattttttttttttttttttttgagaccgtcttgccctgttgcccaggctggagtgcaatggcccaatctcagctcactgcaacctctgcccccaggttcaagcaagtctcctgcctcagcctctcgagtagctgggactataggtgcccgccaccacatccagctagtttttttgtgtatttttagtagagatggagtttcaccatgttggccaggctggtctcaaactcttgaagtcacgtgatctgcccgtctcagcctcccaaagtgttgggattacaggcgtgagccactgtgcctggccaagtatatttgattttgagaaaatattgaaacttactctcatgtctttttttc

SEQ ID NO: 23810 - DNA, 1047 bp, Homo sapiens
tctgaaattcatcttgagcaatttgtatcatctctatgaacctcaactgttttcatctcttagggctggctgtgttataaagaaagtacgtacatactgcatggctgagagttgatatgcaataaaagttattaattattactggcgatgagtacctatataacctcttttggttttttcctaataaagaagataatattattaggattattctgtcttatactattttaattgaactaacagggcagaaaaattagataaaattagcaaaatagctgtttattaaaatgcctcattataaatgttgccttaaaaacctggatatattgctgagtgatagaagtggtgacaaaaataagacctcttaaaatatgttgttttgtgtaccttttatgtttactttttattttaacagaaaaatctatatagatgtttcatttaatgataaattggtaaagtcctgttccaataaagtaaatattgattatgacttttatataatcttggacgtaaagtaaccatggactgaaaaagtgatttttcacttgatgcctcaaaaatttgattttattatgccaatagtgatattgagtttgtgactagaaaacccagcagagggcgccacaatcataattctttgtcatagcccaatataattaggataaatagctcaaataataaccctaagcttttaccatgtagacatataaagatgtgtctaaacatttctatttgattcatttataatatatttaatatattcagtaattcaaaaatacaaaaaaatagatttttcctggccgattttttaatttttaaaaatatcagtttaatttttctacttctagctttaaataaagaagtacttttgatagagagtgaaagttccatacaagagtatcagttcataaatcaccaccatggtagtatgttaaaggacaattagaatgaggaaaaaagtttctaatagatgagagaaccaagagatggaattatctatttattttaagaatttgtttctaggttaataatgcttcctagtaatag

SEQ ID NO: 23811 - DNA, 1044 bp, Homo sapiens
tccaaatgcaagtttatgatgactccatgagtttgtaaaactgttacagactttcaaggatctcaaagcacgggcagaaggcatttgtttctgggcaatgtgctctgcttgttggagtgacccagctaaacagagcaagaagttattttgccttttcctgccatttctccatgcatttgggggctttaagagtgctttgagtctaagaaatatatttgaaatataggttggaatcatctttgttccagtcatgttgaacttaaggctaaagtcaaagagcccaactcttcttacagggctccttgagccccaccagtgaaattgtttcttatctgaccagcctagacataccagaatctcacttagactcaaactgacatccctaccctacaagctgtgaagctgactttgaagcaatgtggaatgtgtttgctttggtgactcaggaggttttatatatatgtgtgtgtgtgtgtgtatgtgtgtgtgtgtgtgtgtgtgtgtgtgtgtatgtcttatggatggtgaattatactgttaattcaaactaatatttctggataatacatattatattcctactactgtttcggtttgttcaatctgaaatagccctagctggacctgtatctctttgcttctttcctggtctctatgttatcatacttacttcaacatcatttaacataatggagctactaatgactcttccaaggtttttgttgttgttgtttgagattgttactttaatgggaccaaaagaagaacgtataagacaaaagaataaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagacaaaagaata

SEQ ID NO: 23812 - DNA, 1032 bp, Homo sapiens
agtagccacatgtggctactatattggacaggaatgatatagagtatttctatcagaaagatgtattaagacagtgctacttcctttccaagacattaattttccacagtagtatcacatactcttagaattctgtgctattggtattgatcgtaattgtagaaccttttatcccttattttttttattatccatttttaatatcatggtattatttttcacagaatccctcttttacttggtgtagtcagaattctccattcctcctcttaacttacattttctcttttcttaaaatggcctgtttggaattagccttgccacccctactaatttgaattccacatcatgaaatgaaagttcctactttgtgcttacctggccagtacctgggggaattcacctattaaatcatattcttccccttaatatattcctttggttcctcttccttaacaatttttttctcacttatttggtgtctgttaaatatcaaaacacttttcctgtgactcaatatatgtttatatgccaagtctttttttcagtttgaggtacttgaagttcgtgccttttcatttgacttgctggaaaatagttattccttccctacatcatgagttttcaggattaaaaggttttttgacctttaaattgtaactaataatttgcctaaatcagtgttgctgggtgataacatctaggataacaagtgagttacaggttcacagtgatgactcggaattaatccttagcctgtgtcatcaagcttgcaaatagaggagtctttagaactaagactctatctgctttctctcatggcacacggcatagtaccaagcatttcatcttgtgcactcaatagatgtagatgattaactgtataaaaagactgcgctatcttagggtagggttaactatctcttgatacttctttttttttttaaacccaacacagactgaataatatagtgccttcgaatatctttcagattggtgcattgatatttgtagatataatttcaaatttag

SEQ ID NO: 23813 - DNA, 1074 bp, Homo sapiens
gctaggaagagaagggaaccagggatgcctgctcccctctttctagatgagtagccattcatcttcagtttgtatccctttcaaatgcatcccgaacccctgggattcccttgaaaaatgccctcttttttcttttctcctccttggttctctcttcacagataggtaattgtgtctccatactacgggacattcccctaagatgcaccctccaaactgggaaaagttaatttcccaaaccttaaactggttggcttaggactgggctcaggggaagtccaacatgtcggcaaaagggtagttttttttttttttttttttttttttttttttttttttttttttttttaccagttgggcttttggtcttcctctccccatgcaaactggtaaaaggcctcaggatttttgagttgtcctcagccccctcctcttgtttcattttaatacatgttttctaataacccagtttgtctcttcttactttcagaccatcaaactccaaatggtcatgcaaccaaagtcttgaagtctcggacaatgaccccttctgccaggaactcttagataggcttctgactgccattttccccaaaacaagaccctctgtcagcaggaagcagttaagatctgtcttcatccttatctttatccttattctaatgtcagttagacatacttctttagaggggggaatgtgacagccaagtataaaggggtcgctagagaacctctgggactacaggtgtgtgctaccacacccggctaattttttgtatttttagtagagatggagtttcagcatgttcgccaggctggtctcgaattcttgacctcaggtgatcggctcaccttggcctcccaaaatgctgggattacaggtgtgagccactgcgcctggcaacagatatttactgaatgccagttatgtgtcaggttcagttgcgttgattattcactctcagagcctcccagatttggtctttcccttatattatttatttatttatttatttatttgaaacacagtctcgctgtgtcacccaggctggagtgtagtgttgtgatctcagt

SEQ ID NO: 23814 - DNA, 1272 bp, Homo sapiens
tggcactattgtctaatttggtgtgccttgtgttgtaattcaatcatctattattaaaagtagatgtggctgtagggagcaaaaccacatacaaatccataaacatacatatgtgcatatttacttatactcacatatatgttcaataaggtttttgttttacctgctattaatgtttgtactagtgagtcataaatggaaaatatctattagctctaaggtaaaataaaataggttttgatttagttcaagtgaaccatctcatttaaaattagcccaggggtcttgtaaagaatgcaagtaatctaaacataataatgcacattgcccaattgcttctgtgtatgatacaggttcagtgctgtagtgctttgacagcccattactgaatgtaatgaacagctatttttaaacagaagaaattcaagttgacagcttggcaatgaaattcagctagtgggataatttttgtcatctttagtatagagaatggattcagtttggtttaagcaaatttgtatcatgtagtttatagcgcaaacatttttattaaaagataattttattgtccattttgtggagaggggcagatgttactgttaagaatatgtaatcagcttttaatgaatactttaatgaattactgaaacatcatttctagaacctaggtttaaaatgaaatttctcatttttctttcctgccatgggtgaaatagtctaataaaacgactataagattaagaggtgtttttctatgctgctttttagtctttcagagtttaaaacaagtagttttaagaaataagatagtctttggaaatggatataaagcttgaggcagtgttgtcttaatggaagtaagaattagacaaaataccattgagagagagaaggaaaatgtctgcctgactatattttagagaaattcttttactaagaataaggagacggtaacatctgattttgacaactcttaaaaaataagttggagaagcttcgtctgcaattcttaaataaaacatatatttttaactcatactatgaaaaataatagggtaagtcagagtgagttatttcattctcttctgtttacagcagaaattgtttgagaattctaattgctattttttctaagttgagctaattgccagagcttttaaaatagagacttcaggttcaacgttgtgcattgtgttaaatgtggcttgaaaaatacattactcaacgaaatctgggtgaacaaagtaagtaaactgagtactttacccaata

SEQ ID NO: 23815 - DNA, 1089 bp, Homo sapiens
ttccctaggtgatgaaatgtattattatttagaacatttattttagtgtgtgttctgtattttaaaagagaaaggtatttaagcagcaaagatgtaactgttatgaaatttatttttataaatagctttcagcagaaatcagaacagtgctttaaaattacagttaaaaaatcatttaatcatcacactccttgatggctaatagagtagtaagtgactcccccatatcccccgcaataggctattctcgatatgctcacttaagtggccctaagaatagtactagtatattttatgttagcaagccttgatagcaaagtgccaaaagttcagggggcatttgtctcctttctcaaaaattcatttaagtcttgctggagctttaactggggcagacagccatacaaatgacttgagataaaatgaaaataatggactgagctgggtgctggggatggtagttatgctgagcacacatcaataagcttggagtgtgattctatgctaatgcaagcctgatggatcagctttctcttttagcctggaggaccattaagctctggaagctgagtcaaactgatagagttggcaaatacagcccatcagttagcagcaatagttaactgactgtgattcctaatatgcgaaactaacattgcttaaaaaccctccatgttcaggacatagatcagaaaggagataatagattctgctttaatttgcataatcaaagcttctcattttcccaccttatagttaacagaagagggaaaaaaagccatggctaccttcattttgttgttagtcttgaatcatagcaaataattttcataaaaatgtaaataacttgtttcaaaataaaagagtatatttgaaagattctctgtgttatttctttggaattaaactgtaggcacagttacatgggttgggtagtaagtgtcttggggatatgaaaagtaacaaagtcttaaaaaattgtgagtctttttagtgattgattattttcatatataatttataaagttctatacttttacttgaggatattggctttgcaaacttatcaaaaacagttcaaattctgtt

SEQ ID NO: 23816 - DNA, 2581 bp, Homo sapiens
ttattatagtttttaatgacctactctgttgtttggatttatgattatttaattggccttataataatagatctaaattcctttttttgcttttatttttgatgttccaaacaaaactgtagtgaatatgtattcatatatctatatgaattgttgctgggtcaaaggttttattttttgggtcatgtgtaatctgacagtttaaaattatacaaaaatgtgctgaagtccttgcgttcattgcttagggagtatctgtgtgcaagaggaacattatatgaatgaatagaaatataattcaggtctcagctatttagaaaaaaaaatgcttcttaattctcttaatctaaagatttcttctttatctccttttgctttttctccttgcactttgttaaagaaactattgttctgtaggttttcctgtagagtctgagttttgctgattgcatccccatattgtcatttaacatgaactgctaccttctgtatttcctatacattgatcgttaaatctagaggcttgagccaattcaagtttgattttatttacttatttattcaaagctacttcatagggagagcttttcttctctgccagaaggccacagtatcaatcttattgtagtattgtagtacttacagccattcttgatcaatgccatggatacctatgttaatgtctttgcagtcctttaagttgttccagtttggatttgcataacacaccacttcaaaacttaatggcttacagtaatgtcagcaagaataggaagccctagaccttgttttcccacaaagacactgacttaacaatatatgacccaaaaacatttaggatagctccagaagccagttgtgaattcacagcaccctaggcaggatcaaagccatgaatagttctattgaaagagataagacaagtagttccatttgaatgatgtcagcccctctcttaagccagcatagctcataatagggaggaaaagcccaactcatggcttctgccttgagaggaaaacagaaaagtgaaatgtacatgcaatatactagctttttagggggtgaaaaagtaaggggttgggtgggagttgggctgcccagaatgttgatttcagtcttgcctgactcagagtgctagctgaaccagcataccttggatacctggggtctacagtgaacaaaagagaacttagtagctttttgcagcaccaagaaccctgccagtaccacagacaggcgcaagagggaggaagaaactataaaccgaaaaagaaactgacaaacttctctaattgggaatttacatgcagagagtgagagaagatacatctccccataaaaggattgagaggctgtcagattctctggctgtgctgtttggtgaaggtcttcccctatagaaagccagtatgtaaagattgggagaggtggctgtttttcaaatgcaaaaatcacaacaaaaaataacaaggcacacaaagaaacagggaaatcagtcaaagaaacaaaataaatctccattaactgactccgaagaaacagagatctattagttacctgaaaaagaatttatgataatcttaaagaagctcaatgtgttacaagagaatacagatagacagctaaatgaaatcaggcaaacaaagcatgaacagaatgaggatatgaacaaagatatagaaactataaaaaagaacaaactagaaattctggagctgaagaaaacaactggttaggaaaattcactgtggaagaccaacaagagacttgatcaaacaggaaagaatcagctaactcaaagacaagtcatttgaaattattgagtcagagtaacaacagcaacacaagaatgaagaaaagtaaagaaagcctgaaggacttatggtgtaccatctggctgaccaatatatacattatgggagttctagaaggagaagagagaataggacagagagcttatttgaagaaataatggtcaaaaacttccaaaatctgaggaagaaaatggacattcaaattcaaaaaactcaacagactgtagatatgatgaatcagaagaggtgcacactgtgacacattataaactgtcgaatgtcaaagacagaatctgcaaagcagcaagagaaaagcaacttgacacatacaagggagctcccataagttatcagtggatttctatcagaaatgttacaggtcagaaagagttggaagatatactaaaagtgctgaaagaaaaaaaactgccaataatactgtatctggcaaaattatcatttaaagatgaaggagaaataaagaccttcttggataaacaaaagctgagggaattcatcatttatcatcactagaccttctttacaagaaatgctaaaaggaatctttcaagttgaaacaaaaggatgctagacagcaacacaaaaacatatgaaaatgtaaagctctctagtgaaggaaaatatatagataaatacagaatcctataatctgttatgaagtgcataaatcacttaattccaaagtgattccaatttaaaattggatatttatcttttaaattggattatcttttaaattccaa

SEQ ID NO: 23817 - DNA, 1034 bp, Homo sapiens
ctactaaaaatacaaaaattagctgggtggtggcgcatgcctgtactcccagctactcgggaggctgaggcacgagaattgctggaacctgggaggcagaggctgcagtgagccaagtttgtgccactgtactctgtcaaaaaaaaaaaaaaaatcaatgaaacataaagggagacagcaagagagaaaaggagagacaaaataactggaaaatatagaaatagtaagttccatgggaacggtgagagcttctctatcagaagttacttcaaatgtgaatgtttactttaaactccttaatcaaagaacagagagtagctgatttaattataaaaacttcaaacaataaatgctgtttataaggcactcactgtagatatgaagacttaggctgaaagtgaaaggatggaaaaagatactccatgcaaatagcaaccaaaggaaaaaggaggttagccctacttagacaaaataaactttaagtcaaaaactcacaagagacaaagaaggacattatataatgataaaaggatcagttctccaggaactcaaaacaagtctaaatatatatgcatctaacagtagagcacccaaatatataaagcaaacactagcagaattgaaggaagaaatagtaacgcagttaacagtaggatatttaaatatttcacttttcataagggatagatcaactagacagaagatcataaggaaacaaaggacttcaataacattatagtccaattggatctaacagatatacagaacactccactcaacaacagcataacacacatttttctcaagcacatatagaacgttttccagtataaatcatgttaggccatcaaaagcggtcttaacaaatttaagtagattgaaatcactttatgtattttttctgaccacactgaaataaaactagaaatcaacatcaaaagggaaactggaaaattcataaatatgtggtgattaatcaacacactcttgaacaaccactgtgtcaaaaaaatcaccagagaaattagaaaaca

SEQ ID NO: 23818 - DNA, 1033 bp, Homo sapiens
cctggggctcccaaagtgctgggattacaggcgtgagccaccatgcctggcctaaagtactattttcaaatagtactttaaggggttggtatgaagattttcaaaagaactatttatgattcttcctaaaagaattaaatgggcaattattttttgctttgagatggagtctcgctctgttgccccggctggagtgcagtggtacaatctcggctaactgcaagctccgctccctgggttcacgccattcttctgcctcagcatcccgagtagctgggactacaggtgcccgccaccacacctggctaatttttttgtgtgtttttagtagagatggggtttcactctgttagccaggatattaaatgggcaattcttttttaatcagtgtatgaaatttgctttggaatttcatttgaatgattattttttattgtgaagaataaatgagataatgtatataaagtacataccatagtagtcagcgaataaattgtagctattactactgttgctgtgaggctcaatctaataacttgtctaaggttcgaacttttgcatcagcccccaaaatcctgtttgtactaaaatatactatctaaaaacattcataatacaaatattccatatatcctctttcatttttaacaaaaatttatggatgatacaatgtaagcaagaacctgaggatacaaaaaagtaagacttggtgcctgtcacctaggagcccacagttggtagagaggacgggcagatataggaaagaagaaattgcttttcctaaattatgcatcccagaaaatagcattctggagtgtggttttgaacagaattctattctgcagatagcaaaacataagttacatgttgatgagattaaatgttcaaatcaaataatgaaatatatttatttagatacatttaatgtcttcttatataagttatcaagttgcattttttctagctgcatttaaatctatgtgcatttccttcctacttctcctgagattgatatgcagccagcatttcagtt

SEQ ID NO: 23819 - DNA, 1079 bp, Homo sapiens
acaatgatgagatcaaaattagttactcatgaattcaaccacagttattaaactttactatttttgaggtatagggatccaacagtacctgttctgaagttcattttagtctaatggactttattagccttaaagatgttatctagttaatgcaatatattacacataggcagtgtaattgctctcctctgtttagagagtgtatatgagtagtcataaattcttgatggcataacccaaactggtatcctaaatccttgacttctaattttagaccattgtacttctaaagtttgcttgtaatttgagtattaagaaattaaaggacaagaacatatgaaggccatcatgtagctcaaggtctaagggaaaataatgctgtttcagttctcaatataaaacaaaaataattatatgagtaattattcattttgaaaactgatcttcaagtaaaactgggcttaatcaaaaaaggagtaagccctgaagaccttttgcattgtaaaattctagcaaagttgtgattcccgttgattttaaagagtgataggagtggagcttctgaatatcccctgagattttagaagtatatgatactggcagttgtcacaaaaatatatttctagagaagtctgaataattgactctttaaaaattatgttttcttgcaaaatctctaaggaactgaagaagtttctaagaatcacaggcatgctcttaaagcattaccatgagcctttactctgaaatacctcatagtggtacctcataccttctttgcagaaatgagtgcctaagtcctaatggggagaaatgtactccaaaatgatctgaagccattggcagggagacagaagagatactattagcagagcagaaacaaaaataggtggatagagccaatgggttttttttttttggtagaaactgacaaacgattttaacgtttatatgaaaatgtaaagaaccaataatagtcaaaatcatctggaagaaaaggaagaaagttggaagatttacactaccagatatcaaggcttgttataaagctacagtaattaagatagcgtggtattggt

SEQ ID NO: 23820 - DNA, 1007 bp, Homo sapiens
atatcttaaataggacaaaaaaaaaaaaaccatacagaaaagattgataaattggtctatgttataattaggaatttctgttattgaaggacactatttagaaagtagaaatgtaagttacagagtaggaggcggtatttgaaatgcatataactaaggacttattttcagaatatataacaaattcttacaaatcaacaggaaaaaaaagaacctaatttcacaaatgtgaaaaacatgaacaggcacttcacgaacagtatatccaaatggccgataaacagaaaaagatactaaaccgaaatagtcaccaggtaaatacaaattgaaaccaaaataagataccaacatatttccaacagaatggtgaaaactaagactggcaaaaccaagtattgataataacgttgagcaattgaaactcatatacactactaatggaaaaaccattttggaaaactgcttgacagtgtctgttaaagctgaaagtatatgcatcctgtttcctggcaatttcgttctctggtatagtagaccctacaaaaatgtgtgcaccaaaagacgtatgcaagaatgttcatagtattttttaatagctgaacactggaaataactcaaatgcccatcaacattagaaaagacaaataaattgtggtttattcatataatggaatatttttaaagcaaagaaaatgaatcaactatttccacacacaatatgctgtacaaatctcacaaacataatgttgagcaaaagatgacagactcaaaataatacatacagtcatgcatcacttaacaatggcgatacgttctgagaaatgtgtccttaggcaattttgttgtgcgaacatcatagagtgtacttacacaaacctagatggtatagcctgctgcacacataggctatgtggtatagcctgccgctctgaggctacaaacctctccagcatgttactgtactggatactgtgggcaactgtaacacaatggtaagtatttatgta

SEQ ID NO: 23821 - DNA, 1032 bp, Homo sapiens
taggtaaaaacgtttagagctgctggcagtgttttttgttgggatcatttgttgcatttttagtgtaacagtggacttagaagttaaatgtcaacctttggccgaaataatctgctagtcaaagaccttggacatttaggggtttttaaattggaagtggaagggtatcctcatttattattcatagctacagtatgttagttattattcttttgttaaaaatgtgacaaaattaaaggcaaatgtagttttaaaggctccagagtaaattagaaaactgatttcgtacatctgcaaaaattttattagctgattattttacctcaattaatattgggaatgttgacagataactacacatcgctgtttcacaagaaatattttgtgtatgtttattctttatgatcagaaaaataaatagtgtagattggacagtgttcatttttcataaatggaaaagaacattgttcttttactagccagagttggaagaaagtacttgggataagaaataaaaatgaatgtgtacatttcagtatgtgtagtggaatggattcaggaaattcattctttcatattaatttttctaaacattttttatgtagggataacagataagagagagtaaaaaaaatcccatttagtaaaaaaacaaacatatttgtatagatgtagtaaagatacacctgaaagttacataccaaattattaactgttcttttgggggaataaacctctaaccagggaccttttctttttaagaatttttatacctccatattatttgattttattttgaggagcatgtattatacctgtaatttaaaaaaattaagcaggcaaagagagagagagagagagagagagagagagagagggatagtatatgaagggctataggcagccccagaagagcaagaaaggcaaagaccaagcaggcatcagagctggatcctgacatagcaagcaattcagacacctgccgggcatcggggcagggtgaagtcttcttaccagaagagaaatctggag

SEQ ID NO: 23822 - DNA, 1044 bp, Homo sapiens
tcatggcagaaggcaaaggggagccagtgtgcacagaggtcatgtggtgaggggtgggaggagagatgccaggctctttttcacaactagctctcactgaatctaatagaccaagaactcacttattactgcaaggatgataccaagccatttgtgaatgatcccatccctgtgaaccaaacacctcacgttaggccccacctccaacactggggatcagatttcaacatgagatttggaggggtcaaacaaaccatattgaaactagagcacccactttctaattgtttttttttaataattgagttttgagaatttgtaaatatattctacatgctactctttgttggatatgcagtagtttgcaaatgttttctctcagtctgcagctactcttttcatctgcttaatagggtcttttgctgagcaaaggcttttagttttgatgaagtccaatttatttttctttgtgggttgtgcttttggcatcaattctaagaactagttttgtagctctaggtcctgaaaacttttcttctgtttttatctgaaagttttatagtcttatgttttacattaagtctgtggtccagtttgagttaattttttgtataaggtgggagtttttggtgaagattcacttttttgctgatgtccagttgctctattctttatcataaaggtcttcatcctcatcatcttaccattgaataggctgaggtgaaggaggcggaaaaggaggagtttgtcttgctgtcagaggcggaagaaaatccatgtgtaagtggacccgtgcagttcaaatccgtgttgtccaagagtcaactgtgcttcctttataaaatgtcagcttgttcctgttacattaaggagaaacaaggagtttatttactttatttatttatttatttatttatttatttatttatttatttgagacagagtctggctctgttgcccaggctgaagtgcagtggcgcgatcttggcttactgcaacctcctcctctcgggttcaagcatcctcccagctcagcctcccaag

SEQ ID NO: 23823 - DNA, 1025 bp, Homo sapiens
gtaaattatctgaaagtaaaaaggtacttcaactgagggctgagagatctgcctcctaaaaccatctggggctcttgctccctccagctgttccctcctcctggactgttcttccctcagattttatcttttggttgggtccctcacttcaagtgtttacacaaatttgaccttgttagtgagacctccttgaccaccctatttaataatactgcaaaccaatctgtccaacctgcttactctgcccaccccccatcttctaatagtactgtactttgtgcttacctaggctgtccctcttgtagctccttgtaatttcagactttagaacaggtatgaatgaaaacgttctgagaactttctctgcttgtgggtggaggaaggagtgcacagtgaaattgttcttccgattgcgtcttccttacgtcagccatgacacttgtagtcactgctgctaccacttaccaaggaactcagactccaggctgccactaccttgcaggacaatattagctgatgcttgaccatgtctatgtaattttgtacacaagacaaaaaaggggcaaaaagttactagctcctccccttagccaacattttgactttggacaaataagttcacctttctgtttctcattttctttataaactgaggctaataaatcataggtttgctgtagggatgaaataagaaaacatataaagcacttagcatagcacctggcatgttgtaagcattaaatgagtggcagccattattattattttctagcttttatggatgtattttacacatggcacaaaattgtactttcatttatctcattttgacagtatacctcttcttctgacctacaggtacctaaatttaaagaacagtttttcctaccctttcattgttgctagcctttcaagagtctcctactttttttgtgctttctcaattcctgtatgatgtttctaaactacaataaattaaagctagtatttcttctctattggaaggccagctggttaaagacaac

SEQ ID NO: 23824 - DNA, 1021 bp, Homo sapiens
tttttaaggtggagtctcactctgttgccccggctggagtgcagtggtgtgatcttggctcattgcaacttctgcctcctgggttccagtgattctcctacctcagcctcccaagtagctgggattataggtgcccgccaccgtgcccagctaattttttttgtatttttagtagagatggggtttcaccatgttggccaggctggtttcatactcctgacctcaagtgatccacccgcctcagcctcccaaagtgctaggattacaggtgtgagccactacacctggcctccaacgttatttttcgtagaaatagaaaaaataatccccaaatttgtatggaaccaaaaaagagcctgaataggcaaaccaatcctgagcaaaaagaacaaagctggaggcatcatactacctgactttaaagtatattacaaggatatagtaacccaaacagcatggtatcagtataaaaattgacgtatagaccaatggaacagaatagagaacccagaagtaaatgcacatatttacagccaactgatttttgacaaaggcaacaagaatatacattagtaggacagtctcctcaataaatggtactgggaaagctggatatttatatgcagaagaatgaaactggacccatatctctctccacgtaccaaaaagccaactccagatggattaaggacttaaatatcagatcccaaactatggaactattagatgaaaacataggggaaacagtttaggacactggtctaggcaaagattttatagttaagacctccaaagcatagacaacaaaaacaaaaatgtacaaatgggacaatattaaactaaaaagcctctgcacagcaaaggaaacaatcaacagaataaaggcataaccttctgaataggagaaaatatttgcaaactatttatctgacaagggactaatatccagaatatacaaggaattcaaacaactcaacagtaaaacaaacaaacaaacagttccattaaaaagtgagaaggg

SEQ ID NO: 23825 - DNA, 1050 bp, Homo sapiens
ctcagtaaagttgcctttttagtgggggtttttacttcacaacatagaccacaaatcctaagggtaagtgagtataaatcccttgggttggcttgcttggctctgcaaaatgtgtccaaaatgtgttgaggggtcctgagggtggggaagaacttgattgagcagaaaaatatcaagcttaggttttttgttattgttattttctgtatcctcaaagaaaatgttaatgtgctaggattcagaggacattttccaggtacacaaacctagttgaacaatatcagtagtcttattgggtcctctagcagtcacttggaaataagctcagcagaagtaaaagtaaaaactgttctatgctgatagttggaaagacagtacctcagcagggattggtcaagctgggaattcagggttcaagtaagaagagtggctctaaaaaatgttagatgatgctgacgtggtggtgcatgcctgtggggctactccgaaggccgaggcaggaggatcacctgagaccgggaacttgaggctgtagtgcaccatgatcatgtctgtgaatagtcactgcactccagcctgggcaacatagtaagacctcatctctaaaaaacaagaaagatatgataggtgaaagatgaccctaaacttaaaaggcagtgaaaaaaatcatcacaggtgtaaaagttagcaatgcatggaacaagattagtacaatgtttaggtcttggggtctggaatacccaggttcaaatgccatctctgtactatcatttcctcatttgaaataatacccatttcatagggttactatgagaattaaatacgagcttatgtaatatatctgacacataggagaagttcaaataacattacttctctctttccttatctctaacggcctaaatttggttaattataatgcaaaagggagggcaagttttgagctgaagctgcagtggaaagggatcatcaagacagctgtccttgagtgtccctcctgcagtactgtctctcattggctgcttgcccatcagaggcacactgatcact

SEQ ID NO: 23826 - DNA, 1111 bp, Homo sapiens
cctttggggcagaatttggaatttcttttcagtcaggctgctgggtcgtatgtgaactattgtttgactcacacaggggctgtcctaaaggcctgtgagccataaggccaccgtgggggcttctagttgatggtggaaggatcaagcagccctctttgccacagcagcaaaaaatgatgttgacatcatttaaaaaaaaaattagccataggaaggaggttaagaagttgtggcagaattgaaacaaatctaggcctctcaactgacaagctgagaaccctgcttgacatttatgagtggatgcgtttgaggaattatgtaagaatagtaagttaaaggatgcttttaatttaaaaaattaagataacctgaaaacatacctgtaaaaacatttcagttgacacagtctcttatgcttataacaaggattactgttaatgtgtttttgcggagttgggctctgatctgtaaatatttctcagggagataagagtctatggttaaacagtcgtagtagtagtagcagaatttgggtgtcattgtatagccaaattcagaagcttgggggaaaagaatagctaccataggaaccagtatttcagaagcaagttctgcttgtgagagttatcagttgaccaagggattcctgtgtaggtttgtaaagagtgtcagatctggcattctcagtatggaattactggcatgatgcaatggaggaacaggaatttttctgcagctctttcagtagtattggtttggtgttgggttatccaaataatgctcagattgtcctaattaacattaattcatcccctctgttgggctcatgtgacatatgcaacccgaccatcagtcagtggcgtattaaaatgctctccacaggaccacagagcagtgggtgatctctgcatggacgtgatctttgttgagcaggaatactcatatttctgccctaagcacagagcaaccggctatcaactgggatagaaaaattatgttcattcaggagactactgaaacatcttgcttctctcccatgtcaatcctttgtaatagagtaagggaaaagtacatacacttttgagtaacagtttccatacaaatgctctga

SEQ ID NO: 23827 - DNA, 1033 bp, Homo sapiens
attaaaattgcctaatttttagacagtttttttgtttgaataattttactttttaaaagatgaaaagcaaacgaataaaaaacaggttataggctattttgaaagcaatctgtgttacttcataatgtggttacatgtaggttatgaaggcacaaatttggggaccatgttttaagaagatcattggggattggtagtatttcaggttattgttacatattttagcttcaaaagacagtcgactgtattttagtgctgtcgttcttttagacaggcacttattgataccaaaaaacaccacgaaaagtaaaaaggaaaacccaaaccacaagaaacattttgatttaaaggttagatagtctgaattcatgagaacttagattcagagcatggcaaggttaaaagaaattttattaggatcaagacacaaaccatgtttaatgcagtctttttgttttgggggaactagagctgatattttaaatctagtcgtttttaccaatgtaagggaatttaagagataaaatttgaatagaaaggtaagatttgtatagtgattacaaagatgtgacctttaacagagggttttgttgtgtttgttttccacataaaagaatgaagaatttgtgagggtgaggtaaaagagaaggggtctccttaaaacttgagagaaggaaagaatttgtcccattgtagcaatatttgaaaacaggttttattaaggttttaatatgtgttgaagtaaataattatgcaaattgaactagaaacttcttagtttaaatctagtctgctatttacagtgttagtagctggacatcatacttttttaaattaatgtaatattgataaatagcaatcctgtgtattctcttatttctcagacttaataacaaagactttataaatccacatatgtagtgggtttcagttgtttgcacgttattcatgaccaatattatgtacatagcattgttctaaggccttctttgatctgatcttgggtataaagaaacaaaaacaagccgggtga

SEQ ID NO: 23828 - DNA, 1033 bp, Homo sapiens
cactaagtatatttatgttgttgtgcaaccatcaccaccatccatctctagaactttttcatctccccagactgagactgtacccattaagcagtaattctacaatctccccttctcccagtccctggcagccaccattctacttttgtctctgtgaatttcttttttaaaaaatttaattcttttgtagagacaggttctccctgtgttgcccaggctggtcttaaactcctgggctcaagcaatcttcccatcatggcctcccaaagtgctgggattacaggcgtgagctgccatgcctaggctctatgaatttcatataagacgaatcatacagggtttgtcctttagtgaatgacttaattcacttgagataatggcatcaagattcatctgtgttgtaacgtgtcagaatttcattcctttttgaggctgaatattattctattgcatgtatatattaatactatattttgtcagtccatttattcattgatggacatttaggttatttccgtctgttggctgttacgagtaatgctgctgtggacacaggtgtacacatgtctgttggagtccctgctttaattttttggggtctatctctggaagtggaattggctgttatgagtaatgctgctatgttggctcttatgagtaatgctgctgtgttggctgttatgagtaacgctgctatggacacaggtgtacacatgtctactggagtccctgctttaattttttggggtctatctctggaagtggaattgctggatcatatggtaattttatgtttcattatttttaggaaccaccatagtgttttccacggtggctacatcgttttacattcccaccagcagagcacaagggttccaattgtatctcttgtggtttttgatttgcatttccctaatgattaggaatgttaatcttttcatgtgctgtttggccgtctatatcttagtaatagtaatcttttcgtgtgctgctattactgttagtaatagtaatcttttcatgtgctgctatt

SEQ ID NO: 23829 - DNA, 1035 bp, Homo sapiens
gttgttagctcttctcatctgaggtgtattgattgtataatcagtagatagaggctgtgggcagatgaaattcagtgttgttgggcaaattatcggctgcttgcctgttgacctggaccctgctggttgtaccttagatgctggtgggattattactcatttcagtgaccctactttatgacagagcactctgtattattataaaagataaatgccatcctgcttgctgtggttgtggttgactacacaaatgtcagaatatagctagtctgcaaactaggcagtgcaagtatgtttccgatgagatcaaaaggagaaattttcaaagattaccttttctgaatttgtctctttgtaagaatgtaataacaaaaagcctatgtgtatctagctgatgataataatgaaacctttatgtatatagctgtttatcatgtgctaaggattatgacaaatcacttaatattttgttttaccagcaagaacactgaagccgacattaagctaagcaaatgggctaagatcacatgtcaatgagcagtagagcttggaattaaatctgtttcttctgaatacaagtcaagtttgttatattctactgctctgtcttattaggttatccaggctgaccattaaatatgtgtatactgacagatctaaggtttcatccaactggattaaaaaataaagacctcaatgttacttaaataaattattgcattgggtaatttttgagactatttgagctattaaataattataacattccaaagcccaaggtctaacatgggattacttttatagacaaaatcattttatataaagagcactgtaaattttatagctggtggctgtttttaaaaaatctagatggtttttgccgggcgtggtggctcacgcctgtaatcccagcactttgggaggctgaggcgggtggatcacaaagtcaggagttcgagaccagcctggccaatatggtgaaaccccatctctactaaaagtacacatattagccaggcgtggtgccgcgcgcct

SEQ ID NO: 23830 - DNA, 1050 bp, Homo sapiens
taatagcttaacatatgtcctttgattgttttttctctatatctgtactttttaagttgtgttttacaaaaatgataccatattgcatatgctatattgtagtctgctttttaaaaatatatttatttatttatttatttgagacagggtctcactctgtcacccaggctggagtgtagtggtgccatctcagttcactgcaacctccacctttcaggctcaagcgatcctcccacctcagcctctctagtagctgggactacaggtgcacacccccacacctggctgatttttgtgttttttgtagagatggggtttcaccatgttgcccagtctcgaactcctgagctctagctcccaaagtgctggtattagaagcatgagccaccatgcctggccctgcttttagaaaatttattagccaattttgataataaacattcctccacctattatttttaatgactacctagtattctatagtgtgaatgcaccataatttactcaacctgttttccaacatttttattaagagaacaacaaaaatgttaaaataattttatagtaaacacacatatatccaccatttagattttacaactaacatcttattatacttgctattagtctgttctcacactgctctaaagaactacctgagactgggtaatttatgaagaaaagagatttaattgactcacagttccacaagcttaacaggaagtatgactgggaggcttcaggaaacttacaatcatggcggaaagtgaaggggaagcaagcacgtcttactacggcagagctggagagagagagaacaagggaggaagtgccacactttaaactatcagatctcatgagaactccctcacaaacatgagaatagcatgaggaaaattcgcatccacgatccagtgacctcccaccaggtccctcccctgacacctggggattacaattcgacatgagatttgggtggggacacagagacaaatcgtatcacctgttttatcacataccagtcaaactagctatctctccattattttt

SEQ ID NO: 23831 - DNA, 1028 bp, Homo sapiens
tcagtaaattgcccccttagggtcatcctgtataattctttaattttaggcccaaaaaactatgaaaggaattttgtgtaaaatgtaccaaaagaactgtcccatttaaaacattttatgccatgcttggaaatgaaaatggacccttcaagaagtaagtctataagttgttttatcaacttatagatgttactcagatggaatggtaacaacttggcttgtgtgttctctaaaaaattatcacgttttcaagttatgcatttaacctgtattgacatatggaagttttgatgtagtttcctttctcaatcaactccaaagagtcaaaagtgattatcaaagctgaaaaggcttttgtattttcttcaaatgttaaagccatgtatgtgaacaacaaggctgatgaatttgctgttttatttcgttgacatcttaattcaaaatgtaaactgaagtttcttttcatttctttgcactgttaatattattctgtttttggttaggttgggtaaaaactgttcactggtgtcattttttataattagacttttatagcttggggtttttggtaagcaaataaatattttaaatgtaattggtgcaattactgtatgtgcactgaacaactttatattgagcttcatgtcatgtcacatttttatgctagtggtttcttatgatttttttaattgtatgtggtattcttctgaaatatataattaccaactcaccctgagttggagaagcaagagttctgtcgttctctcaaacagacttgtattgaaagatataaaaaagcttgctttattctaacattatttccccatcgataaaagtggttcatgtctatgttatttttacatcttgtacaatcccagcatcacattgttctagtaggagtacaaacagataacccaagcttagtccagatttgatttgggagaaactagaaggctgggaaaggtagatggaaggttgtgatgagtaggaggccaggggtaaaagcagaaggaaacaagaataatgta

SEQ ID NO: 23832 - DNA, 1050 bp, Homo sapiens
cacacatttctcctgtctcaagaactgtagaccctttaaagcacaagttgctattatccgctaatgtttaagacactccctcttatttgctgaagattttagaacttggctcactatcttcctctttgtcattattctcaaagtcttcaacatccacatagatagatcatctatctgtagtttgttattcctccccgttatctccatagttctttccctgcacaccctcttagctacctacccccgcagtcataccccagaccttgtcatcaccaataaccacaccacctctgaaatctccaggtcaagcatcccattctctgatccccaacttctttttctacagctcaggtactgtgatagctccactccaacagtgtttcattttggacctccactccaacaccgtttacgtttttcattgctcatcactccctcctccctgcctgcctcaggttctcatttatcttcttccctatttaggttccatgcccatgactaggtatttcatcctcgacactcagcctctatgccccttcctctctcacttcaacagtccagctctaattaaactctgagcctgtccctgagcagctgactgtggcaatcaaccatgctgagtggctttggtttgaataatgaccacagatctcaaatcagcatttgagaaatcctgctacatttccctggtaaatttgttcttcaaacccctccaatatctcctctcctattattctcagctgatgacctggctgatcttgcattgaggaaacagaagcaactacaccagaactacttcatttcccatcactagagccacctgtccacctgtgtctgtgtcgtgtctcctccttttcctttggtaacagtgaatgaatggaccacccttgctcctcactaaggctaggcattcttcttatgcttcagaccccagctctcctcgccagcttaagtattttgctcctaaaattattccgtttccttcattaccacattcctctctctgctgatcgactcctatcaccataaaatcatgtggcagtatcactc

SEQ ID NO: 23833 - DNA, 1049 bp, Homo sapiens
tatgctgtcatccttatctttgtttttatataaaacatctttttcctctgggtgcttttcagattttctctttatcactacttttaggcaattcgattattattatgtgcctgctagttttcttcatgtttcttgtgtttgggcttgttgaaatttcttgctgagttaacagttttcattaaattaggacatttttcagccattatttcttcaaatattttttctgttgtctcccttctcctattttttgagaagtccagtttcacatgtattgaccacttaaaattgtcccacagctcactctttattttattcctttttttctccatatatttcattttggatagtttctatcactatgttttcaagttcactagtcttctcttttgcggtgtctaatctgctgttaatcttatccaatgtattgttcttctcaggcattgtagttttcatctctagaagtttgatttggggctttaaaaggtatctcccatgtctctacctgattcttagaatatattaaagaccattatgataactattgtaatgcccgtgtctgctaattctgacatctctgtcagttttcgattgagttcagttgtttgatttgtcttgtcattatggtttctattttttcaattttttatatgtctggccatcttggattatatactaggtattttgaattttacttcgttgggatctgaatgtttttatatttctgtaaatgtttttgagattttgcgtttgttttagagacagagtctcactcagtcatgcaggctggagtggagtggcacaatcacagcttactacagcttcaacttcccgagctcaagtggtcctcccttctcagccccccaggtagctgggaacacaagcatgcaccaccatgctcatctaatttttgtatttttttgtagagatgggatcttgccatgttgcccatgctgtttttgaacgcctgacctcaagcagtcctcccaccttgaccgcccaaagtgtgtttttgagttttgttctgggatacagttaaattactttgaaat

SEQ ID NO: 23834 - DNA, 1088 bp, Homo sapiens
cccccaatctctctctccaagaacagaagttttagagtctgacacacccagacacaatctttgcctccctatttactgcctgcatgatcctagaaaagtaactttacttatttgagcttcatgtcccttaagtaatatggaaatgatagtaaggcctcatgaggccactgctaggattaagtgaagtaatagaaaaagaaaaggccaattatggggttgatgtcattaaaccagcaaacagcttttgagctgacagctctccactccaactcagggatttatgtgcacaggtgctgtctgttttcatcccaacccaagtgcacaccctggcacctctcacagtccccaaagaggcttttcctagcaccatttgtgagtagtggagactgcattacgagaaacagtgataccacttactttgcaaccaacctcaaaactctaggagacttatgtttcctccattgtcactctgaggtttctttattgctttttctctctttattaactcttcccccttctgcatgtggtgggcagcctctctctcctgctccctcgcagtggtgatgcaaatctggcacttcacactctgcagccagttagcagccagcttttgctcttgagttttcctttcctgcctcaccctcctcttgatgtcatctagccttttgatgtcatctagccttttgatgtcatctagcagatttcctccaagcaggcacaaggctctcaccgagaggaattctgtggaagttgattttctgcttatccttactctgtgtgatagggcccaaaacacttgcatgtaggatactcatttacattaatccttacagcaactctgtgatgcagggattgttagtactcccattcacagatgaggaaactggggcttaaaagaacccctacaaatccacaaggaaatgatctacagtccaatagaaaaggaattttcaaaaggatctgtaaaatatggtacccatcatataaaactttaagcctgtgaaagcagcatatatttttatacagaggttcccccaacctttttggcaccagggactggtttcgtggaagacaatttttccatggac

SEQ ID NO: 23835 - DNA, 1026 bp, Homo sapiens
gaagaggattgttttagctaattgttaacctttcaattcttctttcaaaaaagggtgataggaagtaactataatgcaatgtttatgtctttaatgctagtggaaaatacatgagtacctcatatataaatgtaaagattatatataaatacttgttacatagttctctgaaatattttgtcaataaactgagacattttaagaaaaaagagattaaataacctcttaagatcacccagctgggaagaggcagatttcaagggttagatttgaactcaagtccatcagaccccagagataaactcataaccacacaccttatgtctcccttaatttattgacataagtattcaattaatggtctttctctttgtgtctcatctgagagtttataaacaagagtagaagtgagtccctgggacccagtgttccccacaggccctgctggtgtcaagcagttttgctcaggcagtcctcagcagtttcctgggttctgtccattcatgtacagaagaagactcaggcctgcccccagggttcactgacaccatagggtccatcagaagacaatgcaacagccaggtgcggtggctcatgcctgtaattccagcactttcagaggccgaggcaagtggatcacctgaggtcaggagttcgagaccagcctggccaacatggtgaaaacccatctctactgaaaatacaaaaattagctgggcatggtggtgggcgcctgtaatcccagctacttgggaggctgaagcaggagaattgcttgaatccaggaggtggaggttgcagtgagctgagattgtgccactgtattacagtctgggtgacaagagtgaaactccgtcttgaaaaaaaaaaaaaaaaggcaacataagatgctggcaaacagaatatgtcaagatgcctaaacgtaaccttgacatctcaacaggcctggtgtgaagacaatggcctagggtcgtgcagaggcatgggctccatatgggtccttttagactttgtggagccacccag

SEQ ID NO: 23836 - DNA, 1047 bp, Homo sapiens
actgttgcttctgttctaaaatcactgagaactgactaacatttcatacacactcagtaaatccttttcctgggattttttttccctggccacacaggtagctccattttccagcttcccttgcagttggttggtcatgtgacaaagctccagccaattgaataagagtaaaagtgccgttttcttggtcagaggcgccaatttgactcacaggcagggcatgatggtggtgggtacagacacctcactggcgatctcctccctcctgtccctgctgctcttcactgggatgcagatgtagatccatcagctggcctccaccgagtggcttaccatccagggtggcctgcatggctcaggtctcttcgtgctctccctcactgccttcaagattctggagaatcttgtgtttggcaaaggatcccaagcaaagaccttccctgagattctcctgtgcctcctgttggctctctttgcatctggcctcatccaccgagtctgtgtcaccacctgcttcatcttctccgtggttggtctgtgctacatcaacaagatctccactctgtatcaggcagcagctgcagtcctcacaggaccttggctcttgccaaggtcacaggcaagagcaagaagagaaattgaccttgaatgttcaataaagttgattatttgtttaaaaaaaaaaaagagtaaaagtgtaccacttctaaaccggcccccacctcacacctcccatgcctgtcctccacactcgttacttatccagcaactaagtgcaaaggattctaaggtcctaggtgaggatggaaccatttgataaaagagcctgggtccttgaatctccctgtgggaaaccacctgctcaccggaagcactcctattgaacttttgggtgggtgaaaaataagcttatgttttggaatttatttgttacagtgacaccttatgtagtcttttttcctgttctttacctcaactccatctgggttggaagctgacctgtgttgggcagattttgagtttgaggtaggtttttgttgacatgct

SEQ ID NO: 23837 - DNA, 1023 bp, Homo sapiens
gtccatcagcataattataggtgaggaaattgctaagagaggtccctgagcagttggaggccagaaggaaatattttcaattaattaatggctgggcaggtaaatttttttagtattaaaaaaattaagaattccctagtgtaagatgtcatggctgctaactgtctagaaaggggtacatatcagaagagggtaagctgagattcatggatgttcaaactttggttgtaagcacttttcttctttaaaatattattttaaagatactgtgttaggtttttcttctttttttcccccttaaccccaaaacaaactctaataaaataaccattctgtgagtttataagttgcactggctagaatttagcaaaatgaaaagaatttaacttggatgaatatattatgcctaaggaattgagcatcagtctgggctttgttaatggtgaatgcctaaaccaccaaatgattctgttgtttttgtgggtttcttgaaagagaccaagtatttagactctccctgacttatgtaacacttcagctattgcattggtaagtcaagaaaaataaggaacagagaacaggtttgaaataaagcttcctatctgggttgcaaggatacactttctaattatttgttatgataattttatcaattgcacctactgcaagtgctccttgtccttggatcaatgtgcattagccagagactctcttatcagtaagcttctgaattgcctgtatgaggcacaaatcgttggttgctcatccacaacataagagacttgatgttggccttttgggagctcatgtttcaaatcagattagagctaatgtggccagaacataagaacacaaggaaaaatgaacaaaatgttgtaggtatgaatgtgctgtggggcgtgctttgtttaaagcaaacctcataaaagaagagcagggttaaagaagcctattaagttagggatcacttatttgctttacaagaagggagggacttaagcacagctcttgtggcacattcgg

SEQ ID NO: 23838 - DNA, 1055 bp, Homo sapiens
cctaaatcaaggtgttggcagggccatgttccctctgaaacatgtcggggagttttttcttgtcatttccaccttctggtagccccaggtactcctgggcttgtgttagcaccgctctgctccctgctctgcctttacagggcccttttcctctccctgtcttctcctcttcttataaggacagtcattgaattagggcccaccctaatgacctcatctgaacttgattactctgcaaaggccatatttccaaatcaggtcacattcatcagtaccgagggctaggacttctacatacatttttaggggacacaattcaacccataaaaccatttgtcctcaagatgcttccaattcagtgagggagactgatggaaaagatgatggaatcagtgctacaaggggccggagcactgtgctgaagagtccaagggaggacacacacacacacacacacacccatgcacacacacccccacacacaccccactccaccccacactaaacacacatctatcacatgatgtagaatcggtccattctaaatgctctgtgggtgagtttgccctggcatgtgggctcgagggatgagtggaattttagttgtagagaagtgagccgtgcagggtgtttcaagctgaacctgagcaatgtcatggatgcacttttggtctggcctgggaaggaagatgcttctggtaacaatgtgtaagggaaggattggacgctggagacttgaggctgactgagagattctgcagggggccaaggtggctcaggaggcctgaacttggaagtggtggtgggatgagaagtcaggaacagatcctgaggagtgcggggtaggggagtgaagtaggtgggaggtggcaatggatgggtgggtgggagaaggtcagaggcgaccctcagacttcctgaaagggccgattgggagaaaggtgaagactttatttaggcaagatagggggttcaggcagagagtaaacttgaaaggaagataagtttgcttgtaaagatgttgaatctgagatcattaaagctccagtgtagat

SEQ ID NO: 23839 - DNA, 1865 bp, Homo sapiens
tgagctgagatcgcaccactgcactccagcctgggtgacagagcgagactgtctcaaaaaacaacgacaacaacaaaaaacaatacaaagatgacttatgcacttgaaaatgggagtcctccgctcagatacagatgtggaaatctacctggttttagtagctggtaaggaggctttagtgttgggcagcccggaatactagtcccagctcttgggcaagctattagcctttctgcacctgtgaaatggggatgatcatgcctacccactacaatcagttttcatagtgatgatcagctgagagagcatctgtaaactgcctagtctattgtgtgtgttatagaaggcgctcggtcagcatggtcagttttacttgcatgtgtttatcctgagcggtggactttatgcctcctgaaggctgattgttgggattacttcaagcatccagttctgtacctggttccataaacatttgttgaataactattgattgagatttagtcactgttttaccatagtgatatctaaatcactattatatagtagaacccttcttttttttcccccaaaataaagctctaggggtaccccagcatataaagtgaatctaagaagagcttctgctattgcaagcaggacacgaaccacctctcttttccatttctttccttcactgttcctcagacataccctacaaggagccatttgaacaccttactctgggagtagaagggctaaaagctctgctagaactgaagtttgaaaagagtcattccacagaaagacttctgggcttagtgttccggagatcagctgctaaggccatagctaacagcctcggcagataacagcctttcctattatcaagttttcttgagaaagccttttttccccccccgtcaggaagtcagtccttattcctaactaaaagttgtaaaatttagctgtccttagtaaaggtggaacacatggtcctcagcttctgttttatttattttttttttttgtatttctgatggctgttgttatgtcactcctacctgagttagaggccacagtgctgtttgctttcctcctatattttattctctagcccttaaaggaataatcaaaactccttgggctgggtgtggtggctcacatctgtattcctagcactttgggagcctgaggcaggaggatcacttgaggccaggagttcaagatcagactggtcaacatagtaagacccccatctctaaaaataatttgaaaaatgtagccagacatggtggcatgtacttgtagtcccagctactcgggaggccaaagtgggaggattgtttgaacccctaagtttgaggctgcagtgagctgtgatcacaacactgcactctagcctgggtgacagagtgagaccttgtctctaaaaaaaaaagaataaagaaaagaaaagaaaaaaaaaggaagctcattgacggtagaggcaccttttttttggagtctccagagaaccttgcacttgaaggacaaacatgggctctctgcatggaactgattcttctttggattttcctttattgtcctaaatagacatcatcatttgttcttgtgaaggttctttcctagaacatttcttttgttttggtttttaaaagacaataattgggcttctgtcacattctttggaaaactatctttaactatgcagcctgttcactcataacaaaaaaattcctattctctcatccatatgctcacagaagataaagctaaaatagcttgttttatattactggtattgaaatgacaaatatgtctccaaatagcaaatgggtagagtaatgcagatttaaatttcacctgggttaggaggcattatttct

SEQ ID NO: 23840 - DNA, 1029 bp, Homo sapiens
tgattgtaacctgggtgtggagtggggccttttgtcagttgctttaagttagatatctgcttcggagctctgtgtctggctctgttccccaggtcatagtagccaacaaagggacctggtcccctgcagttggcccttgaattttttctattgtttgagaactagaaattatttctgccagagatttcacctgagaatacatccaggtgagttcttgaggttagggtaggatgagaagcagtagaagccctgggggaaaagaattctgagttgatgctggggtaggaatgccacaggactggccaggagaatagtttcacagctgctgttgtagttggcaagagaaagaggctgtgaaatgaaatattacacaggattgccttagacactcaatggaaaacttttttccctccttccaccagaggaaatgaatgcatgctgatggtaatgagaaaatgaggctctgaaagtgcctgcttttccttcattttcatctttcccttcttttctctgaatcctccctgcccttgtgtcaagcttcattcctggttctcccaggtcggaggaacttgaagcagtgtttgtcaaccagtcttgactgagaggtgtctgagaagactgggctctacccttgcaggagtcagattgggttccagaatgatctttgctcttgtttctgctttgaatgaatggtttgcacatgtctcaatctctggcatcacatcccagcagtatcttctctcctgtttatcctgaggcaggattttgtattggccgcctgatagtttggccccccacaatgaattaaatttcaggagcaggaaaatgggaacccctgtcttctgtgtgtaagagaatctaagaatactgcatgtgactcatggtaagagatttgatcatcaatagcaagaaatacctttcatttgaactgtgtcttttagttaccagagtcctttctcattccttattcctgtgagaaggcaactggggcagagggtggttaagtgatttgctcaagatcccaaacag

SEQ ID NO: 23841 - DNA, 1050 bp, Homo sapiens
ttttaaaaaatcattcttcatttgaagaagggatccactggcatttctttaaataggaaaccatggctgtttttaggttgaggagttaaaacctacctaataatgaatgtgatgggccaagaagggggaaggcagaaaagcctaaagatgtggtattagtttccactcatggtaaatgagaagtgaagataaaacacccctgaaaaagtgcatctctctagaaatagatctggatttgcaggcattccatttatgggcacctgtttcagaagtaggtctgtggttataacagagagatacccataacaatcttcatttacacaaaggacttttattctataaagcattggtttgcaaacttttgcatttcttgagacagtaaaatgtctcttccttcaacccccacacctccaaaagggaagggcattgacataaagttatgttcttttaattttaccaagtaagaatttgagcaatacatttactgtcataattatttcatgaacagagcattttacttcaataattaaataagcattttttgagatccagtagccccaaacactgtgctaagtagtggctgtttaatggcagacacgataggcatggcccctgctctgatgggacttagagtcggatggaggaggggcatgaaacaagccaatacataagaacacatagaaagggtactctgaagagagacacagagctaagatcaaggtgaggggagatggcttgccttttggtggcatggtcagggaaggactgtcctacaaagatgcaataaacagggacaatgacattgagacacaaagggagagaaggagctgagtaaggaaagggaaataagtgttccaggaagaggaaactgcacttgcagaggccatgaggtgggaaaagaacttgatgtgctcaaggtcaaaaagcaggacagacacatctcaggatacagaatggctctttaaatgaaacacattcagctttatgaaaacttatgacagtgagtgtctttctgtcttgctttctgctttctttccttgctttcctcct

SEQ ID NO: 23842 - DNA, 1049 bp, Homo sapiens
tgctcctacctcagcctcccaagtagctgggaccatgggtgtgtgccaccacacctggctagaattttttgtagagacaaggtctcaccgtgttacccaggctggtcttgaactcctgggctcaaggtatcctcccaaagtgctaggtttacagacatgaaccagtgtacctggccaattcctggagctttttactgctacagactgccatgtgattcaaattaggctttcagaatgacctcctactccacagaactccattttcactgtcagccacagtcctagaaattccacccttagaaagtctttcctgtaagttaaaccttgttatgagtagttaaaatacagatgtcctagagaagggccataccatcttatcagtcatgtgaacctcagtataaatgaaatttatgagagcttttttttggaacagactgtcattggagagggaggaaagaatatgggggccctggacatcctagggcaggcaaagggctccatgtcgggaggctagggacagacatgtctcagggactcaggtttttctataggtgagccctgaatgccattttaagtacattctacccaggttgttagtgttaaaatatttggatatgttgaggttcttcatatgttagtatcaactcacagggcagatttatgtttcagagtacctatcatataaccaggagcttactaaataatgaaatacagtattattggtcattacctgtattaaataggtttattcatccattgatatccacctttttgaaaaaaggtttgaagtcagtctataatatatattatatgttttacttatagcttactttgggcagtagtagtagtggtaacaataatcattataatatcttagatgctgcttcctccaggaagtcttcccggatcctccaaatccagctacacatagctttctatgtgcatctgtagtgtgttgcctgcaccttcctcagccagcacctaacacactatttggtattttcctatttgtttatctgtctctttcactatctttctcaaataagatt

SEQ ID NO: 23843 - DNA, 1054 bp, Homo sapiens
caagtctgccatatctcccaccactagaggtttccagcttgagttagacatcgtcctcctgatgcaggctctcctttggctcagagtcctcagagactatcacttccatatgaacaaatatatctcggaactgtttagttgcaaaaaggaacaatcaaagcagctgtaagacagcttgtagtacagtttggggtcaagaccatagactttgggtttgaattttgcctcctccatggattagctttggtcaccataggcaagtcatttgacttttctgtacccaggctccatcacctgtaaaatggtggtaatggtagcattcacctcatagcattgttttgcagattaagtgaagtggtgccgaggtgcctggcacaggcctgtgtgagtgttggctcttagcagatttgtggaagggaaaggagctcagggagatgggaagtggcaggaaagcaaagtgttggaggaaccaaagagaaaataactcttagaacatgaacattttgtgcacttgtctgaaggtgcacatgggaatgaatgaggaaggcaagccggatccttattctggggaacatagacgccaggcaggaggtaaggatgagaggataaaggccaaggctttcattcttgagttgcggagggttgtggagaaaggaaattaatgctaatttgacaactactatgtgctaggcactgtgccaagtcttcctatatattgtcccatgtattttttaccatctgacatacacattttctttttctttttttgagagagagtctcaccgtcacccaggctggagtacagtggtgggatctcagctcactgcaacatccgcctcctgggtttaagcaatcctcccacctcagctaccagagtacctgggattacaggtgtctgccaccacactcagctgatttttgtatttttagtagagacaggttttcaccatgttggctgggctggtcttgaactcctggcttcaagtgatctacccacctctgcctcccaaagttttgggattacaggtgtgagccactgtgcctgaccgacata

SEQ ID NO: 23844 - DNA, 2698 bp, Homo sapiens
ctggataaatcaggaactcccaaacactcttcaaggagtcatccctcactccccaccctgcctgaagccaggcggaatcaggcctgccagtcctggaacacgctgtgctcttcttcggagcactcagacatccactacctgtccagcctttgtgcgggtgggaacagtgtccccattcacgaagcgggagacccggagtggggctgatttgccaacggcccggggctcctcctcgcaactgcccagcggaggacctctcggctccttttctgcctctttccaggtgtatcctctcgcctgtgatgtgtagatgttccccaagcgtctgccctacctggcccccttctcccctggagccttaagacacagaatgtcagggtggagtcaggtccaatcacatgctctctgcatgtccccttgccctcaggtgtgctctccttgctctgtccacagagcttgtcttgcccggggccctccctcacctccacctggggcctaagactcaccccctctgctgacttgcgtacattgccaagtgcttcttggacatttcaacctggacatcgccccaagttcaacaaaaccaggaacaaatttacatccctcccccaaccttagcaccccttcctgattatacagcacctccattcttccatctccctggcttgaaccctttgtttcattccttttccccatgtgctcaacacctcctggcaggtcctgacagcctcctatgccagcgtcctcctctccacagtcctgctgcaggcgacgcaaaccttttgtctgggctcttggaattttctcctaactggcctccctgctgccaatctctcccacctctagcttcatcctgcaactattaccagatttacagttttaattatgttaattaaaatcattaattaacatagttttaatgatgttatttttcagggttttctctttgctttagcattaagcaatgacttcttgcatagcaactagagccttttatggcatttacccagtctttctgacttaatttctttacacctgtagataaagtacacttcagccagaagagctgatttgctgttttcttcttaagctgtgtatttccttcctctctgcctttgctcatgccttgccttccccgaaatgcccttcctcctctcctccactgtttgaaatcccactgttttcagataacctgtcttcaagggtctttttctgatttttgcaaccagacgtgttttctctttcttttggattgcctttatgatggagattatatcttgtcattctttatataaccacagatcttagccttgtacgttgttctcagtattggctgaattgtactgaatttgagcatcttgggaaggatcagtgtgagtttctatgagggcctaaggtgtgaataactctgagatgtttgattgtcatatatggcctaagtgttttgcttttaaccttacagttattgggcattaagatatgacagctcttaaaagtacaggattggaaagcatgtttctagagactgaaatagatgaattttaatatccaacagctatgtagtttttacacggctcaatcacagctgttatttcgtgatcttcaccacacttcaaagtaataggtagttcatgcattatttttattaagcaaattaaggggcagtgttggttcatgtaccagtccaaggatagatggaagcaaagtgggatgacagtgctcatatgaagtcatcatattgctgtcattgtccctccaggctgctgtcttctggctggctgtattctcagacaagatcttcccaagtggtggcacaaatggccaccagcctctccaggcttaaattcaactattaatattttaggaacctacagaatgatacgagagggtatctctcctggtagctttagcagaagtcactgggaaggcccgtctttggtccactgctgtggctgggtctggacatcattggacagaggagaaaattatgagccttggaaaagctaagtgacttttctaagatcacacagaagactgaagtgcctgtcttgtgaccaagagtgtccctgtgtgagcccttttttgagtttaggggcagctgttgactcagtcgcaaagggaacagattgtatatttggggtttcaactttcctttttctgtacccttttacagcctgcagaggactcagctaattctgaagactcatctaatgtccagtctcttaaaattctgtttcctcccttcctttttaaaaacctgacgtttatataaaaaaaattatgttcagtgaaagaagccagactgaaaaggctatatactgtattatctcatgtatgtggctctctggagaagacaaaattctagggttaggaaatagatcaatggctgccaggagtggggtgggggtacaagattgagtacaaaggggcccagggaattttttgaggcatgaactgtttagatcttgatggtggtggtggttacaagactgtatatatttgtcaaaatccacagaactctacactaaaaagggaaaatttcacagtatgtaaattatacttgaataaaaacaacaaaaaaccttaaatcctctttaggcctgtttgacaatgggatttgcatcttaatgagcatcaatactgtagctgtgatgaactaagtagctttgagatacaccataatctaatatcaagaaca

SEQ ID NO: 23845 - DNA, 1058 bp, Homo sapiens
cacatttcattagttgggttccccctttcatgatttctcattttggttgagaaatgaaggacattttagctttcccttccctcttttccttctgtaaaaacttaagtctctgatagttggccagggggctcgatgggtaggggagagttaggaggggacagtgagggctgggagatgatgctaggtgctcttttccttctcacctgagccctacctgaacaatgggccagacagagaatggatattgagcaattatgctgttttctttctctgtttatccaaatgctctgtctttcacatgcgagatgaaggaaaacccatttctactactgattttctctcccttctctgaatatgtgtaggaattatagtctttaccatgcagcttaacacacattttacatctatctgttggctaatgcttaattatatccaaatgttgtgtctccaccttgcagtaggctactggaggcccagaactcaatggacaacttcatatctccacgttaccaggacagggcttagccacagatatttatggatcacctgattgttctgctactgacatgttcacctcctcaaaacctgctttcaaagcttggcaaattccgggccattttggcagcagagctgtgggacaagatttaaattgtttgttgccatttattggtgaactggacaatcaatccaaatttaaaattctctaatcagattagtttatttttaatcatctggagtctggctgggtttgttctgtgtgggagccagtgagacccaactgtttcattgacttcctttgtatactcttgacaaaagtcttttcatcctcgcccaccttatgccttcaaaactgtgagtcaagctgcatttcctttttttctccttcctccccatggatacatcttagttgccattttttcttacaccccttttgttaggtgttagggcttcagtcatgctgcctccctttggcagggctgggaggggtgtgtgtgtatgtacatatctgcatctgtgtgtgtgtggctttttgcatgcgtatctgatggttgtgtgta

SEQ ID NO: 23846 - DNA, 1059 bp, Homo sapiens
ccaaatgctgtgtttaggggttgctccttgttcagataacttgcaaacttacatagtgtactgatccatgtaactctggccttctccttttcagagaggatgggtggagtcagaggaagggaattgtgcctttgggagctgaggttttagacttgtagctggggccccctgatgggctggcactcctctgaaggcagatttctagggtgagaacagaatttcccaggccattttctttgcccttctgtatggttgctgtcaagtttactgctttttcaaaccctgttagcttttgctttgttactataggaacaagagctggtagtctgggggaaatatatgtgcatgtgagtgctggggagggggtgtagtggctgtggtggctgtggactgaagggagtgaggacagcagaagatgttcaccgctgaagtctctctgggggccctgcccactttggccagtgctctcttcagagagtttttgactttgcatggtacactcttggggaacaggcatccctttgtagatctgcagcactctcctggcacccatccagtccttcagtggaacatctggaaagcctcggcccctccccatgccaaagccactgagccctggagacagagatcaatgacctcttctttgctgctccttaacccgtgtcccagacaagtgtttttctgggaaccagtgaataacgcagatctttgatgccagcgcttgtgtgctgttgcagtaacactttcacttttgatgatagggtgggggcagaggaagggcctcggtagggagagcaacgagaatttggcttttcaggaaatcagaactcaagtggggaggcttgcttcctactcactggttttctggctgggaaaacagcaggctgagccattgcctgatgtgaatgctccttcgtgctggggctggtattaggggtaggggtgggcttgaggctagagactaatttggttctaacctccacaggcaatccttgtaactcctgggagataatgctgaaaaagtgcatggtgatttttcatgcatgtagtttataacac

SEQ ID NO: 23847 - DNA, 1062 bp, Homo sapiens
aaatacttcagtacatagtactctctgttccttctgtttctcagtatcttttcaaaacttttgtgtgtgtgagacagagtctcactctgtctcccagactggattgcggtggtgtgatctcggctcactgcaacggtcacctcccaggttcaagcaattctcgtgcctcagcctcctgagtagctggtattacaggcgcccaccaccacacctggctaatttttatatttttagtagagatgggattttcaccatggtggccaggctggtctcgaactcctggcctcaagtgatctgcctgcctcagcctcccaaagtgctgggattacaggtgtgagccaccacacctggtcttttcaaaactttctaaacatcatagtaatatgtacttaactcatgaggggcttttcagatttttgcctagaatgaataaattcagatagctctacaagtatatggagtgcctaccctgcacaaggcactatgctggttgagggatgggttaaggtcagattttgttggatagagtggaattatgcaatggaagtggatttagaagatgttaggcccctgtcctgacagcacgcatggtctagttggaccttggaatgttggctaacagaaaggaacataagttaggtgctcaatgaagtcgcttgctttgtctgctcagcagagctggaggctgtgtcgtctgagtatttgaagatgagggcttttaggaagggcgtagatattgggttgggtttgatattgtggttagtcagttgtcagccagcagtggaaagtgaaagtggcatgtgcttgagcaaagctggcctaatgggatatagatttacccgacacacactgatagcaaatagattgtccttacagcctttaccaatatagaactttgatacgtaccattctgtttgcagaaagagcgaccagaaatgtgcagcagtcagtaatgtaccccctagggttgctgttcattctgactcaaggaactttttggaagcccattgcataactaaaaaagaaatgggcagtctggtgtattgttggcaaagcacaccc

SEQ ID NO: 23848 - DNA, 2038 bp, Homo sapiens
ctggagttcagtgggctctgtggccaaataagtttggatagtgcttgagtgagcactgggagtttctggactgcaagactactcaggcctttgtatgctgatgtacagtgactttcccagatgggcatatatagcatacaacttcctgcttatttgattgtggaattatgtattttccccccaggaggatcctacgtgaatatagtttagttccaaataatataattgagttgaggaaatgctagtctaaatgatttcacttcagtatgtgttttagtgtgaatcactatcaatagtcatgttttcagtggtctcagtgcccgagggagttgattggaaggaagtcagagggacttcattaaataagtcagtgaatgaggagtcctccaagggatccctgcctggcaagaaataccctcaggccatcttggttcagaagttattcctccatacattaacaggcacataacacaggctttaaaaaatactaattttgtgaatattatggctactccatagacagagcatccccttttcttcacttgagatacagggaaggattttgtgtcaatggtatggcgtcaccatccccatgggacagggttgcagcagctggggctgtgagggaagatgaggccgaaagacccagcaagattagggttgcaggtaagatacaggacaccgttaaatttgaacttcagatcaactctgtataatattttggtataactatgttccaaatattgcatgtcacatagttataaagaattattttttctggaattgaaacttaaacagtcatcttgtatttttatctcctgtctggtaaccccatgtaagatgttcagggaagcctagacacacagaccagaaagtgatgtagaatgtacaaggcaaggcagtgaggaatgattccaagttttagagagcccaggtcttccttcttggaaatgggttaatacatcctcaaaccctcttcccacctcatcactttcatcatatccccctcagtttgggagcatttgtatatgagagcttgtagcctggcagtttttttttgtttgtttgtttgtttgtttgtttgttttttttggcagggtctcactctgttgcccaggctggagtgcagtggcatgatccctgctcactgcaacctcccattgctgagttcaagcgattctcgtgcctcaccctttggagtagctgggattacaggcacgcactaccacacccaggtaatttttgtatttttagtagagacagggttttgctatgttggccaggctggtctcgaactcttgatctcaagtgatctgccctcctcggcctcccaatatgctgggattaaatcaagtgcaagatccaaaatgttactaaaaaagcttttcagctttttagattctcttaaaaatgcaaacaaacagacaaaacagtttcttagaaagaagccggttgcgtgcgaaccgagaagtcttgaaaccaaaagaactccaagttccctgcctgtgctgaacactatgggggtggcacgtgcccatccagggcaaatcacagggggagaagatgaggtttcttaacagtaccacctctcacttttggtatttgtaatggagaacacagacttatatcacatgtgaaaatgaaacaatggtttaaaaagtcatgtctctgtgctggctctggatgagatgagccttttgagaaggcagaggcgtgctcggtgggttgggctctgggcatttcttcccctgccaagaagcgaaatgtcttagctccatgtgcgttgatgattactaactggccagggcttactgtaagtgggctgtgctcggggatctcaccaggaagaaaaagaatcaaactaatccctttctggaaaccgtctcccccggttgcctgggccacctgtcccagatgcgctcctctttcccaagactcttgctgtctccccgctgccccagaagcctgccttttctccagccctgcatgggacattctcctgatggcagggacccatgagaggggggctgggtgagcc

SEQ ID NO: 23849 - DNA, 1033 bp, Homo sapiens
gatccacccgcctcggcctcccaaagtgctaggattacaggcgtgaaccaccgcgcccggccaagcatgctgcattttaatcatcaattagcatcagtaaacatttactgtgtacctaggatacatccatccgagtagtgaacccaagggagaattctagagcataagctcggggagctcacaagctggccaaggatcacctagactgagctgacttctattaggactcttctaagacctgtgatgttgatgacagaaggctgctttcaatcatcgtgggctgggcaaactctggcaggcttccagcaacagtgggacttgagctaggactcaaaggttttgcataagcagataaaatattggggtagtcattcctggcccaggccagggataacctgagggtgcgattcggtgggggaggcaaggctaacttcagtgggtagaatcaggttgggagaattcagtggggctgaatattcgaagcctcagtgccacccactttggcttgggaatttctagaatattgtgccagtttttttctacatcccaggaaatgggggacttgcatctcacagacttgtgaagtataaataactcaaatgttgagaaatgacaaagttggcaagcatgaattttcggcctgctgctcagcggctgactgctgaggcctgcaatgatatgcaagggaacttggctggctaattttgaattttcctttctccagggccatggcaagaggaatatgggcagaggggggaatcagtgctttgtttcagggcaactgccatacataaccactgtcttcaaataaaagcctttcacaagtaggtttccattacacagcaagtcgaggaggagctggtgaaatcagtgagttaggtgagtcccccccatcctcaggatcttttgttatggtggtggtggtaatggcggtgatagtggtgataaagaggaggggatgttgcccttaacgtagtactggcatattacatagctcttccatacaggtcatcttatttgatcctaaagcaaa

SEQ ID NO: 23850 - DNA, 1048 bp, Homo sapiens
ttatctttgatgagcccagggccgaggaagagtatctggctattgtttgttcttttgggctctaagatagtacccctagcactaaactccttgacttcaaggattccctttcacctccctccaagctttcctaggctgtagttctgtaagaaactgcttctagttgttctgtgttgtgatctatgggaagaggtggctgagtcccagtgacctctacaaattttgcttgtggtgtgtgaccatgggtatagttcagactcaaagctataatgctttacatttgaatataactttatacttctttttgagatagaatctccctctgttccccaggctggagtgcagtggtgccatctcaactcactgcaacctccgcctcgcgggttgaagcaattctcatgcctcagcttcccgagtagctgggattacaggcacacaccaccatgcccagctaattttttgtatttttagtagagatggggtttcgtcatgttgcccagactggtctccaacttctgagctcaggcaattctgcccgcctcggcttcccaaagtgctaggattacaggcgtgagccactgtgcccggcccataactttacacttctctggacgtactgtttcattttagtccttccacaacaatgtgtatagaagtaatggtagatatttttaacagaaggatgccgaagcgtctttgctagaatggcaagaatcgagacagagatgaggctgggacaagccttcctcagtccttcttcatgctttttcctgccccccactaatagtgtggatggactttttttttcctagaaaggtccgcagctcatgcatataatgcatgcacataatccatgcacaaccagaattagactattctgcagctgatggagcacctggagccttttgtaccccgaggctgggagtctgggggcccctctgtcagcgctgaggtccacctgtctgagttgtgcttattgtaggcgggagcagccttttcctattagctgtgccacagttcaatttggaattgtgcgttctttcttctt

SEQ ID NO: 23851 - DNA, 1089 bp, Homo sapiens
aagcaggggtgcattgttaccatatgacatggcaaaaagggattacctgctaatgccatttggtttagtgatgccttgttacataaactactctggaggagttcaaatatccctcaggcgaacgcttccatccccaggttggtaacactatagctgagtattgttttatttgccatttttcaaaagagggagaaacatacccaagccattatccagcctaccaataatacatttcaagaaaacaaccgcaactcccaatcctttcttctgagggcaggatgttgtagggctattgttccttctcaggccactcttcaacctacagaaactggtctgggctacagtcagattacagggggtatcaggaggcctttgagagtcaggaagaaagtcttacagacagaagcccagctctagcaaagagggaaagatcactgcctttgaagctggatacatatgtggcctttaatttgagtgctggttggttgtcgttgggcaaatgactgaaactccttgatgcttattttctttatcttaaaaacataaaaaataaatgaggataagatgatgatgaccatcatagggttgttttaacgctgggatgcagtgatgtgtgtgcaagctcctggcacagcaacttaataccagtctcctctgtcctgtcttgcatctgctgaggatgaagaaggagagcagttgagtgtggccctgcctggctgggggcccttcctctatagttatcttctttataagccatttatagtcttggtataattttaaggaaaaaaaatcaaggcgctactttgcatttaaaattcatttttgaaacatactggcagcaaacgccacactattgcagttagggaagacaggagagcaaatgtcaggtcttggcaaagtggggtggggaattttttgagtgtgacatttgaataaagaaatctaaactaggaaaaaaaaaagttttccccgatcttatcatggtacaatgaagagttgtataaaaactgtttgtccctgctgcatgtttacttacccatgggcaggatatctcacgggccaaaagttcaaactactgctagctcccaa

SEQ ID NO: 23852 - DNA, 1033 bp, Homo sapiens
tgcattctgagggcattaaaccgcagtgaatatacaaaatttgcttttcattgtaaaactgaattttgggcttgcccaaactcatacatggcgaaatcaaattcattttccatggacctggagatcagcgtgaagcaaggtttctaaagagaagtgtcagttgcattatggattcatcatcatttgcttagcgaagacatcagttataacaagagattatattttcctgatctctagactactaagggaaggatattaaaatgtgagacaagtgattttaaagtttttaaggcttgatatgacctttccatgcaggaaaagtgggacaaagaaagaattgtggaggcagatatatgttctggtaccctctcacaccccactttcagacttcttttcccaggctttcactcctacctccacccctttgtcccacccactccaaatcaaggcctttttctgtcctgtttggaaagaactcaataagctgattcatgtgaggatgttaatgggtgagaacagctaatatacagtctcttctagagatactgactttgttcagatcattcctttaacttaaactaaaaagtctcgtcagtcaacaggtgtttgctgaacccagtcctgtactacatcaagggtaatacagagaggcaagataggatagtaagatacatgcaaagaacaaaggcatgaatctctcctagtggactttcaggactctcagggagcccaggaagatcaggaaggacacagtgccttctgtcaaaggcatcagaggagcccaggcctgctaatggtggcatttaaaggtatggctaaggatccagtaagcgatcccagagtgatttccctgtggcttgactggcactgctcttgcagtctgcacatccgggagggcggggtttgaggggccaggctgtgggtcaggtggaggggaggaatcagtttaggcagagccttagaaggaaggcccctgtggtggtcacaaagtggtaactgccaagcacatctgaaccaggaagaccccatcaga

SEQ ID NO: 23853 - DNA, 1103 bp, Homo sapiens
actgttgtcacaacaagcacactgtcctcacagctcccgtcagggtgtcctctgtgcagtggtgcctgctgccaggcggaggcagacattcagatggttggcagtatgcgtttccagaaaagtccacccaatgcctttgcaccatccctggcaaatgcctatctgtgccagtcccatctgttttcactccacattcatgcaagctgtcccacccccccccctttccagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtgacaccctcctctatctctttcaaaagaagaaatgtttccatttgggggtagaaatgagtggaaggtgctagccacaatcccacttgacctctccctgcaaatgcccacggtgaccctcgctgacctcaggccacacgcctcaggccacgctcccacccccaagcattgggtttggctttgctcatgtccatcctggtagacagctctctactgactcattaacagaccaagtctctgtcatcatcagtagtccccgattacatctttctgtctgtggacctgacactggactgggattatgagaaaacccaattcagtctcctccctgcctccaaatctggaaggtggctcagcttactcttggagtcttttacttcactgttaggaataatgatgcctaaccttgtttttgaaacaggtggagctaacaggacatagtatctttgacttcactcatccctgcgaccatgaggagattcgtgagaacctgagtctcaaaaatggtatccttaattgtgtttacttccttcttgcccccactgggtgggaatctgcctcccctttgtctacgggtataagggagatagctcatggcccttgtgatgcaggaaaaatggatgtccttaaaaaatttaagtatgtagcctgtgagatgagattggggcattgagaggatccagtactcagaaatatctcctgctggccctgcatggtgcctgg

SEQ ID NO: 23854 - DNA, 1031 bp, Homo sapiens
agtatattgtgcctggagttgatagaaattccactagaatgccagatcctagaaccttttcaaccaaggtgtgcaacagctttgcgcattgtaattcccatagtccctattgtgggatccatggttccaagcccagtgctccctgccgtaaatgccctgttgtatcagatggttttctgtcttaagcagagcccgtatccccattgatagaagagaaatagcttagagttccatgcagaatttgacagacaagtagggtatgtaggcttcagttggttctactttcagagagttaagatggaatgaggcagctcatggcactacaggtcagttgccttctctccaaaatgttcactcatgcatgtgggcactcattgtatttgaataacagcaacagtgcctccctcagtttggaacctctagtccacttgctcactcatggtccctgccttaaccccagtcaagttcaaagccataggcatcatttgtccgactgacatattagggcatctaccagtcaaagggtgattgttgtagatgacctttggccttctagagcaggctgctttccacttgacctctgctgctattagcagacaaagagagagaatgggagagagagtgtattggacttcagtccccatcatgtgcactgcctggggacatcccagcacactcagagcaccactgccaaagggaacacttcccctctgttggccaagcccatgggtggtccaggagcagctgtcacattttgactgccaagcattttggagtggaagttgaccgaggcatcttccttctcactaggggccttgcgtgtgttttgggggtgaggggttggcttcctgcctgggcctctgtggagcttctcctttcttgcccagccttcaggacttcagtgtaggctctgcagcaaccccattgtctgctcaaggagggactggagagatgggattttccctcctgctactgcactgtttggagcgatgggaagtggaaagagctctccctctctgtccagacaggcc

SEQ ID NO: 23855 - DNA, 1045 bp, Homo sapiens
tatcatctaccccttctattctgtttttgaaatgtgattctatttttaaagtgccttttcctgttgtctggatgttctttttttctttagcatcttctaagcggtttaggttttgttttgttttgtttgagacaggctctcactctgttgcccaggctggagtgcagtggtgtgatctaggctcactgcaacctccacctcccaggttcaagtgatcctcccacctcagcttcctgagtagttgggactatagctgcatgccaccacttctggctagttttttgtttgtttgtttctttggtttctttttgttgttgttgttgttgttgtttggtagagaggaagttttgccatgttgtccaagctggtcttgaactcctgtgctcaagtgatccacctgcctcggcctctcaaagttttggaattataggcatgagccactgtacctgtctagtttgttttttgatggtatatcatctctgatttctctgaggatattaatgatagtgtttcaaattttttgtctctctgtgtaatctctaattttgatctctttcaggtagttcctcaaatgtctatctgtgtttacaagagtggcattgagcacatgagaaagcatgtatgggcagggctggttgactctgagcttccctgttggtcagggtttctcagcttcagtactgttgacattgaaggctggattgtttgttgtgggggggctgtcttgtgcactgtaggttgtttagcagcatccccagccttttccccctagatgccagcagcatccctcctccattgatggcaaacagaaatgtctccagatattgccagatgttctcctggggcaacaccagtcctcacttaccccacccccagttgagaaccactgttgtagggtgatctgttggggtctttttattggggaacctgtagggttagtaggtattggtcttcccccttgggctagtcatataaaccaggaaagaatcttctactcttctgcccgagggattcatcctgggaggcgagtgaaagaagcagagtg

SEQ ID NO: 23856 - DNA, 1109 bp, Homo sapiens
tcagtataacatcctggcagtgatataaaggagaaataaaaaggaaagtaattcatcataaaactatttatttcagtgttaaattcctaaactcccaaggctgactactccagaaatcataatgaagtaatcaggcctgcacctattaggtaaaatgaccacgaatgcaacagttacaaatattggctaacatagttattttttattagtgactcagatactaacagcaatgtagccagtggcatgtggttttctgtgatggtaagtaaatcctgtgatgtttgttttttctttttcttcttttttttttttctttgagacagggtgtcgttctgtcacccaggctggagtgcagtggcatgatctcagctcactgcagcctcaatctcccaggctcaagtgatcttcccacctcagcctgccaagtagctgggactataggcacacaccatcacacctggctcattttttatttttgtagagatcgtgttttgccatgttgcccacactggtcttgaactcctggactcaagcaatccacctgtctcagcctcgcagagtgctgtgattacaggcataagccactgcacccagcctcctgtgatgtttcaaacaaaataaagttcaatctttctccttcaatgtggactgaaattaccttcctagaaaattcattaaagtctgagggccgtggctcatgcctataatcccaacattttagggggctgaggcaggataattgcttgagcccaggagttcgatactagcccaggcaacagagcaagacccctgtctctacaaaaaaaaaataaaataaaaaaatttctgactagctgggcatggtggcatatgcccgtagtatcaactactcgggaggctgaggtggaggctagagcccaggaggtcaaggctgtagcaatctgtgatcatgctactgcactccagcctgggtgacggagtaaaaccctgctcaaaaaagaaaaagtttaaaatatgcactaaagttatgccaaaaaactttatttttttatatatgcagcaggatcaggtcctagattcatgcgattataaaaggtgttccatggtgagcaggtctatgcaaacctacc

SEQ ID NO: 23857 - DNA, 1104 bp, Homo sapiens
ggcgctggagtggtgtccaggcacattgtgggcactgctgcacattcaagtgcattgccttatttttaacatatagatacttaatgagagagctttgtaaatgtttataaggtgttttacaaatagatgttatttgaatctcatccttccctcctttatttattgcagttagcactgttctgggcacatagtaggtgcttagtaatgtttgttaagcatttctatattcacttgctccagcttacacttttattccctcctattgttgtatatgactgtctttttatatgtttatatcttgaattcccaactaaactgcaagctccagagggctatagtctcaataaatctttgctgattgcttttaaataatacatgatagcataccagctaacaaagcatggcacaaggtaaatcgtccaatgtgagtgtttttatttaagaaatgttttggatatgtattttaaaatagacatacacatcccaaaaacatatattttaaacagagatcactaaggtaggagggaacacccaggtccacatgaaggggacaaagaatagtgcagaagtaaggctcatgggcactgctggctgagctgcacacagaaaggggtctccagctgatggccattggctacatttctctgtggcattggaagagcttttgtttcctctcagagcgcatttctttagttttttgtttgcagattcttatcaggtggtaagtgtgtgtttttttttttttttttttttttttttgagacagggtctcactctgtcacccaggcatgttcatggctcactgcaggcccaacctcttgagctcaactgatccacccacctgagcctcctgagtagctgggactgcaggcatgtgccaccatgcccagctaatttttgtatttttagtagagacaggatttcaccacattgggaagactggtcttgaactcctggactcaagcaatctccccacctcggcctcccaaagtgctgggattacaggtgtgagccaccgcacctggccatgtgtgatatttttaaagtaaggttgtcattatcacatatcgaggactcttcaacaagggacagcctgaacactaa

SEQ ID NO: 23858 - DNA, 1514 bp, Homo sapiens
tagatgttaattatgttgatttaatcatttcactcgtgtgtgtgtgtgtatatgtatatatagagagaaaatattgctttgtaccttatataaaattataatttgtccatttataatatttaataataaaagtaaattattagggacgtacttagagctacaaagatgctgaattgtttataatggcaaaaattccctgcatctattaaaacttcatactatctgttaagatttcatatttattatgtagctaaagggaaaaaagtagttgcaaaacagtatgatctcatttctagactcatcagcatttggcacagttgcgtccttcctgaaactttcttcagttggactctcttggtttttctcccctctcattggactctgctccatctctttacctccttggtccctggttggagggccccagtgatgagcactcagctttgtggatgtcttcttctatagctacactccctaggcctaaatgagcttctgtcagtcttgtagcttgcacagtctacaaccaaagattcctggatttccatctccagcctggacctctttcctaaattctcaatttggttatccagctgtttactcaacaagtccatctacatggctgagtatctcaaaattaacatgtctaagatatgattcttcttttaccctccaagcctgtcctcccagttactcaggtcagaagccctcagctgggtgcagtggctcacacctgtaatcccagcactttgggagcccgaggcgggcagaattacctgaggttgggagttggagaccaccctgaccaacatggagaaaccccatctctactaatacaaaattagctgggtgtggtggcacatgcctgtaatcccagctagtcaggaatctgaggcagaaccgcttgaacccagaaggcagaggttgtgatgagccaagatcgaaccatagtactccagcctgggcaacaagagtgaaactgtctcaaaaaaaaaaaaaagccctgaagtcgtacttgaccttgctctttctcccataccacacatctagccttcggcacaacataccttcagaacatatccagaatccagacacttttttctaactcttccctctatcacctggttcagacctcctccatctctggcctgctttactggaatagcttccaactcacctttctgcttctgtctatgccccatggtcatctgttctcaacacagcagccagagtaagtcttaaaaatgtaagcgcaatcatgtcactgctctgctcagaatcctccagtgggtccccagctcagactaaacgccaaagtccgcacagtggcctacaagcctctgttccctctctgccttactcattgttccccaggcctcctggtctcctttgttgttccctcaaagttctacctgagaacctttgtacttttgttgttccctctgcctggaatgttcttccctatggacatgattcattctttcactcttttcaggtctctgctcaaataccacatc

SEQ ID NO: 23859 - DNA, 1050 bp, Homo sapiens
taatgatgtgtttatgtcatgccaattgtataaacatgatcttatatatttgtgattttttttctccctcccagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaattta

SEQ ID NO: 23860 - DNA, 1077 bp, Homo sapiens
tcagctgatccaagctgtaaggtgtggcggaggacacatgaattttaccaggacatgatctaggcaagccaaatacagataaacttggtcaggttcagatttaaaaaatgaaaaaggataatggcagcacgcatgttggtgatgatagccaccagtgtacctgtctcttaagattcactctagtatgaactgattatatctacacctggtgcagctgtcacctttggatttccctacacctctcttccgtgttgaatgtcctgtttctttatcactatgtctttctttttcttagtttccttaggtttgtttctttttcttagtttccttaggtttgttttgaggcagggtcttgctctgtcgcccaggctggagtgcagtggtgcaatcacagctcactgcagccttgacttccctgggctcaagcattcctcctgcctcagcctcccaagtagctggaacaacagacatgcgccaccacactcgagtaattttttttatttttttgtagagacagggtctcgctatgttgcccaatacagtcttgaactcctgggctcaagtgatcctcccacctcagcttcccaaacactccattgttttcctggagcacatcctccagtaaattcctgatcaaggatacatggaaggtaaaattttgagaccttggatttctagaatttgtctttattctactctcatgtttaatcgatagtttggtaagttatcaaattcaaaataaaaagcacttgccttcagaatgttgaaggcattgctctattatcttttagatcccagtgtcgctgttgaaagaagccattgtgatttcagatcctttattgctcccaccaccctggaaacttgtagcatctttcattcatcctcagtatttcatgatgacttgctttagggtgagtctattttcatccaatatactggatactcaataggcccttttagtctagacaccaatgtcctttaagaaaattttcttaaagtagtatgtgactattttctcccctccaaattttctgttctctttccaaaactccttttattcagatgtcacacaagttt

SEQ ID NO: 23861 - DNA, 1045 bp, Homo sapiens
agggattaaaattagaaacaagctatagctcgaaagcaatgttactgtactagtaatagtcttgctattgttttagatctcaggcaggcatgctgttggtggtacttcagatgataaatacctgggccagctattgagtccaaagtgatgctagcagggctaagaaagccacatgtagccatcacaagttttcacagttttttttttttcactgatgcagaattttagtgtttgaagagtgaccaatttctaatattcttttggttaactctcataataaggattatgaagttaccacaatttattggacatttattgcattcatgacatacttttaggaatttcataggtactctcttcaagtctattacataatctaatcatgtgaataaattagttaaatatggttttagaaggcatgtcatgttaaaatataaccaaccattgctcattttttcattaggttggagttttctttatacatttaaagataattatgccattgtgaatggactgttattcatatttaaaattcatggttatgtgaactgagtaggtgtagactgtacaaattactttcttagtttcagtgcagttgttagagaatgaaagagggaaaatatgaattatttgcattgtccatcttaacaaattcttcatctgagtcagccagctatcctactttcaaggggagtggggagggcttttgaatctggttagagcagaagtaatcttgaaagggtaattaggctggattgttgactcatgttaatattggataaatttgcatcttagtgacctgaaaattagttgcctgcctttacatgtaggtgaaaaattgtagggaatgatttcagagagaccatactgtattatgaaatataatatagcaagaatatattttcacagattcatatgctgcttaacaccaaaattaaatttaccttactctgatgagctttcatacagtaatctttttatcaaagctagtaagaggaagcagtgatgaagataatttttttaaaattgtatttgaaatgggctt

SEQ ID NO: 23862 - DNA, 1069 bp, Homo sapiens
tcagatttttttttttttaatatttgcattatgtttactagttgggcatccctaatgtggaaattcgaaatgttccagtgaacatttcctttgagcattatgtaggcactcaaaaagtttcagagtttggaccattttgaatttcagatttttggatttagggatgctcaacctgtactcacatagcttcttgaaaggaaatttaagaaaagtacactcacctatattaagaacttatttttctagcaagtaatttatcacctctcccaatcttagcttctgaaatgtaaactaagaaagttatgaagaacattatccaggtgttaaatcttaaaagtagatccaagagtggaattagagaaatacagtggcctttcacaataaaagactagattttaagagtctcttaattatttggtgagagacacaggacagtacaatctgtgaatttctattcttttgaactatggagattttatcatgactggacaatgagaagaaatgttatagctgtagcttgatggttttgcttttataaaattcttctggtattgaagagaaaaagattattaatgggtaaagtaagaaaaattaactccattcctactgggtgacttttattatcagatagcaatctgataactgattattattagtttggtgacaataattatttttggatgcttggttgctaataatttgcctgatgcctagaaaattctgatttggggtctgtattctagtgggcatatagcccaaattagcaatcagattcttctactaaaattatctgatcaagctttcagataattcatgcatttacatagaatacatatcagtggtttaaacagaatttcacagacgctttcccattgaagctgattgtttggcaaaatggtgagtcatgctttactggccaactcacacaccagttgttgatataatcagttacctgagccaagatcaaagcagcagaatagaagatagtaccttggctctgatacctttctgtcctttctaaaaaaaaaaaaaattgggatgtaaatttccatccctctcctatgtgctt

SEQ ID NO: 23863 - DNA, 1036 bp, Homo sapiens
tttacccactatgcttcaaacaattatgatgcaaactgtttaatagtaagtcttaattcatttcagatttcagagaatgtcttaagaattttggggatattaatgtagcactacatccttatcaaagaatattgagaattctgctttaaactaccagttcatctttgagactgtttaaacctgcttttctttatctgcaaaagaagtctcaattttaagccatgtttatgggaaatgactataccttaaactgtgtagaagttcttttagggggagacaggaaagggaaagtttgtgttggaagaatagcatttctttgattacatatttttgtagctgacactacatttacattgtttaaattgaacataaaattgtacctgatcaaaaacatgtctagctatggagtatgagactatttaaataactcagtattatacattaggatttttcttttatttaattggagaggagtatgatcagaattagttgtaactgttgtgctatgttagaccttaaataactggattccatttgtggaatgctgtgcttattttaaaaattctaatattaaaagaaaaatcacagatctttgaggttagctaattgagttgcttgtagaggaaggactacctgggctggctagagacagagggttgtttatcctctttaacatttcccatgaaagactctgcacaaatctctttcgattgtttatttacctttttaaccatttgaaatttaattttttcctgagagtttctttgtcttggtctttagaaggattgaagagcggccagtcagaattcccatttttaaagaaagggtctctgtatatgtaaaaacaaacatttgatcaccttcattctccagatggcataattccaactatattatctcaatattcctaaattataataccgttaactgttgttttgctgtactttttcttcccagtttttaaagggtggaggaggtagccagacacggagccctttgagttttttttttttctctgatgcttgaaatcctggga

SEQ ID NO: 23864 - DNA, 1058 bp, Homo sapiens
tcatgccgccaccgctgatctgacactgacaggaggcatagctcaggttggtaatgctcactcgcccacccagtgctcacttcctgctgtgcagctgacccacactagttggggggtgagggcccctgtaagaaataagggagataacaataaaaaactaaagacatactgggaacgataagtttttggatttttttggttttatatttgagtggaggaaagctgattagctggcatccagcaaagagtctagtctgtgaagcgtgcccttgagcaggctggctagggtcatcaaacaacaactttagttacttatagattctgatgacctggagattttaaccgtggagtatttgtgccaggctgatactataatgttgcattaggcctataccatttcctcctcagaatttctcagcacttactcatggttgattatttccttgagcgtttttataatttttgatgacgagttcatttttagtggggctttgtctatgggagtcctatgtggcctgggctgaggctatgtttcctcaaagagctttgatgtttgcttctatctgcctgctatacatttttagttatttttttaacttgtgggttcctggtttatataggtagtattagactaaactccagacctgagtgcgggcagagtgtaattataaatgctcagggaaaatttttttttccccagtcaagggggcaaggccaagatatacagctttactgtgtttctctgtgcatctctgcaaattttgtttctggttcatatgtacttcaatccctgaaggtgtgagaggtagaaaccactcagagtttctcccattctctcactcaacaacaaaaaacacggaagacatctctaccaaaatgtggggaggggcggggggctcttcccacactggaggaagcacatcaattctgcagcagacaccagctgggaggcctccaattcaattcaattctgatgccatctacctagagataacctcagaaaccgcaggttgagggttcagttttacaaaacagccctctctttcccaccagtcgca

SEQ ID NO: 23865 - DNA, 1041 bp, Homo sapiens
agactttggactggaattttgaattaatgctgaaatgagttaaggctttgggggactgttgggaatgcatgattggttttgaaatgtgaggacatgagatttgggaggggtcatggcagaatgatatggtttggctatgtccccacctaaatcccatcttgaattcccatgtattgtgggagggacctggtgggagatagttgaatcatggggatggatctttcccatgctgttgtgatagtgaataagcctcatgagatctgatggttttaaaaacggaagtctacctgcacaagctctttctttgcctgctgccatccatgtaagacatgacttgttcctccttgccttctgccatgattgtgagacctccccagccatgtggaactataagtccagtaagcctctttttcttcccagtctcgggtatgtctttatcagcagcatgaagtccagctaatacagtgcttgaacatgtaatatctcaaatctgtaatgtactttttttttttttaaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggtaattatcttcctttttaatttacttatttttttaagagtagaaaaataaaaatgtgaagaatttaattgtgttttagtattttaagtagattgtgatagtagaatggtttgagacactttaatagcaattagcatgtggtttttaaaaagttgcagtttggctggtcgcagtggctcatgcttgtaatcccagtattttgggaggctgaggcaggtaggttgcctgagcccaggagttcaagaccagcctgcccaacgtggtaaagccccatctctactgaagataaaaaaatttaaaaaaattagctggggctattggcacacacctgtggtcccagctaatcaagaggatgaggttagaggatca

SEQ ID NO: 23866 - DNA, 1050 bp, Homo sapiens
ttttgttgcccaggctggagtacaatggcgcgatcttggctcaccacatcctctgcctcccaggttcaagtgatcctcctgccttggcctcctgagtagctgggattacaggcatgtgccaccacgcctggctcatcttttttgtatttttagtagagatggggtttctctatgttggtcaggctggtctcaaactcctgaacctcaggtgatccgcccgcctcgggcttccaaagcgctgagattgcaggcatgagccactgtgtctggcctatttttatagtttatgtacttggaattatataatatattctgcctagcttctttcattcaatatttgtaagatttatccatattattgagtgtagttgtggatttttgcatttatatttcatagcacgagcatgtcagaatttatccattttacttcccttctgcccgccactgctactctccccattttacctttttttttgtttttttgagatggagtctcagaatttcgctctgtcgcccaggctggagtgctgtggcacggtctcagctcactgcaacttctgcctctgggttcagctgcacgccaccatgcctggctaatttttgtattttcagtagaggggattttgctatgttggccaggctggtcttgaactcctgacctcaggtgatccacccaccttggcctgccagagtgctgtgattacaggcgtgaaccaccgtgcccgacccccattctaattttgatggacatttgggtaattttcatttttggctgttataaatactgctgcaattacagttaattttcacagtttttttttttttttttttttttttttttttttgaggtgagtttcgctcttgttgctcaggctggagtgcagtggtgcgatctcagcccactgcaaccttcaccttctggattcaagcaattctcctttctcatctcctaagtagctggggtttacaggcatgtgccaccatgcccagctaatttttgtattttaatttcacagttctggaggctgggaagttcagaattaaggcact

SEQ ID NO: 23867 - DNA, 1029 bp, Homo sapiens
acgttgaaataccacagactaggaagaaaaagatccactccttatacaggatttgtttgtttcttcttttttcttcatttttgtagagatgaggtctcactatgttgcccaggctggtctctcttttttttttgagcccgagtttcactcttgacgcccaggctggagtgcagtggtgtgattttggctcaccgcaacctctgcctcccgggttcaagcgattctcctgcctcagccttcctgagtagctgggattacaggcatgcgccaccacgtccggctaattttgtatttttagtagagatgggtttctccatgtgggtcaggctgctctcgaactcccggcctcggatgatccacttgcctcggcctcccacagtgctgggattacaggcgtgagccactgagcccagccatgctggtctcaagcaatccacacccacctcagcttccaaaagtgctggcattacaggtgtgagcccccgtgcccagcctgtttcttataattattcctctttctcaactctgtctgctgtggtacctcatgcttcctagtttaagccttcttgggagttctcaggagaaatctgttatctcccttactaagcatttgggattgatgttccttccaggttactataaaaccaagttttttttggttcttttttttttttcttttaaaagaaatgagattttgtcatggttagcctggtttcaaactcccaagctcaagtaatccaccttcctttgcctcccaaagtgctaggattacaggcatgaaccactacacccgatctgtactgttcctctttccattcactaaaacctacttgcaactatgagcatatgttattgccatctagaaatgagtttctagggacttgttcctttttgtactttatttaaacagtcgaattagaaattattattatcattatttattttttgagatggagtcttgctctgttgcccaggttggagtgcagtggcgtgatctcggctcactgcaacctccacctcctgggttta

SEQ ID NO: 23868 - DNA, 1039 bp, Homo sapiens
ttgagtaggattgataagtatactatgttatgccaacagtaactgtgatgcttctaaaattgtgatttttaaattggcattgtcacagaaacagcagagtagttgtttttttctttaagcttcttttagccagaaacataaactgaaactgtaattattactgcaatcgtatgttgaatagacttgtgaaactagcaatttattaggcttttaatgatatctggaccaaaggctgagggagctgtgctgtgtgtatgttgctttgtgctttgttttttagaagcttgtcgtttctttgccattttacttctttctttttttttgagacggagtcttgctctgtcccccaggctggagtgcagtggcgcagtttccgctcactgcaagctccgcctcctgggttcactccattctcctgcttcagcctcccaagtagctgggactacaggcgcccaccaccacgcccggctaattttctgtattttttagtagagatggggtttcaccatgttacccaggatggtcttgatcttctgaccttgtgatccgcccgcctcggcctcccaaagtgctgggattacaggcttgagccaccacgcctggcccattacccattacttgtttcttaatgttacattctctttccctctttttttttttttgttttttgagatggagtttcgctcttgttgcccaggctggagtgcaacggtgccattttggcccactgcaacctctgcctcccaggttcaaatgattctccagcctcagcctcccaagtagctaggattacaggcacctgccaccacgcccagctaatttttgtatttttagtagagatggggctttgccatgttggccaggctggtcttgaactgctgacctcaggtgatctgtctgcctcagcctcccaaagtgctgggattacaggtgtgagccactgcacccagtccttaatgctactttataggtgaaaattgtgaaataacttaaatttcattttaattaaagttaatttttgggaaattaacgaaaggtt

SEQ ID NO: 23869 - DNA, 1089 bp, Homo sapiens
ctgcccaccgtggcttcccaaaatgctgggattataggcgtgagccaccgcacctagcctagattcaggctgcttctttttttttttttttttgagacagagtcttgctcttgttgcccaggctggagtgccatggcatgatctcagtgcaccacaatctctgcttcccaggtttaagcgattctcctgcctcagcctcccaagtagatgggatcacaggcatgagccaccatgcctggctaattttgtattttttgtacagacggggtttctccatgttggtcaggccagtctcgaactccctacctcaggtgatctgcctgcctcggcctctcaaagtgctgggattacaggtgtgagccactgcgcccagcagattcaagctttttaaatggaattttgagctgatttagttgagacttacgtgcttagttgataaattttaattttatactaaaatattttacattaattcaagttaatttatttcagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggtaacaagtgattttgtttttttgttttccttcaactcatacaatatatacttggcaatgtgctgtcctcataaagttggtggtggtgactcactcttaggacacattcagatttcttttttttttttttttgagaaggagtcttgctccgttgccaaggctagagtgcagtggcacaatctcagctcactgcaacctctgcctcctgggttcaagcgattctcctgcctcagcttcctgagtggctgggattacaggcatgtgccaccatgcccggctaatttttgtacttttagttttaccatgttggccaggttcgtctggaactcccaatctcaggtgacccacctgcctcggcctcccaaagtgctgggagtacaggcgtgagccacagagc

SEQ ID NO: 23870 - DNA, 1034 bp, Homo sapiens
ccaaaacaagtgccatctccagtaatttaagagtctatggtgatcaagagtagttctcttcctgctagaagaggggtgggagagaacaccttcacaaagggaaatttatattctgccttcatgcagaaagggggcgagcagagagttcctacgtatactgtttcttcattatcttcctctcaaaagaatacttaggctaaagtggcatgatttggggtgacattctgatcctcttcagtgacaatccttgatatttttccttctttctctccaggtaaacagtgttaacatcctggtatgcttcccccaattccattatactaactctgtattgtgggttaaagattttttactttgatcagcagtatttgaaacatacctgttatactagatgtactctgactgtaaaatagtggtcagtgttacttctttaatgatgctgtgggattaaaggattttattataaatgctgggaagagcctggatttgaggaaggtaagcagtgcagttaggtggatgtagactagaagaggtcatttgttctcatttcattgttgcccctatgacatgcccgtttctttcttttttttctttttttttttgagacggcgtcttgctctgtcgcccaggctggagtgcagtggcgcaatctcacctcactgcaagctctgccccccgggttcatgccattcttctgcgtcagcctcccgagtagctggaactacaggcgcctgccaccatgcccagctaattttttgtattttcagtagacacggggtttcaccatgttggccagggtggtctcaatctcctcacctcatgatctgcccgcctcggcctcccaaagtgctgggattacaggcgtaagccactgcacccagcctacgtgcccatttcttaaagtagaaaatttagtagttgatgatgtcagggaagaaaagctttttctctgccttacgttaagtagttgggggcaaattaaattaataaaagacagattagtgagagaaaaggctgtaagaatttggacttta

SEQ ID NO: 23871 - DNA, 1031 bp, Homo sapiens
catagtgagaccctcgtctctaaaaatatgaaaaataaaaaaaaaattttttaaatgtgtgatatgtttagatggaaatgaaacaatttgtcactgtctaacatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttgagatgcattgtagttcttcgcagtgtgacttcaaatattttggaagaaacaaatagctcagagacctcgtaaaatatcttaaactggagggctccatggagatcattgcgagtgactcccccagaatgtccatctgttgacaggagccaggctggctgcatacgaattagctaaggagcttattatatatccagagtcctaccgtgagcctccatcccgtctgccattctcccatccctggtctatgataagacttagaaatctggattttaacaaaacgtttcagattgagaaccttgatttagtctacttctcctattttacaataaagagatgaagcggttaagaattagctaatcctacgcaaagtgagggaaaaaggacagtctttttaataaatgcggcgggctggtggggtatccata

SEQ ID NO: 23872 - DNA, 1033 bp, Homo sapiens
ggcagggcgggcccctcaccgccagcgtgccagccccgcccctacccaccagtgtgccagccccgcccttccccacgtcgccgcgcgcccgggggcggggcctggcgcgcaccgcccgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttgggggggtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccaggtgggggtgctgggctaaggaaggggcgacgcgcgcagctccgggtggggagggggcctgggaggtgggagcactgggggtggggcgagaaggggaaggcgcccggcccacttggtgggcggggcggggggcggggtggcgggaaggaggaatgcctgcgggaggccgaacggggagagtccggtggtgtggggtgcgaaaggaggttcctcg

SEQ ID NO: 23873 - DNA, 1033 bp, Homo sapiens
tactgtattttacacatgacaaagttctaaggtaacagcccttttctaagactaaagttacagtcctccctttgtatctgagggggattggttgcaggacccccctgtgaatacccaaatccttggatgtccaagtcccttatgagatgtagtatttgcatataacctatacacatcttcccctgtactttatctctagattacgtacaatacctaatagaatgtaaatgctttgaaattagttgttcagctgtattttaaattttgtattttttttcctttttttttgagacagagtcttgctctgttgcccaggctggagtacagtacagtgatcacagctcactgcacctttaacctcccaggctcaagctgtcctgcctcggcctccccaagtgttgggattacaggtgtgagccatcatacctggtcactgttttttattggttttaaatttttgatttaaaatttttaatctaggttggttgaatctggactggaacccaaggatatgtttgttgagcatactgtatttactttggaatacaactagaatgcttaacttgtatgttaaaaatactttatttggccaggcgcggtggctcacgcctgtaatcccagcactttgagaggccaaggcgggtgaatcatttgaggtcaggagtttaagacgagcctggccaacatggcaaaaccctgactctacaaaaaaaaggtaaaaataagccaggtgtgatggcgtgtgcctgtagtcttggctattcaggaggctgagacacaagaatcgcttgaaccggggaggcacgttacgccctcagttgttgacttgagtttttccgtagtttgtagggggagggtaatagagtattaggtagcttttggaatacataggagtgtaactggaaaaagattccaagcaagtctaatgaattagataatttacctaattagtaaattatgtaatcagtatgctttataataatattgtgagttagatcctgtttctgatatgtacataccatattgtataggt

SEQ ID NO: 23874 - DNA, 2025 bp, Homo sapiens
atattaagagaatttacagtagtacagatggggttatcccatccacaacttatgatggggttacataaactaaaaacgtgtttaatacacctaccccaccgaatattgtagcttgggcgtagcctaacctatctcagacgtgctcagaacacttaaatgttagcctaaagttgggcaagatcatctaacacaaagcctattttataataaggaattgcctatctcatgtaattcatcgaatactgtactaaaaatgaaaaacagtggctgcacgggtaccattataaagtcaaaaaatcataagttgaactgtcttacattatggttttccaaattttgatttgtttttaaatactctttccttgcctggcaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactaga

SEQ ID NO: 23875 - DNA, 1046 bp, Homo sapiens
tgcacagttcacaatagggtttgagctcctgtgagaatctaatgcatgggctgatcggacaggaggcagagctcaggtggtaatgcttctcaacttccactctcctcctgctctgtgacctgtttcctaagaggccatggacctgtaccggtctccagcttgggggttggggacccctaaactaaaagatttgggaaatttttatggaaaagtttgccattgaagtgtgctttgaaaaaagagaacaggttttagaagggtaacatatgccaaagggcaatagtatattctgctgggagtttggggcagtaggcatattctctgttggtgaggaatgtacgagagcagggtggaaaagcagagtgatccagaatagaagtgtgatgaatatcatgcttggacttcagttttgggcttcagttgtttggacttcagttttgagagcaaaccagtgagagtttttaagccaggagcatgatggagtttctctgtatttgacttgtgacagtgtgaatgatagggcaatatattaccttaaacaatatctgaattcatttgccaaaggaatgttacagttagtagtaccatgcaaacagagatagtttcagtgaagatgtgggatttgaacactttgtaatcattgccctccttatgtctaaatccactgacttcttttctgtcttactcaacctaaaactgcattatatgacatgattagctctgggaattcatcttttctttgatttgtataacactgtgcttaattctttgtttacctgtgtggactctccatctttttcttttgccacttgccatttaaactttagtgttcactattttgtcttttttgttgatttagtattttcttaatctcattaattcccatggcttaatatgtcgtctgtgatcttatgacttctagatctttctcctaaagcccagacgtaaatttgcaactaattattagatctggaggtatctcaaattcagtgtgtccgaaattggactttattcctctctcttctccaaggatctatttgggtctc

SEQ ID NO: 23876 - DNA, 1044 bp, Homo sapiens
aattttaccagttttgcagagggcaagcaggtccacagagctcctcacgctgacatggcagaagcagaactctgtgatatttgggtaagagtgttttagcgatgttcagcaaataatgtgtagggaatgaaaaatgcattatataataacaaggtaaacattcacaaagactttcgttttacaaagaatcatgacagacttaatcctgcttaacaactgaattttgtttctcaaccattaaaaaatatttgtggacataggagatgcaaatcatttagatgtgcttatgtgtatcaccattatgtctgaatgtatctgccacgattttaagaggcattatttctagcacattacaaccaatcttcattctctatcttcccaaaagtagagggatacaatgggcagtccatttttcaggaaaatgcttagatttgtgattttgatttcctaggtacagagccagatggactccttcggacaaactacagttctgtgttaacaaatgttggtgctgctctgcatggatttcatgacgttatgaaaggtaggccttgaaaaagaacgtaagcttaaaacctttgccccactttcttcgatctgcctgaataagatttaaacaaacactgccaagggtaatagaccccagataaaggcttattagcatttggcttatgttgagtgcacagctcactgccttctgcttttcccatctgttttatttctggaggtaaacaaagtgctgaagagaaatccttgtgtacagtccttgtgtacagtactttagccagaaatacgttacactgactttaggcaggtgtgtgaattgtacaaaaccagacatgctattcagaggccttttgcaaaatacgttgcgcttcttagagcccaagcacaaaggaattgaggaaaccaaggcttcaagtccccagaaggaatacactaactttccaccatcctgtgcattttaatattttaaatgccttttaaagtcctgtcttgttgggcatagccttaagaaatgaaagtctggttttgcattttggt

SEQ ID NO: 23877 - DNA, 1050 bp, Homo sapiens
ctatatttgtaatttttaaattgagatttatagaattaaatttaaatggaagttacatattcaagatactatgttatatcttctgttagaatatgaaatattcaaagttaaaatatggaatctagaaatccgaacatggatattttgagaacagtggcagaaatcaatgaggtaaagagctcatgaaagtcacctacagaataaatgagtatcagtcttggttttcaggaagaatagaaattgtctagaaaaggacatgtcagaaatttgttctgactatttatactggtgtcctctttttattataaaccattgcctaggtattctcaaataaataaatgtggactttggggcaggtgttgaaatttcatttccatttccattctcaacatctttaaactttgctgcaaaaactattagatatatattttagatatattgttggaaaacaaaatctatttccttgtcatactttgtttagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaaggtttgttagctgctgttaatatttaaatcagaggaaacatcaggagtcattctagagaatggcaagagtttttctgcagtttatattgttgactttttatacgatattggggtacaggttgttggtgggtgttgggggagggctgtggggaagaggaggtgacaggacccagactttacctgagaagcagcgttgcctatattcgtaggccatgttggactcatgtcccaagtgcctgatagagcgcctggggtgaggtagccagccaaacagtaaatattgaacttcagagactcttaaacttgtagaaacagaaaaaaaagaaatatgtgtatgacttttttctgaataagaatatgcagttgttgcaaaaaaaaagaaaaaaaaaagagagaagatactgcagtatattaaga

SEQ ID NO: 23878 - DNA, 1050 bp, Homo sapiens
gcttactgcttgccttactgaggtgctggaattggtaacactggcatatatatttctttataaattaataattttaaaacgtggaatgcttcatgaattttcaggtcatttttgagcagggaccatgctaatttctgtatcgttccaattttagtacatgtgctgctgaagaagcacaatgctggtatatttgagttgttaatgtcagttgctgaaagttttggattatctttttatttgaacattttcaatggaaaacgctattcttacatatgtaagtgaaaaaaatttctagggagggacacgaaaaatctttagtactgaacactattgggccatgagtgataatgaccttagttgggtttggtgactttagaagttgctatttaaatcaactagttagtgtaggggtggaaaggacctgataccttttctctccatcatgagggtcacagccagcactcctataacaaaagacaggttaactgctaacagcagatttctgccgaaaataacctggagtcttgccttgcacacagtgcacaatagaaataaaaagagatggagttttctgctttccttgatgtttctactttcagcctttctttttacccccatgccctttaagtgaccttaagggaactaattgtgtggctgtgtatgtgtgtgtgtctttgtgtcttttctgtcttcttcctcttgggtgttgggagcaagtatgtgcccatttcagtgttaattgattaacaaaggaagctcatcctacagggagattactttggttcagtcactttgaggcagaaaaagtaacctcagatagaaacttttcttttttttttttttttttttttgagacggagtctcgctctgtggcccaggctggagtgcagtggtgcgatctccactcactgcaagctccgcttcccgggttcacgccattctcctgcctcaggcttccaagtagctgggactacaggcgcctgccaccatgcccggctaattttttgtatttttagtagagacggggtttcactttgttagccaggatgg

SEQ ID NO: 23879 - DNA, 1103 bp, Homo sapiens
aaccatttggaaataaagattttattttatttgaattctactggaaataaaagagtttatgttaaaaaggatgtaattcacttctctccactgatgcagtttgacagttccccattggtatgaatcagttaggttttattgtggtctcaaaacatcattaaggcagggcacaacatcattaaggcagggcacggggttcatgcctataatcccagcattttgggaggccggggcgggcagatcacttgaggtcaggagttcgagaccagcctggccaacctgatgaaaccccgtctctattaaaaatacaaaagctagctgggccaggtggcgggaacctgtaattcccagctacttgggaggttgaggcggaagaatcgtttgaacctgggaggcggaggttgcagtgagccgagattacaccactgcactccatcctgggcgacacagcaagactctgtctaaataaataaataaataaataaataaataaataaataaataattgataggcaagtgttgtgactgtgacttccattcaaaaagtaagtccaaaaaaaaaaaaaaacaacaaaagtaagtccataaattctgagcttgtttggccctgttgcttagaaaaacaatgtactgtgctcagataaaaatcttcagtctcttcctcttcctgagaatttttaatagtgcatttaatatcctgtaagtcaaccttatactgtttacagaaaagttgcctttctgccttgtccagcttttgcactatctcatgaaatattgttagactggatggtttgccacgggtacaagagtctgcccagcagcccgaggagaggctggggttgtaatgaaggccacgggggcctggacctaaggagcaggtggtctggatggtgagatgaaggctacatccccagacagccacagaaagcagccactgatcacctggacaggtcagatgagttggaaatatcaatacatgaagtgtgggaccagtggagagcaaggaaggcagaggtggttaagaagcaaaatgatacaaataaataaaaaaggaaaaggccaggcacagtggctcatgcctgtgaagtgctaggtgtggtgat

SEQ ID NO: 23880 - DNA, 1064 bp, Homo sapiens
agggcatggtgcagctgtgggcctggcttggggcaggacatttctgggattacagggccctgccccaagcttctccgttgagggggtagggagggcaatgcagagagtgagagggtgccagggcaggctataagctaatttgcctcttgagaagtagggtaataataaggttggagcagagaggaaatctttgtcctaaggcagtgcttctcaaacttttgtgggcccaggaatcaccttgttaaaatgtggattttgactgagcaagtgggatctggaatactgtgtttctaacaagtgctgatgtgacgccaatgcatctggcccaaggaatacgcttagaatagcaggatcccagaatgcatctctatttttctatatgacttttagatcagttgtgtatttagagaacataaagtttttaaaaagctctttaaaattttatccttttcaagattgtctcggaaaactttgcattatttgaaaagatacttcgaaaatggaaactgaatgaatagcactggagtgcagtggcgaggtctcagctcactgcaacctctacctcccaggctcaagccatcctcccacctcagcctcccaagtagctgggaccacagcacgtgccatcacacctggttaattttttgtatttttggtagagatgaggttttgccgtgttgctcaggctggtctcgaacttctcagctcaggcaacccacccgccttggccttccgagtgctgggattataggtataagctacctaccgcacctggcaagaacatataaactagtctactatgttctaattataaaacttttttttaaattttttttccttcctgggaatttgagggatcaggattgaccttttttactggggaaatcacctgtgatttctggaaaggtggggagggctgctggtcccttaatgtcccttctaaccagcttgtcaatgcttagtattcctttgacagtgggcaggtctttcattttgcaacaaaggtttgcctgaggcactagctcacagacttcattcatactaaggtgtgaatgacagcagag

SEQ ID NO: 23881 - DNA, 1064 bp, Homo sapiens; identical to SEQ ID NO: 23880

SEQ ID NO: 23882 - DNA, 1064 bp, Homo sapiens; identical to SEQ ID NO: 23880

SEQ ID NO: 23883 - DNA, 1064 bp, Homo sapiens; identical to SEQ ID NO: 23880

SEQ ID NO: 23884 - DNA, 1035 bp, Homo sapiens
aagccagaaaacttgaaaggaaaaaggcttttaccatttttaaagaaaagcaggtagaaaggttttgtttctgacattttttgtaccactaagtcttcaatttgggtttagttcttcaattttcatcgtaaaatttccccaaataattttttcttataaagtgtgagtatcaaatcagatcatgtgtagtataatttttaactccgaatgtgtaacattcacagtccctttattagcaaaattatagtaattaaataatactggctttataattgaatagcactttgcaaaataatatgtctggctcatctatattgctatagaatactactgccccagtgctgtatgcatatgaactggttaatcctcacaacagcccttataaggttcaggttatcctcattatccacatttttagatgaagaaactgaggctcagagagataagcaatttgtaaccctagccttaaccactttgccataacaagacagaagaatgcctgcagtaagtgtaaatgaacttactgtatcctcactgcagacagaggactaaaaagagtaatggggtttgcaatctttctgggtgtgtgtgtatgagaatgaagttatcacttgcctccagtgatcaggttgttaagagcacctcagaggccactgttgtcctacccttcctgtaagtggtagagatggctaatgagcatctgttggttaactgattgatgatttctcaaggctttttacagccttagaattctattagtcactctacaagaaacaggttgtatggaacgaaaggtaatttatcttttaagaattaagtgaaatcctttaaactcttgtttttgtgcctaaagctatattctgatggaaatgctctttctctagctatgtcagtggtacagtaatttaatctggttcttgaaattactctttatctcatacatttatttaagtaaagatagccacattagatatggagatgctatgaacaatgcaacagaatcatggaatgtttgtaaagctgctgcagtgatta

SEQ ID NO: 23885 - DNA, 1035 bp, Homo sapiens; identical to SEQ ID NO: 23884

SEQ ID NO: 23886 - DNA, 1035 bp, Homo sapiens; identical to SEQ ID NO: 23884

SEQ ID NO: 23887 - DNA, 1035 bp, Homo sapiens; identical to SEQ ID NO: 23884

SEQ ID NO: 23888 - DNA, 1021 bp, Homo sapiens
gaattaaactgacataagacagattaacaggagaaaagcataccaattttattaatatttttacacggacgtggcagtcttcaaaagggaaatgaagaccctaggaagacagtaggccgtgaagcttatatacattttcacgcaaagaacaataaattatggggatgtgacaagacaaaggggcttgggcttggggcattaaattgtaggacagtgcctaggaaatacatgggggaaattaacgaaagacagggtcgttttggtagtttgttgtggaagtccatttcggcatcaactcctagtctctggtgataagaatgttctcttcctagtacagggaaggcacctttttcatggaaaattttatgatctgtttttaggtagaaatgaggaggtcagagagcctatgttagtttgttttgcatcgctgtaaaggaatacctgagactcagtaatttataaagaaaagaggtttaattggctcacagtttggcaagctgctcaagcatggaaccagcatttgcttggcttctggcgaggcctcaggaagtttttactcatggcagaaggtgaagcgggagcaggcatgtcacatggtgagaaagaagcaggagcgagaggaggagcttccaggctcagctctgcatgaatgaacagagtgagaactcactcattatcgcagggacagcatgaagacattcatgagggatctgcccccatgacccaaacacctcccactaggctcatctctaacactggaggtcacaatgcaacataaaatttggaggggaaacacatccataccatatcagagcccttctgcatgagctgtttctcaagtgccttcagattaaaataatcaatatgccaaaacagcatattttgggatggcacgaatcccttcagccccctttttttttgggaatagagtcttgctcttgttgcccaggctggagtgcagtggtgccatctcagttcactgcaacctccacctcccaggttcaagtgattcttgtgcctc

SEQ ID NO: 23889 - DNA, 1047 bp, Homo sapiens
acaaatttttaatgcagctggtccaagtggaagaaatacagaatatctttttgaacttgcaaattctattaggaaccttgtgccagaagaagcagatgagcatcttttcgctttggaaaaattagtaaaggaacgtttagaagggaaacagaacctcaattgcatataatttagtcttcagagaattaacttcagtgcacaatgacaatatgatttggaaatacgtttacttaaagatcttatttttaatgtagtgaggatattatttaaacttttattttaactggaaatgtcctgaaacacatatttaaaatattgggatacagtgaaagaaaaattcaaattttaataacataaagatttcctaactttatgttattgaacacttactcactagaagtgagttctttagaaaaatacagtgaaggactcagttcagtcttgtttttatcagagtgataatcatcctgtttcacatcccaatactattttgaaattctaaacaattaaaccaaaattccaataaatataaggttatgccttcaatatattcctatacaattctgtaaccatggtttaaaatacacaagcttaaaataacatgcttagaaatacacaataatatgaacagtatttcagccttaattgtgaatttccttgttattcaagtattaaatgaaatcttttgagtttttagccaaaaattggcatttttaaaatacgaaaatttccttggaattataatgtactgtacctcttcttttttaaataaaggcattttactatatggaaaataactcactaaagcataaattacattatacaaatcatgatcactaatgatgtagtctgtcattcactttgtattaatcttataccaaaactgaaaaagatgggctgatactacaaattaatggcacatataatgaaaatttagtttttaaaacagcttttggaattctttgtctgtcactatctcaatttgtgtgtgtgtgtgtgtatatacatatatatacatataaaattttttttttctttgcagcctgc

SEQ ID NO: 23890 - DNA, 1055 bp, Homo sapiens
tcacctggccaaaaaatttgtgtatttttgatgtgtacattaactagagttaataattatgatattctttgcttattgatgtttagcactcagttttgtttttgtgttaatattttccttctgaagtatcacctctgtcgttatgtttaattattcattactttatagagttcagagatttcaccaaattaaaccacaaatcagtctaattttctgtctacttctgttgttgatgtagaatatattttactcagattttcccaagcactactatttgaccaactccatggtttatagcatgtcatatacattgacaggttctaccaacaagtgtattttatagcctctaccagaatagaagttctctcatcctctaaccaacctaattcctccagacccacgtcaaacattaggagttcctctcatgccaagatattttttaagttccttaacttttaaagtaccccagcacctctgattagtttcactatattaaaatttgactttatgtcaaatctctaataaaatttgactttgtcagatctctaataaaatttgactttgtgtcaaatcgctaatttcctcttccactgaaaataccttgttatgtaaagtaagttttttatactatctaattctgtacattcagaatttattatattttgttttcttaaagtaaaacctgttttatacaatcagaatcctgattttagtggatccgaatttttagaaaaattataaaagataaactttttctccgtaattcctgttaccaaaaagtaaagtttgctaaaaatatattttgtggtcccaataagtgactcactatttcagcagagttttcagatagaattgctatttggcttattttattgggaaagcagcctttcctaaactaatgaaagactattatttgcatcaagaattgtcttcccttttttgctgtggttccaaacaagcagtttctttttacatttgaagcattttggagaccattttgaaaggaattacaaatgttatgtctcatagcaaatcgttggcacaattgaataaat

SEQ ID NO: 23891 - DNA, 1069 bp, Homo sapiens
aatgaattttctactctactatataaactaccatcctatttttattagaataattttccttaaaaatgaaaatggatgttctgtccagaagaagtagtaataaagggtcatgcttctattcttgccacctcttccccttatctcagctgcaggtttcactatgcagcattattgtttttcttcattaaccttaatagaggtctcatgtattcccaggttattagtttagtctgttagaccttcactcctttgaagtaatggctatatttgcctcatttttaatacgcagcacctaaagtaatgccaaaatatagtaggctctgtgtgtggaaaaaggtatacaataaagttcagagacttttcaaaaaataagacagcatcttgacagtccttgttcttcctaatattgggaggaagagagaataaggtcattgctttctggagtaaccgtccagtgactcatacaagctgaagtagaagcaaaagaaccatagctggttaacggtaactgcagcaagtgaaaaaggggacatagtatccaccatatatttattggaaacccatatactgtctaatttttataaatcattcattcatttataatcggtgcactcactttttaaattcaggtctacattcatttctttgccagtcaatacccatttaaccaccagatcctaattttttaacctctttaataataattacccttttctctacatccaaccctgtcactcccttactttagattctcttcatctctcacctgggttactgtaactcctaacttgactctcttcctctagatttgtccctgctattccttcttccttgccactgctgaagtaatacttaaaaatatcatcacagcacatctttgcctaaatcctataaaatgatgtccaaacctctcagcatttagttttctaccatatagcacctgcttctctctttagatttaaatatcatacccccacatctttggttttacctcttcctcaagtctatatgcatatatacacacatagtcacagaacacacagataaacacataaatcacaaattatta

SEQ ID NO: 23892 - DNA, 1031 bp, Homo sapiens
tccagtcccagtaggaatattccaaacccagtcatttcttctcatcgttactctaacatgcagtggaaaggctatcaggccagcatgtgcctgctggcaccatcgactattgtgatctactgtgagccaatacttaaataagaagacatatctttcaataacaaaaagtcagattggtagacaattctttttttttttttttttttttttcacagacaaggattcccaggctcaagcaatcttcctgcctcggccttccaaagtgctaggattataggcatgagccaccatgccctgcctgacaaatcttgagtcagatattagtaaaacaaagaatatatttgcccagttcttttagggcatagtcctgctaaaatgcacctaatgtgtgtatttagggtacttatcataatggacatctgtaattgcttttggctgcccagcatctgaacccacttgctagattcgggacatctcccattatctaggtcttggtgggaagtaggctctgacctctaactttagaagcctaagggatgagattcaccctctactaactcccctgacagccttgtgacccagatttagccactatgtactttgtgtcttgagtaagcaatgccaagatgaagggatgataagtgatattggatctgtggtagctctagtattagcagtttggcattgaggctgtgtttattgtgagtagtggctgcctacagtggccattatgtcaaatactagagatgtcctatgttggtggtggcagcagcatctccaccagactgttcctgccactcctactcccttggtcccagccaattgtttgagaatgttttcatcatttctcatcacttctgtgagttacataaacccttttcttttcttttcttttttttttttttttgagatggagtcttgctctgttgcccaggctgagtgcaatggtgtgatctcggctcactgcaacctctacctcctgggttcaagcaattctcctgcctcagcctccggagtagctgggtctacag

SEQ ID NO: 23893 - DNA, 1039 bp, Homo sapiens
catcctgagcagaggcttggcattggcagagtttcctggaagggtttgtagagtggttgctttgtcttgatgtttgaatgtatgactttacatgtggaagtactattttgacgtggaaggattttactactgctaacatagacatgattagtggaaatcattcagtgtggattttgtcgaaataattttaagcttttctttttaatagcatattcttatagaacattttaaagcctaattttttttacgtgcaatgacatgatgctcctttaattatgttgcatcgtaactagtatcttcattataattgggctttatttaatggcagccgtagtttctttcactacattattggaaatgcaaaccattcttccagaaggaaggggctaactacccctgttagaagagtgaactttgtaggtctgtggaagtgagtaaagcatctcatgggtttttcttgtaaattttcagtctttgctttttctcagggcatcttttctttgcaaaagacctagtttagtactctgatttttccggtagcacttgtaattatatttaaatttttattgtgtgggaataacatcatctatttttttctactcagtggttaaaggaaattacaccaattagatatacctgtgtttctatttttaaacatctctggagaaggcattttcataatgtcctttgctatcatagtgaggttcacggaccttcaacattagaatcgcctggaagcttgttgcaaatgcagattcttaggccccactctgaactcagccaatcggaatcaacattttaacaagacctttaagtgagttgtatgcacattaaatgaagaaactctattctgttccttcagcaaagggacctcaatatcaaaagtttccttcttgaattttcctttcttttgctgaagtatcagcacatttttttccttgatggtggtgacaaaagtgaggctctcactgtaaattatttgtttaatacaaaattattttataaagctgttctttaattcttggtggaagagtcctat

SEQ ID NO: 23894 - DNA, 1051 bp, Homo sapiens
ccaaggacctttcggaggtcccttgcacccctgagagtcagtgactctctgttttcaccttggactgccgtgatgtctgactcatactgtagtcttcttcctaaaatcctcttctttttattttttatttttggcagtgtgttgaattctcctctagtttcattcagtgagtgctatttcttgcttcattataaaaggtggtgtgtcacaggtcctgtgtgatcacacaggctaagtgtaagctttgagaatgatctcttggaccctttttctcagatttcagtgttgtgcattattatctcatcgtggtggcttctttgtgatttagtttcccctcctcccttcaccataaaaaaagtcttatctcctgatgtatttttggctgcagaataactccagatggtacattttgtgtagggaaaaaaaataacagaatttttcacactcttctgtgaattattttttgactttcaattataatgaagttattaatcttacaaaggctcgctttgtaaagagactaatctgaataaacttgcttgtatacaataagtgccatggcaaaaattaagagtacagttattatcagagactaaaataacaatttaattttctagaaatagaaaattaagaaaaataacttttaatgctgggatttgacattaagaaatgaatgacaaaaatgggaccaaataaaatgctgtaattggccagacatggtagctcatgcctgtaatcccagcacttggggaggctgaggtggaaggatcacttgagctcaggagttcaagactagcctaggcaaaacctggtctgtatttaaaaaaaaaaaaaaaaaaaaaaaaccaggcatggtggtgtgtgcctacagtcccacctactcaggaggtagaggcaggaggatcacttgagcccaggaagttgaggctatagtgagccatgatcatgccactgtgctccaacctgggcaacagagtgagaccctgtctcaaaaaaaaaaaaaatagtaaatggtataactgaaagtaccttgaaaaaatatggcaatatg

SEQ ID NO: 23895 - DNA, 1045 bp, Homo sapiens
aaagtctccaaaaccatactcaaggattgaaggtcacattttctctttcgaccattctacacttaggtagaaaaaaatttcattaccaactagataataggatttgagctgttgtggttgacattcttgatgaaggactgatcagaaattcttggtcatcttatgtaagaataacttcttggagtaaatatgttcctgaagagctgccatttaaagtaaacttttgaatatcatatcttaaatgctttgtaatcataaacatttaaattctgtggttcaagtaatcatttttaagtaatttacttctaatttctctctcttttttttttggagacaaggctgtcacccaggctggagtgcagtggtgcaaacacacttcactgcagtctcaacctccttggctcaagcagtccttctgcctcagcctcttggtgtggctgggaccacagatgcatgctgccatacctagctaacttttcttttctttttattttttggtagagacgaggtctcgccgtgttgcccaggctggtcttgaacttctaggctcaggcagtcctccaccttgcctcccaaagtgctgggattacagtcatgagccactgcacccagtttgtttctctcttttttaaatccaaatttttctattaggctttgcaaataggcccttaaagaaataggcagcatggctggtaaacaaattttgttctttagatgtttccagagaaataatgtggtattttaagagcttttaacaagagacctcaagataattatttttaggatataccataatttaaaaaataacttctgaatatgagagtaatacattaaagaatattcctgtaatcctagagctaagccatgctataattctggtccagtttacggtttgcgctcacatatacactcacatttttataccctttgtttttatgggttgtattcatgctaaaaaattgttttgaaaacactttttatggctgtataaagtaggtgtaccctatttctaaagtaggtgtgccctattactggacatttagtt

SEQ ID NO: 23896 - DNA, 1076 bp, Homo sapiens
cctgtgccctttactaagctgctttcagggtttatgtatctaaggaaatagggtgaggtaaactacttgttactaattctcacccagttgacagatacttcctattattaggttatctgtgaattgtaaaaaactttttttttttttttttttttttgagacggagtcttgctctgtcgtccaggctggagtgcagtggtgcaatctcggctcactgcaagctccacctcctggcttcatgccattctgctgcctcagcctctcaagtagctgggactacaggcgcccgccaccaccccagctaattttttgtatttttcgtagagacggggtttcgccgtgttatccaggacggtctcgatctcctgacctcatgatctgcccgcctcggcctcccaaagtgctgagattacaggcatgagccaccgcgcccggcttaaaaaacatttttaaaataacttttactttacgtgtcttcatcttattcaccctcaggaattgcttttaattcaatgcagtataataagaaatatatttggtctttgttctgggttcctggcatagagctcctaaaaccaatggagtctgccgagtgatgggagtgtcttttgttacccataaggtgtcccttttctgacacctgagtttgtgctaattccatgactttgggtggggatagtctcccatccctagctagcctcaggatgatgctgtgcacccaagactgagcagttagagaattggaactttcagcatcatccactcatctgtggggggagttggtgtaggtagggtggggtgccctgagaggacatggaagccccacctcaccccagtaccttgccctgtgcacttttccatttggccgttcctgagttgtaacctttataataaattggtaaacataaaggggaaattgttttcctgagttctgtgagttgttctagcatattattgaacctgagggggttcttgggaacccctgaatttacagcctgcggcctgggacttggaactggcatctgatatgggggcagtcttgtgggaccaagccctttatcctatgggatttaaca

SEQ ID NO: 23897 - DNA, 2032 bp, Homo sapiens
acagtggctgctgtggacctggaggcattacttatatttccgatgggccatgcgcctcattcattggaaccctctgcttagtatctgctcctccttgactcagctcacatgtggctttggtatactgtcattccaaccccagctcttgcctatcctttgccttttgtcctcattgctaaatgactgaatatccttgtttcctgtagttcaaatgtctgtaaggttgggtacagagatggggttttgattgacccggaagatccttttataccagatcatggccaaccggatacttagagtggataccttcagaagaggtgtccccaaacattggtgaggagctggaagccatatgtacagaacacatcagctccatccatccatagctcagaggcatctgactggcagttggaggatactgttggcatgcctaatgcagaagaattgtggtggggtggaggaaggcattttatagtaggacttttggggaaagagactggagtatcttggatgatcaagggaagggctaaatagccaatctgaagaaagggtgaagggcccctaggacaacagaaattaaggcttttcatctctccatctcttgttgttagtgaccttgtgtaagtgggcttctgtctctgccccttgtaggtagtcttctagatgacaggaaacatggctgccatctgctcctgggcttcactctctaccacctttcattttttctggttccagttggaaatattaggggtgtttgggagaaaggctgtaatttaccaggctttactcaaatgtctagagcagtgaactggagtatggagtgtggagggacataagagcatggcagctctccctggaaccacatggaactgtttcccccaaaggggaaagtttgctgggaagatgacagtaagtaacaatgaatgtttacgacacattttcagatagactgatgttcttgattcagagataaagacattttataaaatgcaaggtgatgtttaccattggttggttacttaaaaaaaaggagcccaataatggacagtttcatttaagatttttgaataaacaaaattaacaaagagaaacaaacattagcgtttcagtctttagaatatgcctttaacatggtgtttcatttgcattgaagttattgtcttgtgaatatgtgtggttgataacttggaaacagtctatcccaagcttgcatctttggattctcaagaaccaagcatcactcttagagcatgacaggtgcttagtactagagtgccattctagattctttagcagtacagtgatataagtactctattaacactttgttccttactcacatgtaacctcttttggggaatagacaatgtgtataaaacaagcaatgaattaatatgaaagtgttgtgatacttcctgaaaacctgaatcttagccttttcatcctctggttgagaaatacatctgttttctacaattcttatttcttctgtatttttattagttaatcttcaagggaatttgcagagctctgaattttgacctctttgctgcaagcctgtgaattttcagaactctcagataatgacatcattgactgatgggtacctgttattgggtgaggctgataagaattttgccattcaggtttaaatttctgcagacgccttagactttttgaacatgtatgtgaagtcgccttattagtcacaagattgtgtctttaggcatcctaagaaacagatggactgaagtcggagatgccgggccatttgcgggttctcagcccttccctgtgttacatgtttacctattggttcactctaagtttgcaggaaacccaagctctccccactgcctccactctgagctccagccctggccaggagccctcttgcctgtatggttcacagtaacctttcctcttcaagaaacttccttggcccttgctattctgtaccccatgttctctgtgtcttattagtgtcatgtgtgtacttaggtgggtgtatccatagtctccctccagctga

SEQ ID NO: 23898 - DNA, 1049 bp, Homo sapiens
agcaccacctgtttggcaaagccagggcctctggaccggggcattcttttgtctgtgcagggaagctttgcatgtgtagataacagacacggtaagaatgcagggataaggtttggctggggtagaagattcaataaactacattcattccccaggaccttgggtgcttgtttccagtgtaacttgccgtttttctcctcagcagtgatctcaggtgttttgtattcaggtctgatatgaccagttaggcaagaaacaggaaaaggatataaatggaaaccagctttgccctgttatttcagattcggctgtatacttagatggttttatgggtgtggggggaatggggggaaggtgtaaagagagggagaaagaaccatccatatctttcatggaacagagataataattcctatggatagaaaaatatcttttgtcctctctttttttttcttgttattttgagtcctgaactatcaaatctgacagccccacctcaaataaacattggcttttctaaaatataggacttctgtaacttgtttcatagtaagtattgtgttctggttatctctgaggtgtcactgctataaaatgtgattctgagtatgcctttcccagtgcataatgggctgagttaaagagaagggaagggaggggtatcagtacatcccagagggaggactggtcctgccactgagaaatgccctttgccaaaaatccagaggagtggtcacccttgttcccagcctaagttctgtgattccacatgaaacgcaacatcgtgcagctgatagcttccttggtgaagtaagagatggccaaaagtgggatagaattaatttttgaaatttctcctatgaggagataaagcctagcaattatagccacgaggactgtactataatagtatctttgtagacatgtatctcacttaatttataaattaattgagataatttataaattatctcaacctctgtgaggttggtcccattattatgccaactttttaggcacagagaaccaaggttaaaaattggcagagc

SEQ ID NO: 23899 - DNA, 1036 bp, Homo sapiens
tgttccctaattgtatgtacacacacacacacacacacacacacacatacacacacacacacacacacacacatatctataaataaagggcttctggaagctggctgcctattactgtgtacctgatactcagtgggtatttgtgaactcccaggaggatagtgtgttagtgtgtttgcgtgtatctctgtattccttcttagggatggcatacaaataaatgtttcatgaataaagggatgaatgagtaggtaaagtaatataagcagtaatgcatatgttttaaagtgatttagctggttttccttccaggggcctcttccctgagaaaagagccacttaataaatgatgtcttgaatgaaagaatacatcatgaaaataattttgtccatgatgtggctaaactaaaactccaggaagggcttaggctgggcctatctactttttttgataaaatgaagtttaatatgaccctagtgacaacctcccctcatccccttaaagctcaaatttagggaactcttgtggttggactctcacatactccctaggactctgctgggtgctggggaatttactaaactttggtgaggagaagaggagaggagagggaagccacggtactaaggtacttagggagacagaaacagttcccctagaaattagacatcacattgtctttttcccccctttcttttgaatgagatggggcaagaatatttggaccaggataaagttttaagatgcatttacactaatgtaatcaggttacatagcaaaaaaatgttaaaaatgtaccctgggaaattgaaatctatccattcttctaggtgtggcagcttattcagatttttatgttgtgtgaccataaaacgaacacagcttttctaaccgcgagtgtctttgtttacagagataacagtgtgagtaatgctttgctagaagccaggcagttaaatcacactctgagcaaatagaggctgggcttcagaaacttagatagcacacgaatgtgcaaacttggtcttttaaact

SEQ ID NO: 23900 - DNA, 1027 bp, Homo sapiens
ttgtgtgatgtgttatttccattttgaagatgaggaaactgaggcacaaaggaagctgtgcccaaggacacttaactagtaaatggagccaggattccaacccacgcagtgcgctttgggactcaatttttaaccatcttgctgtgctgcctgttgagcatttttcacctggtgcttttgtagatcccacattaggattttgttaggaccctgggcaaccttgatttagtgaaagcagttgttgagaggtagaaattcctgatccttttttcaatcttaaaggatttgctgagactctcactcttcattggtgatggtaacaaggagcagcatggtgaatgccatgtaaaattcaagccttgccttatcttggaggactttattcccttttctttgatggtactttggagattccagactataaaggactcagctgacagtacagactctcttgatctgtattttcccagtatatgaaattatttgtaatgtacccgtgagaacctggaataaactgtactggcactgaagtagaatcttggatttaaaagtacagtgttcactgctgcatcgttgagcatttgctacacagagaataaccttggagcaatgttcaaaggtgatggcattacccagaaacatggagttaggccaggaaaccacatctgaagttcagattattggagattgctgatttttcttgactttaaatattttcgactggttgagtgtttgttggtgtttttgggctaagtgttagccttttgttctgtgatgtccctgtgtgaataaaatggataatccctgtttccggttagctgctgctgctgctgctgctgccaagtataagtgaagacttccagctgcgatttgcattgtgttttcaggccaccttttgagtttccccatagcagatataaaaactgtttctaagagttcatccttacgtgttcagccttacttgtatcctaaaaccacaaacttgattttgttcccattcattatgatctatatttggcatcagtga

SEQ ID NO: 23901 - DNA, 1070 bp, Homo sapiens
gtgcctgagagcagggactccttgaaggtgcaagatgaattacactcctcccaggtgtcaggcaggggagagaagcaccctccatttagaaatatggaggattagccaggcatagtggcgggcgcctgtagtcccagctactctggaggctgaggcaggagaatggcgtgaatccaggaggcggagcttgcagtgagccgagatcatgccactgcactccagcctgggtgacagagcaagactccgtctcaaaaaaaaaaaaaaaaagaaatatggaggattctttctgatgagggcttctgcactgaattacgtaaaactcccatttcggaattatcaggaattaaggtggcaggataccttaagagatttaattcagtgtggtccatttaggttggggggaatcttactgagcattaaggcttgaaccccatttcatatcagttggagccaaaggtccttgctaatgtagaactctctgtagagtggtgggggctatcaagtcaaactgctgggactgtgcttgcttcgtgactgtgggcaaataactgaatttttctaggcttgaatttgctcttatacaaaatatgtttggtggtaagagtacctacttcacagagtagttgtgagaattgagttttaatgaagtgcttagaagagtacctggccctagtaaacactcagtaaaccctgactataggggtggacatggaagaagataatttaattcctccgtcatctaggaccatgctggagcccttcccacttgcgtagctgaagcactggtggatgaacccccatttgcctctgatcttattcctgccgctgcttggtgatgtcccctggactcagttgtcagctctgaagctttgaccccttgactcacctctggtcagttggtcccacagtgctttgcttgatcctctctgttgccatctgttcccatgcggtataattacctgttaataaggctggtgtcagtaaactgtaaactctttctgcttctgcgtctatccttatttcctactgcttagtagagcaatttaaaacctttttaagaatggatttgc

SEQ ID NO: 23902 - DNA, 1050 bp, Homo sapiens
ggtatagggcaggactgcaaaggaccctgttgtcatctgcatcctgctgcctcttcagcagggatgggagaaaagaaaggggagcaaaggatgttctgctggcagtgtgcctgggagctcacatgtttaaggactggacagttcctacacagatgctccttgacttatgagattatatcccagtaaacccatcgtaaagtcaaaaaattgtaagttgaaccatcagtaatcagtgttctttctcaaagacatgaccgcagttaaggggcgctaagtagaggtgtccttggaggtcagttttgctgaccttcctctggctggggtcttgtggccctgctagcatgtgcctgctcctgccagttctgtggtcaatggtaaaacaagttcttctctgcttgcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctggtgagtggagaccttaggaagtgccgtgtgttgtaggtggaaaatatttttgaaaaatcaagtgtgacttgtctcctgttgaattctgcacttaatggttgatagttttgaggagaatcttgagaagtgagttgagcgcttcagggagagccttagtgtcacattctgagcgtggatgatgttcttgagctgtaataaagccactttgttctggtaatttgcaaggttgccacctttggtcagaaagaacttggctggggttcctgccaagaacagggcatggtgctggaatttgaagggccaggcttgggcgctggcttctagatgaacctgtgtcccacatgcgatgatggaatgttttctaaatttgtgtctttctggttgtctagaaaatctgagctgccatcttaaggtggcaagcattgaattcagtggccactgatgttttcttccctgcacgctttttattttgggagtggagggagaagctggtgttt

SEQ ID NO: 23903 - DNA, 1086 bp, Homo sapiens
gctatgaatttttagatcttgggaactttgaagtttgtatgaccaacatgtttctatggatagctctgtgagatcatgatcacctcttgaaattaatttcttgtaattactgcttcctaaacttgcccaggtattgtgctttaaaacatgtgagaagcctactctgaagcagatagaacacacgttgtgggagtgtgtggtgtacttgagttttagtctcaattcccactcctctcgtatagtaccaccaggaggtcatctcaccttgctgtatcttgtttattcttgttattctgtggcttgctggtttttgagttgcatccaggtctggaatgaaccatcccttagttcatctggcacagccagtcgccatcagcatggggtccctgtgatgtggcattgaacttcttcaacctgcgtgaatgtgtttgggccccatcaccaccctccccctcccacaccctggaccccatgttcatgtggaagcacacacacattccattgagatttgtagagagagaatagagttgtggaatgtctcatacatgtttcctgtttgtggggaggagattctgagaggaccactttttctaccgcattcatttgaatgtaagtcagacaagtgattatttgagatcaagctttcaggataaagtctgaaagaacattggttatgtcctgctggttggagcctgggaaggtaccgacagtccccatctattcattattctcttccttaacttctcataataccatccacactgtcgcctccaccctcttggagggagacttatgagaatggctgctgcagttagaagtttctgtcccccttgatctgcagttcccatcatgaagacactttgtttgtgatggaaacagcacatgtagctggaccactcactatctcactgctcaggtgcacgaactgacaagaaatgagaagaaaaggcccctgaacagcaaaaatgtcagaagcccctgcacctttcttagaggcagttaatccccatccctcaaatttgaacagttttgaaccaggagcttcgttcaatccagaaaccacctggatgtgagaagaaaaggggc

SEQ ID NO: 23904 - DNA, 1031 bp, Homo sapiens
aagtagctggcattacaggcacgtgccaccacgcccggctaatttttgtatttttagtagagacagggtttcacaatgttggccaggctagtctcgaactcctgacctcaagtgatctgcccgcctcggcctcccaaagtgctgggattacaagcatgagctactgtgcccgggtggattttttattttccttcttttcattccgtttctctgtaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtaaaacctgaccgaaaggaaggacgacagagctgatccaaccagggctctcttttctgtgactcattcactaaacccctacgtacagctgtgtgccttgtctaactgcccacatgtacagctagagaggagccacatcacccatgggaagattgctagctcaggaattaaatgagacgtgaagtgtgaaaaagttgtagagaccagttcagtagccagagctctgtttctgtgacttagatatattccagtgtagggaatcaatcacattgtggttttctttatttttaagttttcagggttaaactaacttaccgtttcattgatctgtgagtgagtggtactactttgggcaggggtcccggagaggtggtatggggagaagggaggagtggtaggtgccatggacagaggagaggtcaggaaccaggcagccagagttctgattgtgagtgcctgagttgcctaatcctctttgagccctctttcttggtctttaaatggagattgta

SEQ ID NO: 23905 - DNA, 1030 bp, Homo sapiens
cggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacaggcaagtggacaagccatcatggacttgggtgtatttctgttttacagccatagtccttagagtcttttctcacccactgcattatcaggagtccaccttccatgggaaggcatttttaacccaaaatattacttgctctaacagcatcgtagaacatttccagaatagaaagacacttgtccaaactagaaagacacagtattaggagtattgggtgttggctgtctgtgtatgggattgataattttcttagttaatgggtattatcaccgtttaacagttaaataaatgttcatctcattcaattctgcattttacacgaaagaaatattctcatactttgttgtttaacatcgtgatttgtgacagttatctgagttgttcaaggcactttataggtaataaaaataactgtttatattatatcaccgtagagggctttaagggcaaatgaatttacctcagatttacttgaaaacagttccattgatgttgaaaagcaagtcagtggcaaaatgtttgagtggctcccatggctggctttgcggtgtggccaagtcccaggcccagcagttctgcttagagccagtcactgcaaaagatagtctgtgctgagcgctgaggctgcttctctgccctcagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcgtgagtcgacccctac

SEQ ID NO: 23906 - DNA, 1062 bp, Homo sapiens
tcactgctgtctaggctagttcccatcctgtgtatctttttgtgtctgaataaggagaccgtattagctgctctttgatatggccatcctgaatctttgacagctaactcatcaaggtgcgattgcggcacctcttgctgcttctctactttctagaagagagtctttctgacttgcatttcaaagtaaaagtttgaacagaaaaccattgctttttctggcacccacctagcaaccattttgaattattcaggcacacacacaaaaacaaaagcagccatattctacagtttggttacctggctggtactgaactgtgctgtcactgtgctttggctccagtggcccagcctaagctcagggagtgattcagacctgaaagaccatcagtttctttcaaggccatcagtttctttcaaattaattgtgtgttttaaaacctacacattttttgaaaagcttgatctcctaacggaggcatcgtttgtctaattttagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggaggtaggttgctactttgctttggagctgcagctggcgtcaagatgtaaaatgactttgttttatatgtttgtgtgtgtcagagatactgtgtttacattcttatacacacacacatatgttttaaaactcctttcctgtgcgtctagaataatgcaattatgcaagactctaggcccaggctggtaaatctctggcacagaagacaatttttgagggctacaaaatggactccgcatcctccccaatcagtactctttctaggtgacgccaatgtccattgactatgccctagatcagtttgctgttgagtgcatggttggtgattctggttaggatggtggtaataaagaggtaaattattaggtgcgtgtgtggccccctgcatgggaatgggcatcctctccaagaggtcagggctttgtccg

SEQ ID NO: 23907 - DNA, 1037 bp, Homo sapiens
tgttgataacataataaaaactaacatctattaaaattttgctgtgaatgaggcattgttctaagtggttttttaatgtatttctgtgtttattccccaaagtgaccctgtgaattagattctatttttaattctcattttataagggaatatgtgagctaatacagggtttataatgtacagtattaggaatagcatttcataattggtatgagcactaacagcgcaattctagcattgcttaccatgctttgccattctctgttggagttctgggctctgtccttatgttctaactccatctatgcatgttatgggggtttactagaaaccaaatgcaagggccttttctgagaggtttgacggcacactctgttgggcccagagccctcagaaatcccactttttgaccattctttgcaggaggatttggtctgtatgttttgagaattgtggggcagtttcattcagctcagcaaaacccacattacacactgaaccgggcaccagcttgtacaccagggacacagtgatatgcacagtccctgccttgaaaagccagtaagtccctagtgcagaggtggcatcttcttcatgtagtcatgttgggggctaccgaggtgctgaaagcagatagctagccagctccttgggacaccaacgctgcccacagtccattttttacctcaatgatcccaggctttgctgcatgaaatgaagtgaaaatcagtgttaactatagcagaaagcctggttctaacctaccttctcataactatgttggaactagtgttccatttcctcacaggtggaagaacagaatgaaacagagcaaaagccttggtccccaccatctgtagtgttcccatatccttccctccctctaaaccccccaaaataaaacacacaactaccgcccaaaagagggcgagttaagaatgcctgcccatctggctacgtgtagattgtgaattcctgcaggtctctgaaggcttagctcatgaagtggggccgagtgaacagagcgttcactgtag

SEQ ID NO: 23908 - DNA, 1048 bp, Homo sapiens
atttgtccacagtcacataggtatgtaggtggcagaagtagaatgtagacagtgccctttctcatcctgtgtgcacacacacaggatgctcagaacttccatatgattaaatgcatggagtgaactgcccagattttaggccagtgattttgtggtgatgcgttttttgagagttctaagtaacttcacacagagggcagcaattattctctacttccaaagggctaattattttgctatggtaagagttccatggcaacctctaatgctgcctttatgtggtggagcggggcatagggcattcctgtagtcgtatttttctgtctagagtctatttaaaacacttggaagtttcagatttaaaaagaattaaattatgtgaaaaggttgcacgtaataaaattgagtgatgatgttctcccaccctttcttactgtttcctctttctcctcttcttcctttcccttcctccttttcccctcttccctaacagggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcagcatacttattttttgtttatttattgtgagctttttactttattaagattttacagcgaaacccttacatgagtaattgaaatgaaattaaatgagattacagcataatgaagaagaaaactagaatctaacaggtatgacacattcagttattctaacagggcacagtactgtgctatatgtagccgcctttacagatgttattaacctatagtagtt

SEQ ID NO: 23909 - DNA, 1652 bp, Homo sapiens
gattcattgttcattttctcaagactttttgtggaattctctgataaaggaagcttttaggatggtatctatcaggccaccagcaggaattgaaaatgttttcacaaaaatccttttccttagaaataaaagctggtgacagagatggtttccttgtaccgataaaaacaaaaccaaatccatattatacatcaaaaccttgtgagacattcacttgctcttttgccatatttagatgtgtcagtggaatcagaaacctgttttgatatgtgttctctatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgctttgtctttggtcattagggagctctaatgtgtgtttgtggctccaagttacattttgtgtttcattgatctatatgtatatatgtgatgttttcatatatatatgtgtgtgtgtttaaattttgtatcatcaggactgacacccaatttgacactttttgtatctagaagaccctccaaaaaaggaaccacataagcacacaagaaaagagtgctatgatgttcttagcatttgctatcatgcctatttttatctagatttttaaatgtagcttgtcataacaaaattttaattacaattggcttgtatgagaagaaaaagtatttttattgttttgagtgatgacgcagagactcagtgaacttgaaaatagcattgcttcgtgcactttgaataccaatcaggtgttttctgtgctactagttgtcacgttgcattcatgttcacctcctgatttaagtatctcgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgctgtctgttggcatgcttaaagcacatgtccattaaaattcattttgttccttttattttccttgttttcttggttagtgattcatttgcataaacattaatgatctctgcatactggtttggggttttctctttccttctaactctaaagaaaaaatttttgctgcagaattatcctcagaagaggcttccctggccttcatctaccttgcagtctgaccaagtatgataaattttagccgttttcaaggaaacatctctctacccaggtcattgctgtcactagcagctttcaagtcaaacctgcagcactaaatttttttttatcctggtttctctacatactaaccccatgtctctctggactcacacctggctcaggccttccagaccaaactcatacttcctcctcaccagaagtttccgaatctcacactagagaagatttgtcacctttaaagtccactcacattattttgactcagggttttgttttttgtctatttcccctcctgcaa

SEQ ID NO: 23910 - DNA, 1050 bp, Homo sapiens
ccttgtcttactctgggggaatgccatgtagctctgatagagttgtctatcggtctgtttgtgaatgccctttcgcttaaacttccagcccttctggtggcatccttggttgtaaggtggctgctgtataacgtccactctctttcatatttaatatgtgtgattgttactgttgtctttttgttttaaagtaaccataagaggagatgatctgagttatatttattgatcagaggaatagagtgcagtaaaactcatactggcatttcgcttttctcatttccctgtaaatgggcgggtattaatccattcccaccttctaatgtccttgatgtccagctggctttgtgggtgtgcaatggttttactgtactgcctcgatctgtgccaggcatttatacacagccacatgtgcgagtcaggtagagcgtatgtggtcacccccatggctcacggagttagctgaatggcctctccgctgtccctagatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtaacagcagcagaggctgccacagtaagatgggaagtcagcctgtgaagggataaggcgggccactcttgaattggaagagaagtatgtgctcatgtagttttattcctttggtagcttcctggacattgcattcttcttgggctgacgctggaaagcaggagtagaatgctggttattcactgagagaagaagagttgagtttggatgggagtagctagaaggggctttagtagttcatctagagaaggaatttgctagattgagactgaagagtcttctttactttaagtgattgatttcatttaggactccttgtgggt

SEQ ID NO: 23911 - DNA, 1052 bp, Homo sapiens
aattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctagcacggtgactagttgttgttcttcctctgctgcgtgtgcatgcccagtagggaaactgcaaagggagaaatgacaaacaagaaacattttacaaccagtctgggctcacttttgcattttttatgcatgtctggtgcacaagctttgaaaactacagcaaacagtaataaatgtgactgttttgtagttatacattcaggctttatcttttatttatg

SEQ ID NO: 23912 - DNA, 1068 bp, Homo sapiens
tggcggccgcacaccggcggcggcggcttgtctgcggcggctgcagcggatgatggtggcggccggcccgctgggctgtgcctgtgtgtcgccgcggaaatcagcgccctgcgccgcgcgctgagcccctgcaggtccgccgcagccccagcctcggcgaggacggccccggcgcgcgggggggcggggggcgcgcggggtcggcttatcatggcggatcggacggcgccccgctgccagctccggctggagtgggtgtacgggtaccggggtcaccagtgccgcaacaacctgtactacacggcaggcaaggaggtggtctactttgtggctggggtcggggtggtttacaacacccgcgagcacagccaaaaattcttcctgggacacaacgacgacattatcaggtaagggggtggccaggggcggcggggaggggttgcgtgtggaggctgggaaggtgggaagcggttgacctggggtcggatccgggagccccgtggaatagaggattctctctggagccgcatggaattactgaagggctgctgattctagggccagggcagaaacagtgtggggagtgtaggtgaggagggagagatgtcttttcgctgtatccctccggaattctggcttttaaatctccaaggagttgagtgttctgatgctttcttgctgttctttcctgctacaagtggaaggagcctgggtaactatgaaacacttcttccttccctaaccaggtgcacggtaggaccaataacctgaagtgtgggcatcatctttgggaggctcctcagtgggtttctcagtaagcaagaggattaaaaaagatctaaaagaaattttactactggtaatttggaatcttcatctcagatgctttggacctgggaaatttctgcagtgggtggggagtttgttctctaatatttcacttggcagtgttttaatgcccaaagcatatttatacactaaatggatgcttccacagcatcattgaggttattaaaggctggcagctgctggatcacaaaatcctaccagccagcccacacaatgacc

SEQ ID NO: 23913 - DNA, 1029 bp, Homo sapiens
gatagccagagaaagaccaaggtcattgtaattctcatccaggtcattaatgcctcatgggttttggtaccatatgccctagatttcccaggacagtcacaaatattccattcagttattgttgtggatacttgttcttgtgacatcatgaatctaatttttaattcagaaatatgagtccaggctcactcctgtcatcccagcactttgggaggctgaggtgggaggatcgtttgagcctgggagttaaggaccagcctgggcagcatagggagaccccattgctacaaaaaattaaaaaatttagccaggcatggtggcgtgtgcctatggtctcagctacttgggagcctggaaggtcaagactgcaatgtgctgtgatcacaccattgcactccagcctgggtgacagggcaagaccctgtcaaaaaaaatatatatatatatgactgtgttttgttttggaaaatgtggttgccacataatgggtcactgcttgaaaacattgcgctgaactatactatcttataaagaattgtatcagtcccaccaaccccatcaatcagtcatttggatgacactgtgataggtgaaaaactgttcacatggcagcagccctaattaggcaacactatcctgcagcctctcctatcctcaaggtgtggatctgaacacctttttgaagcactgtgaaattgttttccacaacagccacaccattttagcatcccaccagcaatgtatgagagatccaattcctccacatcgtcaagatttactactgtctgtcttttttttactattgccaggctgctgggtgtgaaatgatatctcattgtggttttaattttcatttccttcatgactaatgatattgatgatcttttcataaacttactagccatttgtatatcttctttggataaatgtctattcaaatctattacccatttttaatcagtttgtctttttattgttgagttctaagagtttttttacatattctgggtatgagtcccttatatatta

SEQ ID NO: 23914 - DNA, 1033 bp, Homo sapiens
agatacataacattttggtaaatatgtaaagtgtaagtaataattaaagatttttagaacttcaccaaatgtcaccactgtgttggtgggtaaaatgctacacttgtttttctaattagaacaccctatgcagtgacctgagagtccaagggcttcatgttttcagagcgggtcacttcaccttttcagccatgacagaagcaaatctagccgaggataccctttcttttcatgccaagtgtgctttctgcataataaggtaaaaggtctgctagactgatgttcaggtggtggcaacatactactataggacaagatcctgaaattcaaaatagtgggagttaataatgggacattttgtgaaatgactaaaaacaaactcattaacttatatattctttggtaaccttacttatcactaggctaggagaaaattagtatgcatgtctgaaacccacataaagaatgaacttaattcttgcttaagactaaaatggcaataaaaagtggtaattgtaagggaaattggaactttaagtaaacttatttgaggctctttgttttattttatttgggccctaagcaaaaattactgtactaattagcatgattgatttcatcccatgttatttatccttaagatatgaaattatgaaaaaaactttgagatacatgtgaaaaaatgttaaacagttcttgtttctactagtatactcattttaatcttctttatttataactacattatacaaatttatctaggatttttactttatattaatacttggattacagaactgagtcattattacttatcctaattttgtgcttggttaaattttgttacaatttataggtttagaaactttcactttaaaatgtgcaaggtattccagtaattctggggaaaatgggttccttatagtgaagattattacaaaaattataatgggtaaaattgtttattaattctggcaagacaccaaaaagaaattatagtagttgacagaaaactcagaaaaaataaactgta

SEQ ID NO: 23915 - DNA, 1050 bp, Homo sapiens
cagtgacaagaacacttgtaaacagtttatttacattcaatggattatatttaatcattttatagttaatttgcgtaaatctctctctgtggaatgtccacgaaaatgtttttggttggtgacaagcaacatggtagagatgcagagagtcgtgaggcccggattgtagcccaagatctgttatcctctttctgtgtgatcttgggcaagccattatctcctctgagttggttttctcatctgtgaagaagacagattacaacatctctgaagctttacatcttaaagttctaaaacttttctgtttaatagttaaatatatataaattttctactcaaagttttttttttagaaaataaatgggattttggcttctatataagtaacaattatacaagacattgtaaatcccaatctatgatttataggttctaattgaaatacttctcatgttcatgtctgcatagtgccaacacatgtggataatgatgactttgcataagattttgtctgtatgagtttcagctttcagtggaaagctgggtagttaagaaccacactatccaagaagctgggaaatgacttattttgattaatcaaaatacaatgtacagataagctggttgagatacccgaatctgacaggacatttaaaataaactggcaaagatttatatgagccagtctggctgcagtgtgcacctggtgggttgtctggaagctttgatgaattagtagtgatgtcagaagacttcactataattctaggctagaatattgccatagggatgcagcagaggacatctggtttcacttcaatttatccatcagagccaacaatttgagtgctacagggacaagccctagagaagcagattttaataccatgcacctgatctatgatgggttcttatttttgagaatggatgggtatgtttaagtacatttttaaaaattgtagtacaaaagtaatacatgctcactgtaagacattgaaaactactgaagcatatacatttaaaatatcctcacccccagccaccccaact

SEQ ID NO: 23916 - DNA, 1039 bp, Homo sapiens
attcctaaagaaggctctgaagtttgtgctaaatatagaaagagaaggaggaagagagaagggggagaggagagagaaaaaagagttttctgtctgggatgaggagaaagttgtacccccctcccaaactggggctgaactataattctgaccctcaaaagtcagctacgtttccaaatgaggattaccatcatggccattttatcactctgtgcgagatgctgacaccatgcactaagttttgggtcccatgtatttctttttattgtggaagagaaaaaactaaaatataattagaagtgcattgttaggccgggcgcagtagctcacacctgtaatcccagcactttgggaggccgagacgggcaggtcacaaggtcaggagatcgagaccatcctggctatcacggtgaaaccccatctctactaaaaaaatacaaaaaaaattagctgcgtgtggtggcgggtgcctgtaatcccagctactcgggaggctgaggcaggagaatggcatgaacctgggcggtggaggttgcagtgagccgagattgtgccactgcattccagcctgggtgacagagcaagactccatctcaaaaaaaaaaaagaaagaaagaaaagaagtgaattgttaaattaataaatatatcaaatatataaaataactttccttacactctttacaattatgatagtaagaatgaactaacactttacactttcacctgagaaatgacagagcttcagaatttgatttctttaactgtagagtattaatgaaatccaagatggtattttgaatgaaagaaccaacaggaagaaaaagccattttggtgacagtctcatgaacttgtcagtggtagaactagggaagataatacaaaagttttgacatctcagttgcttgccaccctatctgacatggcactagcttgttcttttagaatataggaaggaggggctgggtgcagtggctcacgcctataatcccagcactttgggaggccaaggtgggcagatcacctgaggtcaggagtt

SEQ ID NO: 23917 - DNA, 1029 bp, Homo sapiens
tatccatgtgcaggtttctgtgtggacataagttttcagcttatttaggcaaatatcaaggaatgtaattgctggtcgtatggtaagaatatgcttagttttgtgagaaattgccaaactgtctttcaaaatagctgtatcattttgcattcccaccagcaattaacaagagttcttagcactccacagactagccagcatttggcatcaaacaccatttattttaaaagttcatctttctcttgctatttatgtaaaaccttgtctttgttatacactacatttttatattcatttgtgtctgtttcaagattttctgttttgccatttgtcagtcaactcatacacaggtactatactgttttaattatggagcctttatagattgttttaatacctaggagagctactctctgcactctgcttttctgtttccgttttcctggtcattcctgctggcttattcttccatgagagctttaaaatcaaattgtctaactccagattaaacacacacacaccccgtggtctttttattggaactaagttgaatttataaactaagggataactgctatctttaggattgagttttcctttccaagaacatgggatatagttctgttttttaaagtctgcctttttaatcttacttatcaggtctttttttctctcttcacttttatgttacatgtatctcgttgagtttatgccttgttatttttattgtttataaatagagtcctctcctccattatatttttcaaccagtcactgtatatacaaaggttattgatttggtattcaattttatatactgtacctttactaaaatgtcttatttgtagtcattttaaaatttcctttttaattttttagacatatatcctttgcaaatatgaatagttttagctcttccattccagctcttgtgccttttaaaatctcctctagttgcattagtttatatgttcaatacgatgttaaatggtagtggtaattatcctgactctattgggaatgccatta

SEQ ID NO: 23918 - DNA, 1044 bp, Homo sapiens
tactaggagggtacatatatactatgtttatttagtatgaaacaacagaaaagcaggcatttcaccatttacctggatgtttctaaatggaaagatgtttggcatcatataaacaaaaccaataagcaatgagttcatgttttgctttgcaaatgaatgatttagcatcgtgtaggtctagctgtagattcaagtttaaatgaaaaaattatttcgggtgatgattttggttcaaggaagctcaaagtgtgtttattcctatttgtgcttttttgtggtactcttggactgaatatgtagcaccaggctaaagaagggctagccaaacagcataagtagagtttatgttgccccttttcctctcccacaggggcacatggaaggagaagtgtgggggttggcagctcaccctctcctgcccatctgtgcaacagtgagcgatgataaaacacttcgcatctgggaactatctgcccagcaccgtatgctggcagtacggaaactcaaaaaaggtacataacaccaccttacacatctgtcagagtatttacaagtaacagaatgtgtcatatttattcactcagttaatatttactgagggcacgtgttatatgcccataaatatgctgggcaatgagaattttatattggttgctacagtcataactaagcacatgtagaattatgccagaaggctggcctaatccagctccatttttcacttcattttccttgcactgcacagatatttgccacctgggggcaatatgtccttcctcttctcattgagagctgtgggagtcaattgaaattcatcagcttttaaagaatgctatttattttgtaacagtctccagaacttattttatgacttgaaaacaaacatcaattatatagaaatataatacttaagaaatgagtaaatatgtcttgaacacctaaatgcactagaactatgaggtgtactgagaggtacaaattcagcaaacatttattaagtagcttctgtgtggcaggcacaggggatcccatgatgaatggtcc

SEQ ID NO: 23919 - DNA, 1033 bp, Homo sapiens
ccaccatgcccggccgagtctgttttttttcactgactaaaaatacaaattccaataatgaagtaacaggcactataatgaaccaattttctagggtgctattttactactgttatttgttagtgttatctgactggtgtctttgcttaatcctagaaaccctcatgactcagttttccacattgctcttagcacaagaacataaaaatctctgtacgatcatgttgagcaggtcagaaaaacctaaaataataaatctgttatgtagaccaaaaatgcaaaatcaaatctcatcatggggaaacactggacaaatccaaatcaaggtacattctacaaaatagctgtccaatatgcttcaaaaatgtcaaggtcaaaaacaaaaattgaagaactgttccagattaaatggagctagagagatatgacaacatggatatattataatccatgatcctggactggggaaaaaaagtatactgttgggacaacggacaaaatgtgaatatggactgtgtattagataagagcattgtacaaataagtgttaaatttcctgagtttgattagttctgtagttttataagatagtatccttttgcttagcagatgtacatatttagaggcaaatgggcactatatctcaaacattttcaaatggtccagggaaaaaacatcacgtgtgcatggagcaggacaaaaatgaggcaaataggacaaaatgtaaacaactggtgaattaggtaaaagatatataggagttcctggtttttctcttgcaatttttctggaaatttaaaactattatcaaaattaaaagttaataaaaaaacacaaaatctacgtggggaggaaaaaaaacagatgaggtgatttaatcaattttaaatatactcagtctttactctggctatgatatatgctagaaacaatatttttaaatatttaatatttaaatgtaaattttcttcttatggtagacttctctgccagccccacaacaaagtcaacagctctttccatgacactgtta

SEQ ID NO: 23920 - DNA, 1052 bp, Homo sapiens
gtctcatgtacatttatttcaagtttgaaagacttcagctgacttgagattttagagtatatggctgggtgcagtggctcacgcctgtaatcacagcactttgggaggctgaggcgggcagaccatgaggtcaggagatcgagaccatcccagctaacacagtgaaaccccgtctctactaaaaatacaaaaaaattagctgggcgtggtggcgggcacctgtagtcccagctacttgggaggctgaggcaggagaatggcgtgaacccgggaggtggagcttgcagtgagctgagatcgcgccactgcactccagcctgggtgacagagtgagaccctgtctcaaaaaaaaaaaaagagtataaacttcctgatttgtatttgacatctcaaagaaaggagaccagaattcaatgatactttggatttcacagagttcaattttctgcccagccattatgtttatgaagttgagtatttttgaatggtcatagttgtggttactgttgagaggtgtccatcctttttctggcttaagattgttaggacctttgtaggaagcagtggttctttttttttttttttttgagacggagtctcgctctgttgctcaggctggagtgcagtggcatgatctcggcttactgcatgctctgccttgcgggtttacaccattctcctgcctcagccttctgagtagctgggactacaggcacctgccaccactccgggctaattttttgtatttttagtagagatggggtttcaccatgttagccaggatggtctcgatctcctgacctcgtgatccgcccgccttggcctcccaacgtggccggaagcagtggttcttaagctttagcaagcattggaaatggttggagggcttgctgaagcacatatggctgcctcccagtttctgatttaataggtctggggtaccgataatttgcatttttaacaatgatatggtttggctgtgtccccacccaaatctcatcttgaattcccacgtgttgtgggagggacccagtgggaggtaattgaatttt

SEQ ID NO: 23921 - DNA, 1051 bp, Homo sapiens
gtcccagtgctttcagaggctgaggcaggaggatcgcttaagcccagcctcagacttctgtttgaggctgcagtgagctatgatagtaccactgcgtgccagcctgggcaacagagcaagaccctgtctcaaaattaaaaaaaaaaaaagaaaaagaaaagaaagaatgttgcctgactaagatccaggggtgaataccttagattaatgttgattatactcaaaactgcagactatttgaaaatagttcttaatgatgagaaaaagtcaaaggctctctggattcttttttatctttttggtgccttattaaagaatttagagaaattgcaaatgagagtattattttgatggtttttaagtacttcatactgttgtgttattcttagtactttcagttttcctcaggaagattattaggagaataataattttatatcttttgactgagcaaaaatgcacttaagattaatggattagttagatgtcagttttctgattgtgatattgtactactatagttttgtaagatgttaccacttggggaagctgggtaaagagtatatagcagatttctgcattatttcttacaattgcacttacctcaaaataaaacatttaatttaaaaaaatgtatataaacatcaggaggattagagtaataaagctacttaagagtagacccaaaatcctacagtcatatgtggataaagaaatggaaggtaaaaattaagaagcattctgctaatgttgtggaatgtaataattacagatgcaaacagaacaattattaccagtccacctgcttcgcaggaagataaaagtaataaagtaaattaaaccaatattttaagttactttttattttcttgggctcaagttgctacttccctggtttataattattagaccaacatctgaatagaagcttcaagggcagagatcgttttattcatctttgtatccccccaaagtgcttaacaccatggttttattacacatagtaagcagcgcccttttcaataacatctgttataatataaatgaagac

SEQ ID NO: 23922 - DNA, 1039 bp, Homo sapiens
aagagatatttgtagttaaaagtgtggggtttttggtggggcttattctgtaaaataggaaaaggcttaaaagatgatagttaaaaatggccgggaatggtggctcacgtctgtaatcccggcactttggtaggccgaggggggcagatgacttgaggtcaggagtttgagaccagcctgccgacatggtgaaaccccatctctactaaaaattagctgggtgtggtggtgggcagctgtaatcccagctactctggaggctgaggcaggagaatcgcttgaagctgggaggcagaggttgcagtgagcccagatcgtgccactgcactccagcctgggcgacagaaagagactctgtctcaaaaaaaaaaaaaaatatatatatatataaaataaaagatgatagttaaaaagataatagcttaggatgttacagtgatagatctgaaggtaacttgtacttaaggaacgagaacagtgagaaatatatgtttttaatggagttgatactatttcatgtggtctttggttttgaacaggtgtattacctgactgcttaaccgatggctctgatgtggtcagtgaccttgaacacgaagagatgaaaatcctgagggaagttcttaggtaccattctttaattgttttttaaatgaatcattattaatattatatgatctgtacatatgctttttgcccaacaaatatgaactaataaaattgctaaattctctactgaaaaccatcaaaatgatctatcaatttatgactgtggatatatttcttagtgacagaaaaagttattttcaggtaacttataccagatcagtccaaatgaaagggtctttttacacccgcatcataggaataggaaagtagccaccaatgggaaaaagttgcagtagacctagcctgatctctggagagaggtataatgacttgagctaaacagcttactccttggcttctggatctcactatggaggtggcatattctaggtgtcacatggtaggaggctgggcatccagattccacaga

SEQ ID NO: 23923 - DNA, 1047 bp, Homo sapiens
tgacattttatcaagaggggtataatggctcttatcaagaggggtgtaattgatcactctaaagagggtgattgaagtccttattaatgggatttgccattcaaatttgggttcaggatttcaaatctgttgatctttattcagctagggttcattcagagttctagaagaaatgggtagacctgtattttgtgttactaactgtattatgctgtatgcctatgtatgtctttcccagttgactgtaagccactttagagcaaggcttgattatcttccatctttgtgtctaatgtgccttttattgtaagcttaggttagcatgttgcttagttgaatatttgttctttgaccaaaaaaggaaatttatctttttatcttatttttgtatatttcagaaaatcaaaagaggaatatgaccaggaagaagaaaggaagaggaaaaaacaggtgcctacagaacatataacagaagtattttattgctgttatctcttattaagtttacacctagatcttactattaaaatttatacttatgtggaactacataattttaagtacaatgtaaatattgaccaataatattaatatatcaataattctatgtatgtcgtgcattactgctggccaccatattatatagtactatatatacttaactgtatatagtacaaacaccacatagtactaattaatcttacaggacatgcatataagcaagagtagtcattttttttggcaagtttaagcatttgtttttaactttttatacttttttctccttctttatttttgtcctggtaactcacagaacaacattttttttttttttttgagattgagtctcattctgtcacccaggctggagtgcagtggtgtgatcttggctcactgcaacctctgcctccggggttcaagcgattctcctgcctcagcctccagagtagctgggattacaagcgtgcgccatcacgcctggctaatttttgtatttttagtagagacggggtttcaccacgttgatcaggctggtcttaaactcct

SEQ ID NO: 23924 - DNA, 1035 bp, Homo sapiens
gtagaatgaaacttttttgaagttctgggaaactgatttgcaaatcactttcatgtatgttgtttacttgtgtatgttaagcctaaacctaggcagtgcagcctagtagtgaagaggaagctactggagcctgactgattagatccaaatgcttgcattctcatttatcagctacaggacctccaagaccttgggaaattacttaacctcttcaagctttggcttcgtcatttctaaaatggggataacagtcctacttcacaggattttagtcaggattagatgtcataatgcatctaaaaatttctacttattattattactgctagctataggagagaatgctctggcttaatccaaataactttctattcattttaacatatagttggtgtcttgagaatgttctttcctgcctaaattatttaatctttatgtccatgttcttcctaaaggcctctgagtcagctgtgggctgtgtgtgtgtttggtgtgattaagattagaaaatggaaaatatattgtggatccctctacttaagatggctgactaggccaggggcggtggctcgtgccaatcccagcagcactttaggaggaccgacgggacaagtgcttgatcccaggagttcgagagtagcctgggcaacaaaaggaaacgccatctctacaagaaattaaaaaaaaaaaagccaggcctggtgttgcgtgcctgccgtcctagctactcccgaggctgaggcgggaggatcacttgagctcgggaggttgaggctgcagtaactcgagatctcgccactgcactccagcttctgcgacagagcgagaccgtgtcaaaaaaaaaaaaaaaaaaaaaggctgactagaaacagctagtgtgcgccactctcacaaacagaagaaagtggtaagtagacactacctcttttttttttgttgtttgtttttgagacggagtctcgctctgtcgcctagactggagtgcagtggcgcaatctcggctcactgcaagctccgcctcccgggttcacgcca

SEQ ID NO: 23925 - DNA, 1113 bp, Homo sapiens
aatccttaagagttaggatccagctactgagagaatcacttgttatttagtgttagagagagtgttaaaaaacaatgaggtggaggtgggaggcaatgatgttagcacatacatctaacagaaaagttatttctggcccattctctctctctccctcacaaacttttggtgaggaagtagtactacatgttaataaagttatattattgactagtttcactcataaagtaaacttcagattatcctttgacattagaaattaatatttataggatgttggagccaccagaaatcctagattcttactttttttaggtgaaattttaaacaaagtgaaatacatatattgtgagtatataatttgatgagttttggccaagagtatgtccacgtaaccaatacttaaataaagatttagaacatttccatcacccccaaaagttaccttttaccctcttacagtgaatctctaaaccatttaggtggccactattcttatttatatcacatacattagttttacctgttcttgagcttaaagtaaacagaaccatacagtatttacttgtgtatctggattctttcactgaacataatggttttgagattaagccatgttgttgcatgtattatctgttcattttttaaaaaatattttttctattcaaatgtgtaccaatttgtttatatacggttttgttgatgggacttgggttctttctagtttttggctgttctgaataaagtcatggacatacaagtctttttgtggatattgtattttcatttcttctggatgagtacctaggaatagaattgcaagtcatagggtaggtgtgtattgaactttataaaaaactgccaaatagcttctgaaagtggttatatcatcttacactcccatcataagtgtttgaaaattccagttgttccacatccctcatacacatttggtatggtaaggcttttttattttagccattctagtgggtatataacagtgtcctaaagattttgtttgcatttctctgatgaataatgaagttgcatatcagccatttgtggtcttttttagtgaagtgtctgttcatggattttgccttttttgattag

SEQ ID NO: 23926 - DNA, 1028 bp, Homo sapiens
ctgatttacctttttatttccttgtaactgctattcaaggagtgttccctagacaagcatcatcatatcacctgggagggtgctagacaggcagaatctcagtctcagatgtatgccaactgaaattaaggctgttggggcagagataatttgataaaggtttattgaaagccaaatttgactataaacccaggaagacacagcaacaaattcgggcatgttccgaagtctattacaagttggaatgtttttataggcaagtgtaggagagggaggggtactcctcacatcgcagttttttttttttttttttttttttttcattggaaggtacaaaacagtggttacaatcaatggtacaaatgaaaacatacaggctaaaatgtgttacctgcaagtcaatcagtaaaacttcatgattcagaaacaaattggtgtccattttaatgtcagtagattatgtattaatcagtatgtcaactattgagaaactcacgataagatttaagggacttacaataagattctttactcagaaacaagacataagccatgaatcataaggccttctccaggttgttgatttggaggcctgccaaatgtgacctgtaggttatcatttactaaatcagaatctgcattttaacatgcatgtttgaaaaatgtgtgtttatagcacatttatttttctgttcattttatttattgcttcttccaaagtttttccagtctgcttattttatgctatcaaatagacataagatatcactggagttaatggctaatccttttgcttcatgaaaatagatgatcatttaagtcccccaagtatgaagcttctaagttagaaattctccagttacttgtacagtctaagtttctttgaatatggaaatttgtttctaatcattaaaaaaccttttattacataatttccaaaaaatacctattgtttttatgtggcatatgtcttatggttgtgagtgttggattatgctttttattatatactgcatatatatatatac

SEQ ID NO: 23927 - DNA, 1032 bp, Homo sapiens
ctattttgtatgctgtctttttaacctgtttcccccaacatgtgtgcacacagacactacattataaactgctttcaggcagtcactcacagtgcttaatatggccttgcatgttatagttcttaaaaaatgatgtgttaaattaactctagaactgttctattatgattttcccaataaataggttgtatgagacaaaaaaattccatgctctatcctatatgtgacctgcgtgtaaggcactgtactttcagatttagataaattcttttgtatcttttggggagtttgaagggataaaagtatgtgtttattctcttttcaagtatatttttaaaatacaagaagctgtgtacttaatccatagattgtagaatttattgtgaagagtctactctgttaaagcatagtatggagaggggactaaaaaatggacattgtgttaagacaaatcagttttctctttctaataaaacagttcttctgagtagtatttaattgaagtagacctaatagcaagtataaacgtttgtggggaaaagcatggtgtttactataaaatggattgacttatgtatgtatgcatgtaacatgcataagaaatcaacttttcaaagaatgtaagcacaacgttaacagaaaataaattattgggatttcttttaatccaagtctgtgaaaggtttgattaagggttttgtacatagtcagaagcttttgttatggtttctgggcaggggtattttatgtttgaggtcgggaattttctatccacataattagtcatgaggtttaatgtacattttttttttgtatcaggcagacaatgtcttcaaagagacagcagtgctgcaaaggagcaagaaaagaaggccaaagttgacacacagagaggcaaaacagtgtaggaaaaatcaacacgttttgcaaaatcaatcattgaaaatgtgtcagcattcaggagactgtctttaatttgcaatccaagtgaaatagagtatttaaatatgagaggcagtattattgagccca

SEQ ID NO: 23928 - DNA, 1079 bp, Homo sapiens
aaaaccaccaaatatggctagtcctatatataatttattaatagtgtttgaaaaaagaaaaaaagtgtgtcattttatatttacccttttgtgccagagacttttatatactttatcttattttgtcctttgaatagcctgttaaaataggtgatattatttttattccatagatgagagaataagctcagatgtcagtactttgttgaaatggtctctaaatgctttaaatttaaaaaaatgagcaaacagtaatcttgaagtaaaggactgccactgggggactgaatggctgattgaatcatgatacatccatatcatgtcatatgtagcccattaaagaagtccattagagctatactagttgccttagaaggattttgatgagatactattgaaaaaagtaagatggagaaaatacttataatatgatcacatttttgtaaaacaaattcctaagtgtgtgtgtttgtgtatgcatgcatagatatagaataggggctgatgtggatatataaatgaagggaaggaaagaaggtatggaaggtgccaaacagaacagaaaaggaagaagtgcacttaaagacatgtttataaatgtatagagacggtatatatgatcttatcaagaaacaaacaaatataaaattcatgtggctgggcacggtggctcatgcctgtaatcccagcactttgagaggctaaggcaggcggatcatgaggtcaagaggtcgagaccatcctggccaacatggtgaaaccccgtctctactaaaaatacaaaaattagctgggtgtggtggtgcatgcctgcagtcccagctacttgggaggctgaggcaggagaatcgcttgaacctgggaggtggaggttgcagtgagctgagattgcaccactgcactccagcctggtgacagagcgggactctgtctcaaaaaaaaaatcaagtgtgtacaataatttgttcaaggccatatggcaagaaagtcatggagtcaaaatgaattgcattcagtactatctaatttagaaagattttttcattatgtaaaacagtgtgaatggttcagtacagcat

SEQ ID NO: 23929 - DNA, 1034 bp, Homo sapiens
gtaaaccagcagtgtaaacaagagcagggcatgtatgagtagttgagaatggtgaataggagtatgactagacaaaagatagtagggatgacaagtttttttggggcacagtctaagttggtctggtgtccaatgagactggggcctaataaaaaggagcgtctatacaggagcttaaatgggctgtaccttgtagcattctgaggacaggcctgaattctgagaagcgaaagtggtaaaagtattgtccagtcctttttaagttggtggctgagcttggtgaggtgtgtttttaaaagacctttagtccgttctacttttcttgaagacggaggaccataagggatataaaggtttcactgaatactgagagcctgaaaaactgcttggctgatttgactaataaaggctggtctgttatcagactgtatagaggtgggaaggctaaactgaggaattatgtctgacagaagggaagaaatgactgtggtggccttctcagaccctgtaggaaaggccattacttattcagtgaaagcgtctatttagactaagagctattttagtttcctgactcgggacatgttgagtaaagctaatttgcccgtcctgggtgggggcaaatcctggagcttgatgtgtagggaagggagggggcctgaataatccctgaggagtagtagaatagcagatggaacactgagaagttatttccttgaggatagatttccacgatggaaaggaaatgagaggttctgagaggcgggctagtggctcgtactatagcatagcctgcctttgctggtgtgtggcgattaggcctggtggaactgccatcaataaaccaagtgtgttcagggtgagggacaggaaagaaggaaatatggggaaatggggtgaatatcaggtggatcagagagatacagtcatgggggtcaggtgtggtatcaggaataatgtgggaggccagattgaagtccgggccagaaacaatggtagttgtgggacttaaagagtgagttcagctgaaggag

SEQ ID NO: 23930 - DNA, 1047 bp, Homo sapiens
cacaaatgagaaaaatgtttttaaggctagtaagggaaaacatcttatgtcttcatgacattttgccagggaaaaattgtatacattaaaatttcaaataactggcattcagttaattggcattcttgattaattttcattaaaagtaaaaataacacctgtatttatttttaaaatttaaattgtacagaagggacaaaaatgaaaagtaaaagtttctctccactcgccactggaaatcacttaggtcatttattttacctgccctctttctttcccttctgcgctcctgctatctctctctttttctgtctccctcccgttttgttctattcaattgtattgtgaggtggtaaaattatttattttctaacttatcaatcttaggctactcatatgatggcctactgtgaagggcacatccattttacaccatcaccaccttccatatcctccaacttttctgcattctgatttgtgttaagttttataacatatacattctactctgtagccatagtgaagccttcctctacttttaaaaaccacaggacaattctacacattttaacccagtaaaacagtattatgttgtgtaaatgttattcaatgaagagccaagcattttggttggactttggcaaagtaaagataatactatctcactaaacttccaactgctgcaaaaggaattccaaacttccaggttcagtggaaatatatatttaaaattcagaagtcttttttttttaatttccagaatgtgtgtctatttatttatttatttatttatttattttcaaaggcagcctattctttttaatggataccaaattctttcaaattctttctgaagatactagttataattttaaaagctttccttgctgaatgatatcttttcggcattaactcttctgttctatgaattcttctaggctcttttcttttgtgctcttggtgtctctcaaatatgatcttggagctgtgttttctgcgtagctgtgtaggtaagcagcagcgggtggagtgtttgccaggtttttc

SEQ ID NO: 23931 - DNA, 1043 bp, Homo sapiens
tttgtatttttagtagagatggggtttagtcatgttggacaggctggtcttgaactcctggcctcaagtgatctgcccctcctctgcctctcaaagtgatagaattataggcattagccattagccactacacctggcctgaaggttgataattatatttaacaatataagtatgccttgccatttggaaaaattagaacgtacagtcaagcaaaatgaaaaaataaaagtaatctgtaattcctgatatttttaggtatatttaaacttccggactcctctgtgtactgtaatgtatattttgtttgacactagtttctgtgttagcctgaaacaaaggcttgtagaagatggtttatctgggaagcaatcccagggatttcattaatattgctgttgtaaagtgcattgctttttttaaattgattatttttcaatgtttgctaagtatatgttagaattacaatcgatttttaaaattgtatctgaaaatcttgttaaacttagtagcttttttgtagaatctttagaattttctatgtatacaattaagttttctgaataaagattattttactcattcctttctaattttagcctttttatttccttttcttgtcttattgcactatagaagacctccagtaaaatgaaatggtgagagtagaaacttctgtcttatttccaatttcggagtatgtatttccaatacatactattaaatatgatgttagttgtggttttttttgttgatacccttcatcagattgagatagttctctctctagttttctaagagttttttttaattattatcatgaatggatgttacattttgtcattttatcattttatccactgcatatgatatggggcagaggaaccccaaaattgaggcttagcctgagaagggttcatggtttcacccaggaaggaattcaggggtgagccggaggtgttagatggcaactttgtattttgttttgttttgtttggagatggagtctggctctgtcatccatgctggagtgcagtgacacaat

SEQ ID NO: 23932 - DNA, 1037 bp, Homo sapiens
gtgtggtggcacgtgcctgtaatcccagctactcgggaagctgaggcaggagaatcacttgaacccaggaggcagaggttgtggtgagctgagatggcaccactgcactccagcctgggcgacagagcaagactccgtctcaaaaaaaaattttttttttctgtcagcaataaagcagttttactttttttgtcattcctatattcactggagagtagcacttgtaatttctgtcaataacttttccttggcattcacagcttggttaactgattggcacaaggggcatagctttcggactatcataactttcaacatgcctttttcactgagcttaatcttttctagtttttgatttaaagtgagagacatacgactctttcttttacttgaacacttagaggccattaagggttcttaactggcctaatttaagtattgttgtgtctccaggagtagggagacctgaggagagggagagagatgggtaatgaccagttggtggagcattcagaacatatacatttaccaagttcaccgtcttatatgggctcagtttgtggtgccccaaaacaattacaatagtaacatcaaagatcactaatcacaaatcaccataacagatataataataatgaaaaagtttgaaatattgtgagaattactaaaatgtgacacagagacatgaagtgagagcttatgctcttggaaaaatggtgctgaaagattttctcaactcaaggttgccgcaaaccttcagtttgtaaaaaactcagtatctgtgaagtgtaataaagcaaaacacaacaaaacgaggtatgcctttatattttatttcattttatttttttagacaggggcttgctgtatctcccagaccggaatgcagtggtgcaattatagctcactgcagcctcaaccttctgggcccaagcgatccttccactctagcctcccgagtagctagaactacaggcatatgccactacacccggctaattttattttattttattttattttattttatttattta

SEQ ID NO: 23933 - DNA, 1029 bp, Homo sapiens
cccaggatggtctcgaactcctgagctcaggtgatctgcctgcctcagcttcccagagtactgggattacaggcatgagccaccatgctcggcctttttttcctttaataccaaatacccagaacattcactctgtagaaggttagaacaatctaataattataaagtttcatgtagtacctgaagtgagatcatgtgtaagttaatttgccttattcatgtcagggaatggccaaatcctgtgctgctgaagcaaccagaagaaagcaatttgaatttgcctgtctgggatcctcgggtatgtgatttattatggagtttctttaaagcttttaaggaagaggacatttcactaaattacagtctagttaaagatagttcctcttgtctctgttcttccttctatataactatagtccccttcctccttctgctgtggtttttgttttgttttttgtgcagatgattaggatcactaatgctgatccaaatgttatgtcattaaaaatcgcccatgtaagatgagtgggtgtcttatggacagtgtcataatccagtgtggaaaaaatgtctcaaaagtaattggatacttggctgggcatgatggttcacgcctgtaatcccagctctttgggaggccgaggcgggtggatcacctgcggtcaggagttcaagaccagcctggccaacgtggtgaaaccccctctctactgaaaatataaaaaattagccgggcgtggtggtgcacacctgtagttccagctactctggaggctgaggcacgagaatcacctgaaccccagaggcacaggttgcagtgagccgagactgtgccactgcactccagcctgggtgacgagttgagacttcgtctcaaaaaaaaaaagtaattggttactaataataaagtactaaagtataataaaagatttactttgcaatacaatttaaagcaaattcattgttccagggtagcataattctcccatatcttgcattttaatttgcttttagagtgagtgctcattc

SEQ ID NO: 23934 - DNA, 1025 bp, Homo sapiens
ccttcagtatggttttactcagacaaatgatctgggaccaaatttgcattctacagctcccaaacctattgagaaaaataaggaagatataggcagttcaatctaggactaaaatctcattttcattaatcacaagagataatttgcttaagtgaccttcagaattgaaaccagtctttatattgtcatttgcattttgaaatcctaaaatcgttcccttctttcagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggtctgtctttatttcaaatgtgtccttttggttttctgttcagtttatttgaggataatgtgaacttttctatacctctgctactgccttttaaaattgttaaaagatttcattttactggctgctggtcaatttcttgcttagaaataactcgtggtaatcctgtgggaaacggtataggcttatgagcatatgggactagataggtacacagaaatgtacacatttgttgcttaaatttttctcttcttactgggtcctctgcatttttcccccttttagttcaatgaaatgttaaagtacaggcctgagccaacagttgtggccaggcacggtggctcaggcctgtaatcctagcactttgagaggtcacggcaggcgaactgctggagcccaggagttccaagaccagcctgggtaacatggcaaaaccctgtctatacaaaaaaatacaaaaattaattggccgggcacagttgctcacgcctgtaatcccaacactttgggaggccaaggcgggcagatcacctgaggtcaggagttcgagaccagcctggccaacatggcaaaaccacatctctactaaaaatgcaaaaattaacagggtgtggtggcatgtgcctgtattcccagctac

SEQ ID NO: 23935 - DNA, 1063 bp, Homo sapiens
acactcctgccacttctaccctttctcttatccctctgcttttcacctctgactgtaaaaagaagtagcagttccgaaagcaagagttccctatgaacacggaaggaaatattcattgcatacttgagtgtttaggagctagagggtttgggagaaaaactccccaagttttgtgactgactttctagctgggcctttataatatatatgatgtgcttttccttttttgtttcctctttctttctaatagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccat

SEQ ID NO: 23936 - DNA, 1034 bp, Homo sapiens
tggcgcaatcttggctcattgcaacctccacctcccaggtgcaagcgattctcctacctcagcctcccaagtagctgggactacaggcgcccgccaccatgtgggcctggctaatttttgtagagatggggtttcaacatgttggccaggctggtctcaaactcctgacctccagtgatgcacccgcctcggcctcccaaagttctgggattacaggcgtgagccaccgtgcccagcccctattttttctgaaataatttttcggatatacttttatatttgaaattagttgaacataagatgatcatcaagcttgctataagttttaagctattgctacatttgaacaaagacccacgtacttatcttagaaagtacttaggatatctttgagattaatggtgctacatcactctacagtactatgtaaaatgaatggagctgctgttcctttctagctagctgtttgtgtagttcatattaatttaccctgccttttatttggattgtctgatttcttagttgtacacatgaacctcattatttgcctggaataagtaatcaaataaaattgctttgataaataggtgatgattgagtgatgttatttgggactaactcaaaagtaccagaagtcttaacttttcagtgacaaccaattttgtcatttaccactcagactctttttggtagataatggtatctactacccacttagtatgaatgcaaagctcagacctaatgtgcatcacacagaatcatttattaaacgtttatcagcaagcggtggcacaacagtttatacagtctgctctataaccttaatggagtgtcccagctttctgtcccttttggtggtctgaccaccctttcatgaaaaggccacttgaggtgtctatgtcaagcactaggggcaaaattctgtcacccttctgatcaggatcaggcaatcagtcctccgtactaataatggctggacacaggatcaagctgtgggtactatgcatacaagtacaggttacagggctcgttac

SEQ ID NO: 23937 - DNA, 1058 bp, Homo sapiens
tttttttttttttttttgagactgagtctcgctctctcaccaggctggagtgcagtggcgcgatctctgctcactgcaacctctgtcttctgggttcaagtgattctcttgcctcagcctcccaagtagctgggactacaggcacgtgccacaatgcccagctaatttttgtatttttagtagagacggggtttcaacatgttggacaggatggttttgatctcttgacctcgtgatctgcctgcctcggcctcccaatgtgctgggattactgatgtgatctcctttttttttcaaggcttaacatgtaatttaacaagttgatgctgcattgctgctccatttctcagaaaaacttcaaatttaaagtatcagcaacaaatcaaacatagtacatcaattaaatatgcacagcataactactatctaagataggcaaggctaagagctactctcagaccttcagcatacagcaactctgtttccaagattgtactaggcctatcaagaaaagttgtgaacagcaacatcatagacacaaaacggccattcctggttgtccttatccaagaaaaagattgaggcaagttaacacaagatttttaaaaaagatacactgaaatgaaagtctctaagagaaaatgtcttccttaggacaagaagggataatatatcggatataaaagaactatacgtacattgtttgtgacctctgtggacatttgcctgaattctcacctgggagtgaatggagcagtggggcgaaggtcattggaggaggttgtgttttgtggtgtatgtggcagtgtctctggggttggggagtgtatggataagaaagcaaatgaaacaggatggagaaaaaaagaacgatcaagattaatgggtctctaactggattcatttcactgtagttcccccaggtcttcaacagtcacatttgagacctcagtaatgcaccacagagaactcatcagttaaacaatataccacacagaactggtttgttaaataccactcctcccttgccctcttcctccaaaatactccctacagta

SEQ ID NO: 23938 - DNA, 1034 bp, Homo sapiens
ttattaaactaattcttggaaatttttgtgccaataatggccaaagtggagaggagaaaaataatagtaataatttatttattttatgagcaccttttgtatgccagacagtgtgcgggtgctttatacatagtattatttaatcctcaccgtaactccaaaggttaggtattgttttccttacagtatagctgagaccattggagccataggttgcacactgctagaagtggtaaagctgggtaagaatctgtagctgactctttctagtcattttgttggtggcatacttcattggaatgttactgtctctccttttatctgtcacattaatctttttgaatctgtttaatctgaggatctctggagtggtagtgctgctacacacattatgtagtcctcactctttgccaggtagcactttccatatatcctcagaagtatgtaagctagctactattattatctttgttttacagatgaggaaattgaggcacagagattaactaatctgaaccagataatgccataagtagtagaactgcgatgcaaacttggacagtctgactccagagtctgcacacttaaccactccactattctggccttctacaaggtacatctttggttggtaggaagctgtgattttagtgtgctaaatgtttttctgtttttgtttccttttaatgttcattcaaatacatgtaggataactttatgttgtctaccagctgatgtcctctaccagtgtcttatgtaaacaatgacatagtactaattataattaacatttattgagagcgtaccacattcacgacccctgtgctgtgttttaaatattccacataaccctcagcacaatctaaatactattatttatgcagcatctcatttgtgagatacttatatcatcttcaaagtgctttcacaaaataatccctttatttctttccacgctgtcagtcagaggtatgaccatcacctacttgtgttgctgcatttcagcaaggttcgatgacttgccttggctagca

SEQ ID NO: 23939 - DNA, 1111 bp, Homo sapiens
gtctcaaaaaaaagaaaagaaaaaacatgctgccttccctttatcttctctccaagttttacgtaatttttcttaacatctcgaatcctccaatgaaaaagctggttctttagcaattttgtgtccattttaattagtaaaggagaaaattctacaatgtttcttttcaacagtttgattgaggtataagttatatgttacaaaattcacccattttaagtgtacatgtagatgagttttggcacacagatgtgtaaccaccaccaaaataaaaatctagaacatcatttcaaaaagttccttcgtccccctttgtactcagttccctttctccagttctgctctcaggcaaccatgaatctgttttgtcaaaacaatttacctttcttagggtttcatatgaatggaatcatgagtagttttttgttcctggcttctttcacttagtatgaggtttttgagattcatccatattattgcatgtgtcagtagtttattcctttttattgcagagtagtattccattgtatggctataccatactttgtttatccattcccaatttcatgggcatatgggtgctttcctcttgttggctgttgtgaataatgctgctgtgaacatttgcatacaagtctgtgtggacatgtgttttcatttttcttgagtagatacttaggagtgaaattactagatcatatggtaagtgtatgtttcactttataagaaactgccaaattgttttgcaaagtggccgttttgcatctctacaagcagtggagcagtcccaccactgtgcattcccaccagtagtgtatgagagttccagttgctgcacattcacatcaatacttggtattattggtctttttaattttagccattctagtgggtagatagtgttaagcaacttttcatgtttttactgaccatttatatatcttttttatgaagtgtttgtttaaatctttggcccatttttattggatcatttgccttattattgaattgtaagatttctttgtatatactttagatctaagtcttttttgtcagccatatgtttctcaatatttcccctagtctatgccttgccttttaattttctttt

SEQ ID NO: 23940 - DNA, 1057 bp, Homo sapiens
gcctgccgaggccacctgacggcggtgtcgcgtctacactgccggttggactctcaggcacccgctactcagcgccctgcttcccggcgccgggaatcacgagcccgccagcaccgcgggacttgcagcgccctccgcccttcgcaggcggcccagacagccccgtcccgccctagcgttaggagacgcgcagcggaaccccggcggccccagcccctccccgcccgcgcgtccccgcgtccccgcgtccccgcgcgacccgcctcccagatcccggctggggctcccgggcgcgccgcggcagggcggggcggggccgggggcggggccttctggcagtttctgggagctgcgaacgcgccgccccggggctcggcggccggaaacgctggcttcggagccttaggcgccgcggcctttccttgttttccgcccagtccacgccgccatggccaagtggggccaggggaacccccactggatcgtggaggagcgggaggacgggaccaacgtgaacaactggcgctggcgcggctggcggcggcctccttccgggatctggggagggccgggccgcgggagccggggctgccctggggtctgtgcggggccgcggggccagggggtcagggggccgccccccctcagctgctggacgcagggctcggccttcgcctctcggctcgggagagtccttgagtacggagaccggctaggagggttgcagctgcctctttttgaaagttgggttgggccccaagagtgacttccgacagacctttccactcccaccgtctgtggcctgagggccttcccttctcctcccgcccacccctctggatgtttcggggagttagaagggagctggattgagagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacc

SEQ ID NO: 23941 - DNA, 1032 bp, Homo sapiens
caggcaaagagtaccctgggacaagaagaggaatatgggtgcacttgccccacactcctctcaggacggcggactgctgactcctcatgccctctccttggccatggcctgcctgacctttcttccgtggctgctcagggggccctggagtggtggaaccctgtgagggcagctgagctattcagtgaggtagggcagtttttcataaaatcaatttttttttcttttttgagacaaggctcactgcagccttgacctcccagcaatcctcccacctcagccttccaagtaactgggaccacaggtgtgcgccaccatgcccagataattttattttgtagagacagtgtctccctgttgcccaggatggtctttaaactcctgggctcaatccatcctcaccacagcctttcaaagtgctgagattataggcatgtgccacagtgcctggcccagttgttactttgtattataattgaagaacccattttgctcattttaggcatcgttaaagaatctggagtgaagcacaagggattgattgaaatacccaatctttctgaggaaaatgaagtagatgacactgaggtatgtgatcaagtttctatttcttttgttcttttttcagtcaagcttctgctacagacattgggcatttcaaatagtgttgatcagactgtgtggttcctgtgtggtagttcgggtgccttgtggagggcctgtttgccgagaaggattgccgtactgtgggggcagcgtgttgtgtggagctggagtggtacaggaaagagagtaagccccaggaagccctgagctcccccgaggaccaggcaaggggcctgggcagctggctgcaccctccttagcctcctcatctgtgaaaaggggttaatttctcttccaggggtgttgtcacgttagatgtgacagtgtgtgcactgtaaactgctcaggcagcttgcatggcttgatgaatgtgactctccctcttctcctgcacctttgccgtttccctttaatggtgaaaagtct

SEQ ID NO: 23942 - DNA, 1039 bp, Homo sapiens
ccctgctaattttttttttttttttgagacgagatttcactacattccccagtgtggtcttgaactcctgggctccagtgatccttttgcctcagcctccccagcatctgggattacatgtgcaagccactgtgcccagcatgtatggaccttatttggatgcctggatttttgaagacactaaggagttattggatttttaatttgttattatggtattatgcttaacattattttaaaagagcatccctatcttttagagatacatagggaaatatttacaaatgaaattatgtgatatctggaatttgagtctagttaatcctgggtggagaatgtgggtaggggagacaaagacaccaagatagcctatgaattgaaaattgttaaggctgcttgatgagttcttggagattgaccctatcaatctgcttcttttacataagtacaacaagtcaaaatttaaaaaattaatagaagcaggacggtggccacggacatcagaatccactaaggactgtgtaacaactcacctgctgacaaaattaatagaaaagagaaagacagcattgctcctggccttcaatatatcagactcagagctaatgccaaaattccaagaagcatttttaaaagcaacacaaatctggtgttgaatgtctacatcttgacagtttgaggcttgaaggagcagttgttcctcatggacggtggggagccacaggcagagctgactttagaagctcagggcgttttgtcctggttgcatccagacgatccagacagcagggacaggaagtaatgacaacaaagacttattccatttgagtattgtcctgtagtacttggatttccaagaagaaacttggattcagggcaatcctttttgcccaagcctttttaatttttggctctcgttccagcgctctcacaataatgagcagcacaattcatgagagtaaactggatttttattgaatgaaagtaaagaacacaactattcaatgtagaccagagctctccagtagaactttcaatg

SEQ ID NO: 23943 - DNA, 1014 bp, Homo sapiens
ttatcagttcattggtggagatgcccttactgggcaagtgttcttctgaaaacattttatctgaattacatgtccgagataactgtttccagttcaataattatttgaattactgcagtcctaaagaatgtctagtgataaaccttatcaaagcaggagatgtgtgaaggacacagaatgactttcagaaagtccttggaaactgttcttatctcacaagcatgggcctcctcttctttgggcgttcccggctctattttgtcggggtctagcaaaagttaatttcatcttgctatctgcaactttcacagagaggtgcccttcttatacctagaagaaaggaacatctctcactctgaagacacatagacaccaagaagagtctcagcaaatgggccttaatacatttcccctagtttattaccattatatcatactcttttgccctatcatatttctccacgactctcctctctccatcaaacctagcataacaatattcaggttcaactgtttcttcaggtctacacttccttatgaaagctcttgtgtcatatacaacttaaatttgtaaggccaggtgcactggctcacacctgtaatcccagcactttgggagcccaaggcaggaggatcacttgagcccaggagttcaagaccagcctaaacaacataatgagacctggtctttacaaaaaattagttgggtatggtggtgcatgtctgtagtcccagcttttctggaggctaaggtgggaggatcacctgagcctgggaggacaaggctgtagtgagctagtgagctgtgattgtaccactggactccagcctgggtgacagagccagaccctgtctcaaaaaaaaaaaaagtatgcttttcttttgttcacctgttttttatcataagggactcagccataaacctaagatggggggagggaaagatatttttcctcccctacaaccttttctgtgtaattatgcccagatttatgaaaagtccaggtgactgct

SEQ ID NO: 23944 - DNA, 1130 bp, Homo sapiens
agtggtgcaatcaccgcttactgcagccttgacctcctgggctcaagcaaccctcccacctttgcctcccaagtagctgggactacaagtgtgcaccataacctagctaataaatcaacaatattaaactatttttttcttttttctatgtcctgcaggcattaactccaaaaacacatacatttaaaaaatatttaagttagttttctatatttttgagagtttcgggactacttaatttatgtaagtgcttattttctctaagcccattatttagaatggagctcttttattaattgggtaataccatctggaggtaggaaaatatcacatgtgcataatatatatacacatatacagacaaaagcagagaatattatgactttcactctaaaaatttagtctttagtcaggcataaatacagtgatacagaattcactagtttaaatataagagtctgttcttgtctttgcctcactttatttttttatctgaaatatttttctagtggatagaacaaattgctcaatatgagggctaaaactttttaccaatatttgcagaggagacttttaagactttgttttgtcttgttgtatttatggaggatgtagactaaattctgttcccatttatcatttttagccccaggtggttgctttcaaggtccctgagtccccttcaagatctccctagggaaggagcagaatgcctaaaattccagtgactacagggacttgaggaggtggagtctgaagggatgggtctcagaggagccagcttgggagatatttaggttttctcacagaagccattgaagtgctgggcacggtgtctttgcacctataattccagttactcaggaggtggaggcaggaggatcacttgagtccaaacccagaagttcgagaccagcctgggcagcatagcaagaccctgtctcttaaagcaaaaatttaaaaatgaagccattgaagttctaaattatgcttagtaaagttatgccaataagaaaggaagggaaagagctagtgctgccgtggcagagcatatagtcagcagggttttgacaaggaagggtttcagttgactgagaaattcccatgagaagagcagggtgaagtgtaga

SEQ ID NO: 23945 - DNA, 1043 bp, Homo sapiens
gatactggcctccgtccacacacacacttcttagtctaaagaaaacagcctagtcttcttagaatatcatttaaaggctgggtgcaatggctcatgcctcttatgctaacactttgagaggccaaggcaggcagatcacttgagcccaggagttcaagaccagcctgggcaacatggtgaaaccctatctctacaaaaaattaaaaaaaattagcagggcatggtggtgcacacctgtagtcccagctgcttggtagactgaagtgggaggattgcctgggcccaggagtttgaggctgcagtgagctgtgatcatgccactgcactccagcctgggtgacaagagtgagaccctgtctccaaaaaaagaaaaaaaaaagaaaaatgaaggtatcttttggctgtgtggctctgttcatgtaattctttaaaaacgctgacttcaggctgggcatggtggctcacgcctataataccagcactttgggaggccaaggcagaacgattgtttgagttgagaacaggaggtcaagatcagcctgggcaacacaggaagaccccatctctacaaaaaatttttaaaattacctgagcatggtggcatgcacctgtagtctcagctacttgggaggctgagataggaggatcactggagcctgggaggggagattgaggctgcagtgagccatgattgtacctctgcactccagcctgggcgtcagagcatgacctatctcaaaaaaaaaaaaaagtctgactttatgtggaggtaagatcatgggtagcaggcccatacgcatcttttcaggtacttccgtcttcccaacacatgtatattgatgaaaggtggattcttattttccctgcttaggtcacatggcacatggctacccagggggaagtcactgttcattggaattagggtaatttagggaaggtataaattgacagctgataccacagggaataagtgaggagcagttcaccaaaggaattaggcatgctggacaaacaaaaccaatatgatacaaaggtacttttgt

SEQ ID NO: 23946 - DNA, 1065 bp, Homo sapiens
ccctgggctcaaccaattggcctaacatatattgggcagttgcattacctgtctccctccttattactgcagtaatcagctatgcacacttatttgaaattagcatgattaatagccctccacttgactccattcatacaatcacagatagctgtggtaaaaatcagcagcagaaaaataccaaggagaggctctctcaacattaagagatattcctattagtgaagtaaactaaatatatttttcttgtagccaaagtacgttataccaaaaactgaatttgatgtagacttttcttttttttgagacagagtctcactcttctgcccaggctggagtgcagtggcatgatctcggctcactgcaacctctgcctcccaggttcaagtgattcttgtgcctcatcctccctagtagctgggattacaggcatgtttcaccacccctggctaatttgtttatttttagtagagatggggtctcgctttgtcgcccagactggtctcaaattcctgagctctaacgatccacccgcctcagcctcacaaagtgctgggattacaggcgtgcatcaccacacccagccaagacataacaatttatattaaaattttgaaataacaaaattacagagatggagaacagattcatggttgccagggattagggatgtagaacaggaagggtgtgagtacaaacaggtaccataaaggatcctttgataatgggactgttatgtatcttgactgtcgttgttacagtcatctacacgtgataaaactgtatagagctacatacacacataagcagatacaaatggcaaaatctgaataagctttgtggactgtaccaatgtcattcattttcctagttgtgatatggtaccacagttatgcaaaatgttaccactgggatagtctaaatacaaggtaagtggaatctttcatatatttttaaaggcattagttgttatttttattcattcttttaaaattgacatataattcaaataccataatattcgcccttttaagtgtacaattcggtggggtttttttttttagc

SEQ ID NO: 23947 - DNA, 1049 bp, Homo sapiens
atgcctataatcccagcactttgggaggctgaggtgggaggatcaccttaggttgggagtttgagcccagcctgagcaacgtaaccagtccctgtttctacattttaaaatctcaaagtttttcaaatgaaatagaagagaacttgagagtgaatgacatggaactgcacacaatgcgtcacacatgtaaatagagttttgtgtatgtatgtgtatactaaacacagtataaaaatgtatttgttataatttaggcaaatcggtttgccaagcactgtatgtgccattgtaagcaaggaagttgaactctcctgaggttatttagtaataggtatttctagcttcagcatgtctcaaacagtcacttacatagtgcttgctgtgagccacgcgctattttaaaagctttccatataacatcatatactcacaaccatcctttgaagtgggcttgattcccattttatatatggagaagttgagacagggactatcccacttgcccatgatcacaaagctagaaaggaagggccaagatttgaacctaggcagtgcaagtgtagagtctttgctgtaaaccactattcctggggagacaggtaaaataaattgtatgtgcaaatgcaaattgataagtaattgatacaatactccacccctttattccagatatgagaaatgagtgttggacgtcgaagaataaagttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgag

SEQ ID NO: 23948 - DNA, 1079 bp, Homo sapiens
caattaataagcttgatttaacatattatatattataattatacacaattataatatgctgttattattatatattttgtaacaaatagagaatactttttattttcaaacattcaaggaacattcctgataattgaccatgtatcatcaagaaatgtgaattgcttgattgtatcatcaagcaatcaaaaaaattgaaacaaattacaaaaacaaattacagggactccattacaccatgatacaataaagctaaaagagaacaatcagtagaatagccaaaaaacaaacaaacaacaagcaaacaaaaaaacccacgcctactctcttagaaaactaaaaacaccctttaaataactcttgggttaaatagataatcaaaactaaagttacaaattacttagaaaattaatgacaatgagaacactttatatcagaattggtgggaggcaattaaagaccaattgaaagacaattagtcgtttcaaaagcttttcacaaaagggcaagaattggaaacaactgtacaaaataactgcacaaaacaactgaagatggagaaaaagacgactcttagagatgtcagaaaaagtcgtctctaaaaagttattttgatctcactctctccaaaatcaaacaaaaaaatgttaaggaaaatatgtagaaaacccagtcttctacaaaactagaaaatgtgcacaacctcaaacctcaatcatgaagaatgcttggcatctacgatgaaatcaggatcaatctgaaggctcagcactcagtgattatttggctatttggagaagtaaacatttgtgggtggagttaatggggaggaggtggggcttaagattttgaggtcttaggccctgtgcattttattcccccctgagacagggactcactctgtcacccaggctggagtccagtggcaaaattatggctcactgctgcctcaaattcctggactcaagctaacctcccacctcagcctcctgagtagctgggactataggcatgtgacaacatgccttgctaattttcttatttttgtaacgatgggatgctcctatgttgtctaggct

SEQ ID NO: 23949 - DNA, 1049 bp, Homo sapiens
gggctgctgcttcgccgtcccagccccgcagccttttgtgtctttccacttctcccctggcccgctgcgctctcgctctagagaaggcagagactgccttgggtgtggcagccaggagtggacggttgcgggctgggaggctggccgggtttcctccccgtcgcggacctggaggaagggctgggtgcggcgggaaggccccggagggagagctgagcctgggttggtagcatggtgaggaatagcggcctcaggggcagagatgtccgtttctttgtgcaccgaaagctctgagaaggacatcccgataccagtgaacttctagatttggaatgagcttcttaccgagcatctcacattccaaagtgcatctgattcggaagtcctcgtggttctaccttcggaaggtgggggtggggtgggctgcctgggtgcagagggctgagccaggctggtgggaactcctcagcgtccagcacctgtggggctgcagcaagcttttgctgctaggctctaaacgaagcctgtaattaaggccttagtttaactgggtgcgctctcacttttatctgtggcctggcctgagcggttgcctccagcagcctcagctaccctcactgctttgccgctgaacccaggaacggctattccactgcaagggagctaagaccttcatttgttgcaccaacgttttcctcatggcttatgtctctagcctcagagaaatcagagattagagcccagatctggggtcagaaaaagacccgggtgttagatctgactttgctactagctgggtggcagaagatgggggaacacttcgctcctttctacctgtttcctccccttgttaaatgcggaggctaatgacacttactgcagatggggaagctaacagcacttactgcagagggtgttgtgaggaatcactcagcaaattcttgtaaagggccaaggttagaactcaagccttttaaaatcccatctcttagtctgggcggatcccaggaaggtgtcaagtccagctgatgggcataggtgtgtccgtg

SEQ ID NO: 23950 - DNA, 1026 bp, Homo sapiens
ttaaatgagttaatacatttaaaatgcttggaacagtgtcagggacatagtgcctaatagatgccattattatgtacagaggtcgcagagggaaaaacaattctttaagggtagaggatgagttgttgggatggcttcctgggatctgagctgggttttgaaagattcatagttgttgtccaggaagccaagggagaagacgtaaaagacattctagactgaagcaacaacctatgcagaaacatgggaggcttacctagcatgggatgtgctggaaattcaagtagtatagtttgatattaatggggtttaaagtgtaggattggggggcatgcagtgagatatgaggtttgagagtcaggcaggactgaaagcatgttaagttatgtgctgttaataaatgatttggggattattctgtaggtgataggaacatagtaaaagattatgagcagaagagacattaggtttgctattggaaaatcaccaggacaacagtgtagactgaggatcatagtaaaaaggtgactggaagcagcaatattagggtagctgttttaataaataaggggagacaaaaggttaggactaggcagtggcaaagggaatggagagaattaactggaggaacactcagaacacaaaatgggtaggatttggtggtcatttcagttggggatctgagcaagatggggatgagggagaagaaaagggctagattgacatccaagcttttgtgttggaaatttggatgtatttgaccaagctggagaaggtcgtgattataggtgtttcttaacttggcagtatactgggagcatcaacgttaagatggttaaattttaatctttttcttaagggaaatagaacattatcaggtgattcctcagttagaaaatcagtttcttcctcacagtttgcagccttcctggaattttatttccctagagcttttaagttattaatttttaaataacaatttaagttattgctaatgtgtctaaaggtaaaagctacagcgaaaat

SEQ ID NO: 23951 - DNA, 1027 bp, Homo sapiens
tatagtcaattcaacagatgcagaaaggaacatttgacaaaattcaatgccaagtttcttagcaaagtttcaatagaagagaatttatttattttgataaaggacattcatgaacagctacagctaacatcatatttaatggtgaaacattgaatacttttcccctaagattgggaacaaggcaaggatgtttgctcttaccattcaacattatatttgaagttctaccaaactcacaggatataagatcaatatagaaaaatctactgtatttttatatatgaacaacaaacatttggaaaatgaaatttaaaaaatttcatttacagtagaggtaaataaaaaacagactaagaaataaatttgacataagatgtgaaaaacctctgactaaaaagtataatacattactgaaagtaattaaagaagaccttaataaatggagagataacctgtgttcatagattagaagatacagtattgttaagatatcatttttcctcaaatcaatctgtaaatccaactcaatgccagtcataatcctagcaggtgttttttaaaaataaagaaattcaaaagtgattctaaagtatatttggggatgcaaagtaaccaaaagaatattgagaaagaactgaattataatagtaatgctacctgacatgaaaatttactataaagctgtagtaatcaagatagtgtcaaattggcataggataaatagatcaacagaacaaaacaaagtcctgaaatatacccaagcttggccaattaatttcaacaaagttgtcagcataatccagtgggggaaaaggtcttttcaataaatgatgctgaacaactggatgtttgtatggaaaaaatgaacctcaacccccacctctccacatacattaattcagtgtgttcattataattaatagcaaacattaattcaagatagatcatagacctaaatacaaaactgtaaaatgatgaagcttctgaaaaaaagcaaaacaaaaacctagaaacctgtgtttctgac

SEQ ID NO: 23952 - DNA, 1147 bp, Homo sapiens
aataacaaaggatcagtgaactgtggaacaacttcagtggcctaacgtgtgtaaagaagtgaagagaaggtaagaggacagaaaaagtatttgaagaagtaaacaccaaaagttttagaaataaaaaaatttaaaaatataaacaaacctacaggtcaaagaagccaaatgaaactcaagcacaagaaaaatgaagaaagtcatagcaaagcttgttaacaaaaacaactcaagccagaagacaatgaggtgatattcttaaaggactgaaggaaaagtataacaacaaaaacctgtcaacataattttctattcccagcactccaaaaaagcaaaatgatactacttgaaaatttggatttacacgaaggaaaaaagcacatgaaatgacaaatatattagtatatataaaatacttgtcttatttttaaaaatctctctggtagataattgtttaaggcttcaataatgtattctgggttttataacatatagaagtaaaacgttatgatggttgtgtaaaggctgagtagcagaatgaaaggatactgttttaagcttcttatacataatgttacttgaagacacttttttcagagttgacaattgtttatatagaaaagcataaggaatctttaaaatgggtactaaaactaaaaagtaaatttagcaaggttacaggctacaatattaatatataaattcaattgtgtttctctgtagtcacaatgaacaatcagaaatcaatattgaaaaaaataccatttatagaagcatccaaaacaaaaaactcagggataaatttgaacaaagatgtgcaatatgtatataccgaaaacaacagaacgttgctgagagaaattaaagagtgaaatcaatgggaaaaaatacaatggccatggattcaaagatataagttattttcagtcaatttataaattcagtgccatcccaatcaaaattttagcatgctttttaaaaaaataatttgtcagctgtttataaaatgtatgtggaaatgaaagggacttagaataatcaaaacaactttgaaaaagagcaaaatttgaggatttatactatctgattttaaaactcattaaccaagacagtgtggtattagtttactaatagactgtaggtgact

SEQ ID NO: 23953 - DNA, 1032 bp, Homo sapiens
cataatggtaaggggttcaattcaataagaaggcttagctatcctaaataatatgcacccaacactggagcacccagattcataaaacaagttcttagggacctacaaagagataactatgcaataataattggagccttcaacaccccactgacaatattagacagatcatccaggcagaaaactaataaagatattcagaacctaaacttgtcacttgactaaatggacctaacagacatctacagaacactgtgaccaacaacagaatgtacattattttcatctgcacatggtacatactccaaaatcaaccacatgctcagtcataacacaattctcaaaaaattcaatataactgaaatcatactaactataccttcagaccacagcacaataaaaacagaaatcaatactaagaccatctctcaaaaccatgttggaaattaacctgctcctgaatgacttttgggtaaacaaataaggcagaaatcaagaaattctttgaaacaaatgaaaacaaaaatacaacataccagaatctctgggacacagctaaagcagtattaagaggacagcttgtaacaccaagtgcccacattaaaaagttagaaaggtctcaaattaacaacgttataccacacctagaggaactagggaatcaagaacaaaccaaccgaaagctagcagaagatgacaaatcttcagccaaaatcagagctgaagtctatgaaatcgaggcttgaaaaacagtacaaaaaaattaatgaacccaaaagttggttttttgaaagaataaataagattgacagactgctcgttaggctagtaaaagagaagattcaaataaataccagaaatgacaaaggagacattaccaccaaccccatagaaataggaaaaacattcagagactattacaaatccctctatgcacagaaaacctacaagatatgagtaaattactggaaacacaacctcccaagactgaaccaggaagaaattgaaaccctgaacagaccaataataagg

SEQ ID NO: 23954 - DNA, 1032 bp, Homo sapiens
acatggtgttttcagtcctttgttgttatgagcaatgctgcaatgaataaccttgtacatatattatttcatatatgttggataaattttctgaagtgagtcaaagtataaatgactgtaattttgatagtcattgtcaaaaggccttccaaaggggttgtaccatttgcaatcagatctaattctatgacttaaaaaatactgtctctttagttatgtgtttcaaatttgtatctctagttcccactttttcctgagctctgcctactcagcatttctcctggtgcaaaattgaactatatttttcttccaaacttcttctcaacatttctcttgctgcaaaattgaaatgtattttccttccaaacttgctgtttcccctgtttttcctatctcctagaaaatggcattgcctttcatgcagttgctcaggaagaaaacttaagagccatttttttctcctgtttcctataaactacctatcctagttcaaatagatctttatttgatggtggaaatgttctgtatctgcattaatgtagtatccacaagctacacgtgactgttgatcacctaaagcatggctagtttctctaaagagctgaattttacagagtgaaaaataaatctaaaggccctgaggctagaatgactgagcatgaggaccagaatactaatggaacaaaaaaggcggtgagcggaaagaaacaagtttggagagagaggagatgaccaggtcacacagggcctcaaaggtcacggtaattttattctgcaggttatgggaagccattggtgggttctgattcgcgggagtgacataatctgattaataatattaaaaatcattccagcaagacttccagttccaaaagatacttgggagatctttctactgcaaaacagtaagatactgcataaaataaagatttttattgaattgtcaggcacagttattgttttctttaaataacagaaaacctgaggggtgagccgtgagctctcctgaaagacagagttaaccaagagcag

SEQ ID NO: 23955 - DNA, 1069 bp, Homo sapiens
cacaaaaatggaaagtcatcccaacctcatggatcagatgaatatcattaaaatgaccatgtagcccaaagcgatctacagattaaatgcaatatctatcaaaataccaattacattcttcacagaaatagaaaataaaaaacagaatttatatgaacccacaaaagacctcaaatagctaaagcaatcatgagcaaaaataaccaagctggacgtataacactaccagacctcaaagtgtatgacaaaactattcttaccaaaacagcatggtactagcataaaagcagacacatagaccaatgaaatagaatagagaacccagaaattaattcacatatccacagtgaactgatttgtgacaaagacaccaaggacactcattggggaaagatagtctcttcaattaattgtgctgggaaaactggatattctggaactagactgccacctctcaaaatggatcaaagacttaaatgtaagacctgaagcattgaaactactagtagaagacatagtggaaacacttcaagacctcaaacgcataggcagcaaaagcataaataaacaaatgggattacatcaaaccaaaaagcttctgcacagcaaagaaaacagcagagtgaaaagacaacctacagaatggaagaaaatatttgcaaactactcattcgatggaggattaatacccagaatataaaagaaactgaaacatcccaatagccaaaaaacaattgaactcaaatatgggcaaatgacctgaacagatatttctcaatagaagacatacaaatgaccaaaaaatatattttttacatgtccaacattactaatcatgagggaaatgcaaatcaaaatcacaaagagatatctctttccagttaagatggctattatcaaaaagacaaaaacaacaacaacaaaaaaacaaatgctggagaggatgcagagaaaaggaaactcttagatactgttggtgggaatgcaagccactatagccgctatggagaacactatggaggtctcacaaaaaataaatagaactaccatatgatccagcagtcctcct

SEQ ID NO: 23956 - DNA, 1070 bp, Homo sapiens
atatagaatatatattagcctcatacctaatgagaatatgttctaataaaattataattaaatttaatccagttttagacagtaaagatgtatttccctcatgtcaagatttatatatttgttccacagtttctagtcaacattaatattctctataggtaatctcatgaagctacaatcttattcataatctctattatttcagcagattgtctaacctttcattagtttacaaatgtagattacccgttttttttttggcttctaattctgtatctttgcttttaagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatgtgaggagcattggttaaaaaagaccataagttgttcattgtaatcatggggaggagggaagtaatttgcttgtatttctgctatgttatttttctacggactgtacattgtgaatacttggtgcacttactgaactgataaagataaattcatacttgtaggaccatttgatcattattcctacagagcagtgttagtgatgaggaaaagtaagatctgggaatataatttccacatatacatgaataatctgttttttgttaatttatattttataactgtagttgtactctaagattgtattttgtcaatggaagttaattttgttggaaatgtttgaatataatactgatgtctattatttattgaatacctactaagtatttcaggaacaataattttgttttacttaactccatggagactgaggccaataggcaaggtaacttgtacaaggtcacagagtcaataaatggtgaatccaggatttgaacctgagccttattagattccagagtcagtccactttcctatcatatactgccatccttgtactaaaccacatttttatatatatttttgtgtagtgcttcacagataataatgaatgtataataacaggagcccttaaaattt

SEQ ID NO: 23957 - DNA, 1051 bp, Homo sapiens
tagttaatatttcagtgactgacttctaaattaaggtagttatttttatattagcagcttacaatttatgacagtagatatatatgtacacttcctatgttaaagccctttagttttacttttaaaagggaaaatgtgatcttgatctttttcaatacaaaaatgtaatctcagctatttaaaaaagtatagtttctcagtgtattagaagaacttatagaaaattagtacctcggtggcatgaatgctggttcagtcaatgtcacttctcttcattaaaatctaaatactcaaaatttttccatttctggagggtttacttatggttgttacttatattcctgaaatgctatatatgatcataaaagatttgctctgtgaatgagtaagagaaaagggatgtgcagaagatataaaaaaagaaaaagcatttgtatgatcaaagtacagagtagtctaattttactctcagtgatttattttctctccatgatgaccaacattaactgatcacagatacagacttatcttgttattataacaatgtaacttctattgctgagctagttcattccatgaataaagtagatggatttttatgatccaactcatagatactgagttagtacaaaattcaaaatgaaaccaagacattaaaaatgtagggatcatgtaactattttatactatgtgtatctttctctgatttacttttatctcattttctcatttcttatcctacaagttgcattctgaactttattataattacgaatttggtccatatgattttttaaaaatgtttttaatgattatacctagacttataagtttggtaagatataaattctgttagtgaatagtcactagtcaccatttcagaccatgtaggtattatcagataatgaacatgtttatggtgctatataagtattaattaaataacaaaaactctattgaccaccaatggtaaacgtaattgaattagcagagcagtaaaataaatgtagacaaaataaatatagacaagcgcatatgagaaagcttgtgt

SEQ ID NO: 23958 - DNA, 1031 bp, Homo sapiens
taaaatacaggtttctcagtattgtttcacatgtaaagcaaaaagccttttaatgcaacacctttttcctttttaccaggtgattttgttattgatctctaatctgcccctttagctgtattaaatgcttaaagtgttctgcttttccatgtagccttgatgctagctatttgtgtctataaattcattaacattaaaacaggatctatatagactattagagtctatgagttagaaaatggcatattacatacttgtttagggcataaataacaacataaatttaagattatctgcataaatgttataaaaatatgttcgttgataatatgttatgagattttaattatgtatttataaggaacatatttttcacaatctctcttttctttagcaatcactgtacacttaccaggagaataagagtagtcaactccatttcttaccatatccatccatacctagaaagaagaaaaaaccaaaactgggtacatttttatatataaagatatttgaacacggctgggcacaggctcacgcctgtaatcccagtactttgggaggccgaagcaggtggatcacctgaggtcgggagttcaagaccagcctgaccaacatggagaaaccccgtctctactaaagatacaaaaattagccgagtgtggtggcgcatgcctgtaatcccagctactcgggaggctgaggcaggagaatcgcttgagcccgggaggtggaggttacagtgagccgagatcacgccattgcactccaaccggggcaacaagagtgaaactctgtctcaaaaaaaaaagatatttgagcttagagttaaattaattctgtacaactaataaataaccaggaaaggaaggaaaagatgttgatataataactctttccgaattttatatgaggaaaaattttgccagtgtttctcacatttaacacatatatttgatgtttctatatactgttctttaaatgttctcttatcctgaaaaattatatttttgtacattgtacttggttca

SEQ ID NO: 23959 - DNA, 1043 bp, Homo sapiens
taggcccagtgaaggtaatagagccatttcgataagcacatctaccactatcaggattaaaggtcatccttgagaggacatgtttgttataacatccatagcaacagtttcctaaaggtatttagaagacagttcagatgtagcaacttcttggacgttgtgggtctttgctggaggtacatgtatcacaaaagtaaagctttgctggagctttttaaaagatacatagaaccaggtgtattggtagataacttcccctccatttcctggcctgcattccttatcttcaggggcttgactctaaaaggttctccattaggtcaggcattgctatatgtaggtgtccacttgttgtttcctcctaattatctcagttaattaaaattgtgtagagaatttatgaccagaactcaagcaaaaccttgtatttttttgagaaagttcatcaggtagggcaatgacattagaaaaatgggtgatgaaataacctgcaaatcctaggaacatttaaatatctttgaggaggggtgcgggctgtcccattctgggttggatcctttcccatagttggagagaacattacttataagagtcaccaccaggctctcaaagatacaattttagggattggtccagtggtagtactcttgcaggcaattcacctgtgcctggacagagactcatatgcagttgaggctaaagagagaaagcagtttcatctctctatatatatgtttactcctaatattacagaccaacctttgtaatgtgcctatagcattttatggacttaagaacatcaccagttagttttagtaacagacacttttaacagtgtctggaaggcttcctcacttacaattctactgtttaagtttagcttctttaaaacttctaccatcagacttgtggggatttagcacaacaggattccctcaactcccaacctttaaaaaacaagacactggcgtggccatagatcaggaatgtgggagcaagggcctctggcttagatattaaatacactgtttgtttatcatgtc

SEQ ID NO: 23960 - DNA, 1089 bp, Homo sapiens
tgaataaaaggagccaaatacaaaagaatataggtatgaatccatttaagtttgaaaaaaggcaaattagtctataatgttacaaatctggacagctgggctgagattatagcatcttgaagtgggtataggaaggcttctggggtcctggtaacatatgttacttggtcaggatactgtttacaaggatgtgttcactttgtgaaattcattgagtcacatgcttatgttttgtgcacttttctgtatgcatgttagacttcaataaaaagtttaaaaaattaccaaattgttcagattatcatcatccagcttttcctttggcgcctcttgcttttaactatggtggcagtatttatgtctgatgcttttttacagactttcccatgtaaatggaactactcttttgctatctcacataatttggctccttgcttgcatcaaagaaccactttgaaagccaaaaatttaataactttcagctttgggataagtttaagagaataattgaattaaattgagggaatttgaaagaaaattagctttccccagcatgatgtgggctgcaaaaaagaactaggtagagaccatgatgaggaaacaagaaattctttgttaattccattcggaattatgagtgagaatcacccagttttctgcagcaaaactggagtagaacattcatgtaatagggcaacctcttgaaagttactgatgttatttaatagtatctttgtcaaaacatagtaatctaggtcaaaggctgaggcctgagacaaggctgagaaaagggaagtcacagggtatcagtgaaaatatatttgctagaaatgacgcagggctcaaagtgggtacactaagctttctggctaggaattatccgctggccacagtaacctcatcagagaatacacaggaagtgagatgcattttggtgaattggggagtttcttcattttgctgaaattttgtgataatctcttcacattctctttcactcttactaattttaaatagctttaaaatgcaaagatggccctcattatatctgataccctggaataaaaggcagggtacaggacaactaag

SEQ ID NO: 23961 - DNA, 1029 bp, Homo sapiens
acctatgttcacactataacattgtgaaagtcagcaggactctcccaccctcctgcttttcaactgcaatgttgcagaagagcagaaagaaccatacatggacttttctttctctgtttcatcttcagacattcaaacactaagcctcatactaccattaataagatggaattacctacctgggaaagtaatttccccaaagacacagaagaaaactgctgaggtggaattaactgttcattaggtggccacaaccccttcactaaggactgtgatactgtgaacatgtttttaagtagctactaaaattgactgcattattctaaccatataggtgaccttatgggaagttaaacttaatagatagtgatcttcactctcttcagccccccttttcttatcctagtttgctgttcattgaagtagtatctgttcatactttataccctaaccttccttcattcaacaaatactttttgtggaaatgcaaatccatatcaaagacagactgttctcaagagcgcttcatggcctaatacagagcaacagaaatgtaaatagaaaaccacaggctattaaagtctttagaggaaaattctgtgatgatatttataaatactcactacgtactgttcttagtgctttgtgtgttaactcttttaatccttaaaactactctgtttgttaggtaattgctattattatctccattttactatggggaaataatacagaaaggttaagtaacttgtcctagagcatgcagttaatgagttgtggagccaggacttgaacacagaaagtctggctccagagtccatctctttaattactactctctactgcttctctagccccctgttttagaaaattggtgtatcctttttgtttccttcacgtgattcaccaatggattccctggcctaaaatagtaccaagtacatgataggaacttaatgatgttttgtttaatgaatgaattaaatgagaaaacagttcatcagtggatttataaggtaatatcattag

SEQ ID NO: 23962 - DNA, 1104 bp, Homo sapiens
gagtaaggaaatctgcttccccgctgaagcaggcactccgacttccagcaagcctgattaatatacactaaaatccttttctaaggtattcatttattcagtttcttgacccatggatactgaattattctttcatgtcagatactgtacttagctttccatgaactgaaatcaaatatacagctattaacaataagagcaagctatagcatgtcactcagtttaatgtttttttcatatactgttaaaattgagtagtggtgattcctctcactgtgtctgttagcaaaccaatgctggttttatagcatccttctttctgaaagtggcatagtgctagatacctgacctcctaaaataatcatcatgactaattaatgggaattacatgcatgtacataccaaataaaaactatgtgaaaagactttcttgtgtctaaatgaaatagcctacactaacagatgctgtccttgctatttggtagcctataattcttgtgctgttggatatcacccccatgatgggtgtcctggacggtgtcctaatggaactgcaagactgtgcccttcccctcctgaaaggtgggttggggagtagagaagggattttatggtatttgatttcttacaaaatacaggttttaggtttttgttaaaggctctcaattagaaattatttcataagaggatttttttattttgaactaccactgtttattaactacttatgtataccaaggataaataagggtaagaaatgagcaacaatcaatgtcaggtaaaggactatccttttttccccaatgtgtgtgtgtatataatttattataccagttaagtgtaatattgcacaagggttatacacctgaaattgtctacacacacacacattatagacaacgtaggaattgtctacattgtgttgttatggagtctgcttaactggtaatagtagcatcctgtaatggaaaactttctcagttttgaaggatgtccttcatagctatacattgctctggaagttggttggttcctcttacacggtccccatcccatctaccaatcatcaggttgagacatagtgtaaattgtccttaccatatg

SEQ ID NO: 23963 - DNA, 1027 bp, Homo sapiens
attgaaagtttttatgattgaaattaatctggaaaggaagattcagctcttcccactagacactatgttattatgcctctagtattagagacctacaaatagtatatttctaaatgaagcaatggttttcagtgttgttgttctttattataactgtgctaaagtcagtcatttttgaagttttttttttttagattcaaggggtttaaaattcaagtgttgagtttttattagaattatctattaattaaaatctggatttttatttactttagaatcagactttaaaacgatatacctctaaatataagttcaaacaaggttgttgcttactgaaagatcagttccagtttaaatctcttatttgcattattttcaaacagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatgaaagtgactcagactctgtttctagctaatatttagtgtctattcaggaagcaaacttgcggacaggcgcagtgactgacacctgtaatcccagcactttgggaagcttgagatgggtggatcacctgaggtccggagtttgagaccagcctgggcaaatagtgacaccccatctctactaaaaatacaaaaattagccaggcgtggtggcacaggtctgaaatcccagctacttgggaggatgaggtaggagaataggttgtcccggggggcggaagttgcagtgagccaagattgcgccactgcactcc

SEQ ID NO: 23964 - DNA, 1041 bp, Homo sapiens
aactggaaactaagttgtgaacaaacttggcaaggtacagatcatggtagatagttttaaaaagatctttttaaaaatctcattccactttctgcagaaaaactagattgacatcctagagggctgaatgttgtttagagcgtgttcttcagtagattgccaattaactttctttcacttatcccccagaggatgttagctatttggccaattcttttccaccagtgagaagagaacatgagtggcctggcctcctctggactttttgccaggagcctcatgcggtttgccccacctcacctatggagtttccctcctgtctgtttagttgcagtagaggtcttagaacactgaattttattcatgttttgggaaagagagaaacagggtgattagaattgaaagcacaaagatcgcactggtgactgactaaagtgattcagtcagagtaacattgaggctgtatccagtagtatgtgatgttccctgtgttgtctctgaacactagccatctttgcttgagtaaatgtctttgtgcattctcctgggggagctaagtagggaaagtggaaggcaggcctaaaacttgtctctgtgactaggtgtgtccagtgtgactttagctgttgctaagcaattttctaacacatatccccttggcttgttgaactaaaccaagctctgtgggactgcttggttaggtgcctggtagagggtgtggacagtgtcaccaagagagaacacctctgctgataatagggtgatttatgtgatggaaagctgtgcttaccaccaaatttaacatgtaataagctttagacagaaagtgtcctggcttcctggaatcaaatgactagtacctttgtgcacacccctgtgtcttttgaggggtggtggtggtaggggctgggtatgtcaggaaacatcagtgaaagacctcccctggaggcttccaacagtaacgttatcttgaccacttgaaatatttctcccgtcttcatacgctgttacttctttttttcctttccacagttattctga

SEQ ID NO: 23965 - DNA, 1049 bp, Homo sapiens
cctttctcattgctttttaaaattttattcatttgtttattgcattttccagtgggtcaggccttcagggtctgaggtcttggcttttccctaacaggctgtaaaattcatttttcttctcccacccttttcagatagttccattttgtgggcacattaaaggtggcatgagaccaggcaagaaggtgttagtgatgggcatcgtagacctcaacccagagaggtaaggcagagtctttgtcaggacagaactatcaggctgtggctgagccctgcccacttctgttgtggtttagcactcctcttcctctccttgtggacagtgttgctagttgccagtgccaagaaagtaccatgttcccatgaaacgaatatgtatgaatcccagccatcatttctccagacagctatttatatcagagattataaatataggcccacattttctctttgacccttagggaggccagaggatttttttttttttttttaatggttttgaaacatggtgccaggagcaagaactatcaagatgaataagaacccaacttaacattatttcccctggtcaatttctgtggctgtttttgagaattccgaagtggaattctctaattttagtcattttcaacaccaaagttttcaccagagcttgctttaggtaacaaaataagctggtttgacttacttctccataatctaacctctcttgaagagtagtggcctcttaaaaatggacaaacccagaggaggaagaagaaatataagcacttgggtcattttgaaatgtttttatatccaacccttaatcagtgggatgattttcttttcagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtgagtacctcgagtgcctcggctccagccactggcag

SEQ ID NO: 23966 - DNA, 1033 bp, Homo sapiens
tcttccttccacctcctattccgaggattttatttggtggaggggagacacagagtttatctttgatgctacacttaattgttgctttcagttaacctcttagacattaaaatatatgctaaactctagggacaacaaatgtttcaacattattatgttaatataattaacacagtcacgtacattttatatgctttaccagtttaaatgttggcttttttagtagtcatttttaacacttcgcagaggtatatttgtttaaacaaagtatctgtggtagtctcctaaattttgttcataaagatatttcacatggattaaaagacagatcttgtgtaaaacatctagcccagtaaatggcacctagcagatattcattagctctagttgttcctccgtggattaaattagatatatcagttgatcttcaaagtacacatatatttttaaatcttcaaaaacctctggaaaaaaatccactacaattcacataatatgtagggcatttaagttttaatgtttgctgatcttttgacctagagactgttaaaaaataatcccgtatcacaacaaggataatatgtccttaatagccttgatacatcttgccgaatccagttttcgttatgaaaattgtatagtgtgggtgaatcatatcataaaacatcattttacattttcatttgttctgcttacatttagtgaaaaactagttcagaaatgtagtgacatttgagtaccaaataatgttttattttgtgtgaaatctaaagtgctttcctcagcaggcaaagtctttgaatagcttctcattaagggattgccccttctctcccaacccttcccccaaatctcataaaaggaggccgctaagtatttagatattttttaatcatcataaattatttaaataaaatgtttatattctaatttaatgttacctacactttgtagattaaaaaataaaggtttttccctctattcttagcactttcaattcctttttaagtagaatagtgaacctttctagccg

SEQ ID NO: 23967 - DNA, 1047 bp, Homo sapiens
aaaggaaaaaaacttgttaatctaaatatatgcatttatatatgttatttatatataacttgatctgctgatcttacagggcatttttttaaagaaataataagtaaaaatttcagaagctctaagacattcttccttagaattttgctttgctgttaacgcccggcaactcatgaactttttttctcaagttatttgctggtaccaggagagtgtaggattaaaaatttttttttttactctgaatattattcaaagtgtaacttaagtttaaaatatttaaactgttctttttaatgttattgttgtcatcattgctataaatctgtattacatgagaaatacacaaagttatatgtattttaatgcagtcagatgggggagattttttaaatcaatttttgcaataaatctaaccctctgagcttccttttgaattactctaacaagatatttgaactaatgactaccagattcagacatgagactacagaaattaaccctgtagacaagaattttcattttgttcaaaagtagtacttttactcaccttttctgaaaatcttttaccctccccacctctaacctgaagaaagagctatgtggtatatgtttatgattagtccttagtcatgatttttttttttttttttttttgagacgcagtcttgttctgtcacccaggctggagtgcagtggcgtgatctcggctcactgcaagctccgccttccgggttcatgccattctcctgccccagcctcctgagtagctgggactacaggcgcccaccaccatgcccggctaattttttgtatttttagtagagacggggtttcaccgttttagccaggacggtcttgatctcctgactttgtgatctgcccgcctcggcctcccaaagtgctgggattacaggcgtgagccaccgcgcctggccagtcatgatatatttaaactaaccagatcatttaccatgtttgagactttgtggtagcttctaaatctttttctgtggaagaaaatagagaaaaaataaggaggtgagg

SEQ ID NO: 23968 - DNA, 1068 bp, Homo sapiens
aaatcaatcaaggacccagaggctcaaggacacttggaagggtgcctctgacccgtggctctatcttccatggccactttgatcccacgtaataacttgccacagacacactcctcctaggctttagttgaatcattaattcattaaacaatgatttatttggcaacagccaggtgcccttcccaggtgctggactccagtagtgctcaatacagtcaaagccctgctcttacaaagctcatgttctagtggagggaatcatgtaataaataagtatatgtcagccagtgataggcaccaagaagaacattaaagcagggcaaatagataggaagagtgtgtttgtgtgtgtgtgtgtgtgtctgtggtgatgggtactattttagcagggtggccagggaggtcttctgatcaggtgagggaggagctatggggagatgtgggggaaaagtgatgtaggcagcaggaacagaatctgcaaaatcccagggagactggccaggatgcaactctggttgcttgtagtcccctagccccattcaatgctaagtctgcctaggtgtgcagccagcataccttgctccaaacccacctgccaccagcctcctctacagaaagggagtcatttcattggaaaaattattgtaattgtcctcaaatctgagagttggttcgaaagctggaactgcctgacctcaaacaccacactttagaattgcagacctgctaaaaccagctctcttaattgttaaaacaattttcttactgatttaagaaattgaataataaatgtgcatagtttgggggtacatgtgataatgtaatacattaatataatttgcaaagatcaaatcagtgtacttgggatgtccatcaccttaaacatttgtcttttctttgtggtagaaatattacaattattctagctattttgaaatgtacagtaaattattgtaaaatatagtcaccctactgaactatcaaacactaagtgtatttcttctatcaacctgtacatttgtatccattaatcaacttctctttgtcccctttcccccctacacctcc

SEQ ID NO: 23969 - DNA, 1033 bp, Homo sapiens
ggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactggaatctgcagttcctttattcccttcttgtgtgttgaagcggcacttgctgatggaggagctgttgctcttctaggagatgggctttgggtgactaaagggatttgttttccttgctccattcatcaggcacgagcccctaagtcagggcagg

SEQ ID NO: 23970 - DNA, 1085 bp, Homo sapiens
tatctcctgttcctcaagagtgactggtgactttttaaggaccagggattataggccaagaggctgctgcccagaggtccaggccaggggaattctggcaaggagagccctgccgtgtttctgacttggtgattaaaggctttaggggtaccctgaagagacttgggaaaggagtgtccagggctttgggctcctgggggctctgaacctaaatcctcttcagacccaagggacatgtcagaaccttggagccctgtagtaggcagcactgtccctggttaaggagaattccttgggcttctctgactgccaggcagcttctcctagtgggagtcacatggggcagggaatcctaccaggttctgtgactgcaggcaaatcaccagatctttcaggccctcagtatcattgggaggtgaccggaatgatctgttctgcccagctcttacattcttttctgttctgcttgccaaggcctttcctgggaatggctttgatcttctcggtgtcattgtagccttggctgctgcagggtccccttgtggggctgcaccctgtgaggaggctctgagcgggactgggagagaacagaggctgggccccacctgcctgggagcaaggggcagtgggaggctctggcacctgtgagtcagagattcggtgaggcaggaagcgaatcataaacagacacagaaatggcctttcacggggatgagtccggtgcttattattagaattcctgttgttcgttaagctcttaccatgtgctttgcacacatgggtgtatttaatccttaccttctgaggagctggtgctatgaggggaggaaagtgaggctcgaagtcatacatctggaaggtggcaaagttaggggctggcctcaggtttgtctggctccaaaacccatgtccttcaacactgtgctgtcctgcttccctcgggggtgagttcttcatcaagcagataaaaaattcagtgaagaagctgagatgaaccagtcattctgctagtgttcagttaccactggcgtgtgaactgagcaggatggggtctggggcgacctcctgggtttggacgtgtcctg

SEQ ID NO: 23971 - DNA, 1284 bp, Homo sapiens
aaaagatggtaagtgaggttacacacatgctctgtttgttttccacttttgcttgatgggacagtagttgttgttttgtgtccctttagtattggggagggggggttatttccatatttttattttaagtactttgatttttaacctttttcattgcttcaatttgatagcaactaattaagtcctatactttcctgattgcgtacaatggaccaaacaagaactaattactaacatagttttgaattgttttccttgtttttcttgtagatgaatgttataattaaaatggaatgtgttgtgcataatattagaaaccagatggctttatataggatatgtgtgatccaaaaaattcaagtgaagttgttacatttgaataaattcactttattgaccagtattaaattgaacattgactgtcatagcctgtatatatatttgcatctagtgtggtatcatatgtgtacttaataaactgagtaaaattttaatatgtaaataaaccatagatagaaaaagagaattctttccatatcatccttactgatgagcagatttcacaacgttatctgaggataaataagaaaaaggtaaagcttttctataaacaacagatttcccccccaaacattgtacagtgtgtttttctttataactataagcttgctggtcttatctcagacatttaactcttcattgtatttttctgtgatagtctaagtgcttctgtagtagatacttttcaagtttgtttttaatattgtttgtaagaatctctgacaaaaatcaggcacttctaatatatattttaactagtaatagtaactttgtgaagttttcttttgaataaacaaaaacatttaaaagaggaaatttatcctaaataaaagatcataacatttgtgtttatattctaatgagattaagaaaagggtgtgcttgctgggcacggtggcttgtgcctgtactcccagcactttgggaggcccaggcgggtggatcacgaggtcacgagttcaagaccagcctgacgaacatggtgaagccccatctctactaaaaatagaaaaatcagccaggtgtggtggtgtgtgcctgtaattccagctactcaggaagctgaggcaggagaatcgcttgaacccgggaggcagaggttgcagtgagccgagatcacgccactgcattccagcctgggcaagagtgagactccatctcaaaaaaaagaaaagaaaaggaaagagtgcgcttgtagagaacagtgtaggcttattttaacag

SEQ ID NO: 23972 - DNA, 1052 bp, Homo sapiens
tcttatatggggagaaaaaagtgtaaataatttaaaaatgatacatttgcatctcataaaaattaaaacttctgcttttttactaataccattaaataaataaaaagataaatgagatatggcagaaaacagtcaaaatactatgataaagtatgtatatatagaatataaaaaaactcttacaattcaatagtaagagcacgaaaggtaaagaaaaattagcaaaacatttgaacagacacttaccagagaagatacatgaataactaacatgaatatgaaaagatactctacatcattagtcatcagggaaatacaaacccacaataggataccagcacaagtccataaaaatgaccaaaattaaaaagactgacaataccaagtcctggtgagggcatagagcaagtagtataagaatttttgaaaaaaagagtggtggtttcttataaaaataaacatattcttatgttgtgacccctaaatttccacttatggatatttatcgaagagatatccacacaaacacttgaaatcttcgcagtggtttcacttaggatagcctaaaactggtaacaactcaaatgtccatcaactggccaatggacaaacaaatcataacataagtaaacaaatcactgtataactaaatgaatgcattttacatgcataaactgtatctcaatcaagttggtaaaaacatggagataatatctaccttaactctgttgaaaaggtggaatgaaaaaagtcggaaccattagcatgctttgaaacaaaatgtgtgtaatccgtgcacacttaccagaccccagagatgatgtggggcttaagagaaattaggtaaaacctaaagaataaaatcagaggcagaaaaagaagactttgaaattgaatctagatttccctagaagttttgaattttaaaaaaaaacccaaaaaacccaacctataaatatgtaacttgtggcaagtggccattttcataagccctgttgcacagcggtaggggcatcagagtctgagtgaaatggagctgtctgacccacacg

SEQ ID NO: 23973 - DNA, 1009 bp, Homo sapiens
agcaacatctgttttccgttcaatagtacaagaaggctctgcatggggctgagtgtacacagtccatgtgaatctattgttattctcattccttttttgtgcctatgcctggtccatttgccatgtaccatccggcaaacagctgacacatactagctattatggacccaggcctaattgtgaggtcttaaaagctctgccatgtttgtcttctaggatgaatcagaggcccctataaaccacagtgttatagaccaccactctcattttgcatttccagagtagcagactgttgtgccagagggtttgttgatgttgaaaatatagtcagaatcagtggcggcattttgttttcctctttgcctggaatgtttttgttttccttagtaataaagcatgcaattacttacagaataactatttgtagatattattttagcttggaagcagaaactggcaaattataaatgtgccaatgcagctctgagctggaaccatggttgaagggggatgggaaaggtggcatggttatgtgctccagccctccatggctttgtcattatgccatgggatcctaccaataagggttcacagatgcctcttatttgggtttctgatttgtgcccccacagccctcttggaacagagatcatgatgacacggcatctactcgttcaggaggaaccccaggcccttccagcggtggccacacgtcacacagtggggacaacagcagtgagcaaggtaggagagatgttattctcttttgctacttgtttcatttttaaggattgaaaaatcagaaatgtctagtgagttactaagtatacagtttttcctagaagataaaccccctttaacttgagaatcagctcatcttattttattctctgaccctgctcttctgtgctattccagctgcttaactgtctgtcacctggccagcttcataaaacagggtagtgaattgactcagggcaagattagagaagtagcttagaagtttgaa

SEQ ID NO: 23974 - DNA, 1049 bp, Homo sapiens
gtagctgggactacaggtgtgcacaaccagacccagctaatttttacattttttgtagagacagggttttaccatgttgcccatggtgatcttatactccaggctcaaatgatcctcctgccttggcctccaaaagtgctggtattataggcataagccacaactccctgccatcactttttttttttttttttttttttaggatgaagtcatttcaaaatttgctttcaaggaaaattttctgtaatatataccaagtgatgaattatttgaaatttattttaatgcctaaggccaaaataatacatgagttttgatattactttgcatcatcattgtcaactagtgattggttcatttcacaagctgctttaaagagaattttagtggctgggtgcagtgtctcacacccagcactttgggaggccgaggaggttggatggcttgagctcaggagtttgagatcagcctgggcaacatagtgaaaccttgtctctacaaaaaaaacaaaacgacaaaaactagctaggcatggtgatgcataactgtagtcctcggaggctgaagtgggaggatcactcgagccagggaggtggaggttgctaagctgtgatagtgccactacactccagcctgggcaacagagtgagactctgtctcaaaaaaaaaaaaaagaaagaaaagaaaagaaaattgtatatgtaattaccttcctcaactgtggtagacaatttcagttctttctaaagtaatttggcaaatacccccaacactgttagagaaggaaaacttttcatgtggctgattgatggacttcttatgatttgaccaaatttcaatattatgtttatcaagtgggtagagaagagaggtgctcccttttcccctcctgtctattctcctcctgccgctgttctctacctcccctacccgcagacacactgatgatgtattgcaatcttggaactgttggatcctggaggaggttaagaaactagaaaaaggtgccaaaaacatgatttcataaggtttgacttgagaatgaatca

SEQ ID NO: 23975 - DNA, 1059 bp, Homo sapiens
gtaagacatcagaaagtatatgtgagatcaataataattccgaacatggagccaaactaactcagcaacaagacattagaaaggacagtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaaggtatgtatgaaatatgaaatagttttctttgaaaagcatcttaaaaagtagtaaaataattatttgttgtttttgagtgtgagtaatgtataaggtaaaactattctatgactagttaattttaagaattaactagaattcttaaaatgatacttggaaataattatacggcattatacagagtagttggtttatttttcaaaatattacattgaattctttcccagcacttaatacaatgactggcatatagtaggtactcagtaaatattttttgaataacttattctttct

SEQ ID NO: 23976 - DNA, 1798 bp, Homo sapiens
tcaagatcagcctggacaacataatgggactccatctctacaaaaagtaaattaaaaaaaaaattagctaggcatggtggtacatgcctgtaatcccagctactcggaggctgaggtgggaacctcacttgagcctgggagattgaggcagcagtgagccatgactgcaccattttactccagcctgagtgacagagtgagaccctgtctgtattagtctgttctcacactgctaataaagacataaccaaaactggataatttatgaaggaaagaagcttaatagactcacagttccacatggctggggaggcctcataatcatggtggaaggcgaatgaggcgcaaagtcaaacgtcttacatggcatcaggcaagagagcttgtgcaggggaactcccatttataaaaccatcagatctcgtgagacttatttactaccctgagaacagtatgggagaaaccaccccatgattcagttatctccacctagtcccacccttgacatgtgggattgttacaatacaaggtgagatttgggtggggacacagccaaactatactatatcactctttaaaaaaaaaaaaggtgatgtctcatgagtcttgtatttttttattgtgtttagtgcaataccgtaaaccttgattaacacaccatgggaccatgggacctatgtgaaataccactagtgatactggaagttctcccaaaaagcagagaaaaataatggcagaaaaaaaaaagaaaagaaaaattacaagaaaaagttgaattccttgatatatacagtagattaaggtctgcagctgtgttgcctgccatttcaaaataaatgaatacagcatatggacgattgtaaaaaaaggaaaaggaaattcatgaagctttcactgcagctatgccagcaggtgggaaaaccttgtgctttttgtaaaacacctttttatcttgtattgaaaatgcaatttttatgtggatagaggcttgctataagaaaaacatacctatagactctaatatgattcaagaaaaagcaaagccattatgtgacaacttaaagcaaagggagggtaaaagatctaaagctcgagaatttaatgccaacaaagaatggtttaataattttaaaaagatgtttggcttttaaaatgtcaaggtaacagaaaatgcagtgtctgctgcccaagcagcagcagatgaattcccagatgtcattaagataatcattgaggagaaaggatgtctgtctgaacaggttttttaatgtagatcaaagtgccctactctggaaaaaaaaaatgccacaaaggacagttattagtaaggaagagaagtgagcactgggatttaaggcaggaaaggatagccagttctactgttttgtgcaaatgcagttgggtttatgattagtactgcccttatctacaaaggtgctaacccctgagacttggagggaaaagataaccaccagctgccattcttttggttgtacaaagagaaggtgtagacatgaaaatcctttttctgaattggttctgtcaatgctttgtccctgaagtcaggaagtaccttgccagtaagagactgccttttagaattcttttgaacaatgcctctggccacccagagccccatgagttgagtaacgaaggtgctgaagtggtctactttcccccaaacacagcatctctaattcagccactagatgagggaatcataaggacttttaaggctcattatacacagtactctatggaaaagattgtcagtgttatggaagagaacctccctaga

SEQ ID NO: 23977 - DNA, 1027 bp, Homo sapiens
gtcatgaaagccatcaagcctgaagcagtaaattcctgctgaaggaaactgtccagatgatatgcatgacttcacaggttttatgacaaagccaatcaaataaattatggaagagattgtggatatggccaaaaagtcaggggtgaaggatttcaaggtatagatattggagaaattcaagagctaataaacactaattaacacaagacaacttgatggagatgaatgcttctgagccagtgccagcaatgaggaagacatgtagaagcagcagtgccagttaccaaaccaacactaaacactgtggcagaagggttacgtttattcaagactgcttttcttttacaacatggacctttctatgatacagaccctgaaactaaacaaatggtggaataagattggaactgtataaaaactttttttttaaagaaatggaaagcaaaaaagttaggcaagttatcatgtattttcataaagttacaccaagtatgtctgcctttcttgccttcccttctacctcctttaccttttacacctttgccaccctgagatagcatgagcagctcttcctattcctcctcctcctcagcctactcaaggtgaagacaatgaagatgaagacctatatgatgatccacttccatttaatgaataatacatatattttctcttccttacgattttctgaataacatgctcttttctctagcttattataagaatatactgtaaaatacatataacatgcaaaatatgtgttaatcaatcatttataattgattaaagcttccagtcaacagtaggctattggtagttaagttttgggggagtcaaggttggttcccctaacccccatattgttaaagtatcctgtaagtttattgaatttgtttatcagttttaagtgttcttttggtggagtctttaggtttttctagatgtaagatcatgttatctacaagcagggatgattcaacttcctcctttccatttagatgccctttctttttcctttttttttttt

SEQ ID NO: 23978 - DNA, 1046 bp, Homo sapiens
cagctttgtgtttggggctccatttgtttccagatggtcatgacaactctatgagagctctttctttgaatagtttctccacttggtttaaatcttatccttaaccaataccaagaattgacaaatatcttcagggaagaaagcagcctgtgattgtcagcttacaaaggaaggactgtcattattaaatctctggaattttagataatctaaaattttcattgctctcacaattctgtcataaaagtgatttttacagcctatcaggcttttttttcctgttgttaaaaagagtattctcctaccatgaggtcctacattcttttcagaagcaaaataaaaataatgcctattcttcagaagaataaaaacaaaatacaaagccttgcttaggatagtaatgtcaaaaattgctgtcttcttgtcatcagtctttttaaaataggtcagagaaggggctagtcaagagaaacaactccaaaaccaattagcttacatgtgctaataaaaactttcatgtctgtagatacgtgtagatgtatacgtatagatatggtgctttcttcacctactgaactgctttgtgtcctgattctggttgcagataaaaacttacatttttttctcttgttaattttaattacagttcagagagacttttagagaatgttagatatgattgattactctgcctactgctttaaaaataaggggatgtaaactaagaaagattaaatgagctgtgtaagaccccaaagctggtgagataaaaccaaatctcttccctcctcgagaccagaatttctccatggcattgcctgactccacgactgttagtcttggctttctaaagtatcactggggggttgtcttttcagccaaatgtcaaaataatattttggagttttaaaaataatatttggagttttcaaagtacctctagataaggaactttgaagaaatcataaattttccaggtcagcaaaataatagaaatccttacaaactgtctgttgtcacatgatcattattgagcaaaaaacata

SEQ ID NO: 23979 - DNA, 1036 bp, Homo sapiens
tgcagttcattcttttttattgccaaataatattccattccttcacttcatccgttcatcatcagtcaatagacattttgatgtttttggctattgtgaataatgcagttattaatattcatgtacaaattaataagtgtacatatattttaattctcttgggtatatatgtaaaaatgaaatttctgggtcatataattctatatttaactagttgaggaaatgccaattttttttccttaatgccaaaatggctgcaccattttacattcttgccatcactgtattatgaagattctagtttctctacatcctcatcaatggttgttagtctcctttttaaaaaaaaaatagctattctagtgcatataaagtggtatctcattgaggttttgatttgcatttcccctgctttttctttgtttaagtagggtcttgctctgttgcccaggctggtcttgaactactggcctcgagcaatcatcctgccatggcctcccaaagtgctgggagtacaggcatgaggcattgtgcccactctgcatttcccattggctaatggtgttaagtatgtttgtatgtgattactggccatttgtatatctcctttggagaaatgtctattccaatcactcgtgcatttaaaaatagggttatttgtcatcttgttgttgaagaattctctctatattttattttactttcacttaaaaaatttttttttgagacagggcctcactctatcacccaggttcaagtacagtggcatgatcatagttccctgcagcctcaaaaggattgtcccacctcagcttcctgagtagccgggagtacaggcacatgccaccacatacgcaactaatttttaatttttttatagacataggggcttgctatgttgtccaggctagtctgaaactcctggcctaaagtggtccttctgacttggtctcccaaaatgctgggattacaggtgtgagccactgtgcctggttctatatattttggatactagacccctattagatatatgatt

SEQ ID NO: 23980 - DNA, 1034 bp, Homo sapiens
aagggcagatttgttaaaaaaaaaaaaaagtatcttctttgccaatcaaatgtgtcccctcaaagtagacctctagagcctggctactcaaagtctgatccagagaccagcagcatcacatcacattttctttttctggaggatctaaggggagaatcattttctcacctttcccagcttctagaggcttccagcattgcctgatggcccctttcttccatctttctgaactttgttttgtactcacactttctacttctacagtcaaatctcttcttacctccttcttataagggcacacttggataatccagcatggcatccccatctcaatatccttgacttaatcgcatctgcaaagtacttttaccatattgtgaaataataagaaatatataagtgtgtgtgtgtgtgtgtgtatgtatagatagataaatagatagatacctagacagatagataggtacatagatacctagatagatacatagatagagatatttgtctctgaccctggttcctgacatagagctcctaaacttttctaattccctaagtggtacgggtactagcagcatcatttgttctaacatttggtctttgagtccagttcctgacacagagctcttaaatttcttggtattttctgggtgataagagtgtcttttattcaaatgaaacaactcttgatgaggccttggatagctttaggataggggcttgtcatcagaaagacaaggccatgattagaagcttagcacttttaattcccaaccttcattctctggggagggcagaagagctagagattgagttagtaatagatcaagcctacatgatgaagcctccaagaaaaaaaaatttccctcaagtatgggttttggagagctctggggttggtaaacacatccatgtaccagaagtgtggtgcaccccagctccacaggaatagaagctcctgcactcagagcccttccagacctcatcctatatacctctttatgtcctttattataaaagaaaatggcaaacac

SEQ ID NO: 23981 - DNA, 1069 bp, Homo sapiens
gaggttacagtgagccgagattgcaccactgcactccagcctggtaacagagcaagactccatctcaaaaaaaaaaaaagagtgtataaatgtataataaagaacaagattgtatgagtcaggtgtaaatgccataggatttcagagcagggaaggataagtgaaggcaagaagagtcaggagagcttcatggagagataacacctgagtgatttgaaacgtagtaattacaggtgaagaagtgggacgaggccatgccctaaagagacaccaacccgaaccagggatggatatatctctgagcatagtttgttcatgggctctcccagaccatgactttgttgttgtttttccttcttgttttgcatccatttctggggcctttcaatttggggacatttctcaagttggcaactatctttgtaggatgtacgctctacacccttgatcttgaacacccaagatgtggcagtgcggcccagttgatgctcatccctgttaaccctgatcaggatttgctttgtactggctgctgggttggaaagtcacaatctttgaagaaaagaaaatgacctaaagttagacacaaggttccaaattcaacattaaataaatgaagacccctgtttttttctcctgatttatatgaaaaacagcctgactgcagtagcaacaaggttcaataactttgagcggatccatgtcatatcactgtttagagaaatgccatttgaatgaaacctgaaattcaacaaactgagacctgaaacatcaaagcgaaaacaactgctctataactgcaggataatggaggaattaagaatacaggatattgagtcgaaaatctttatttcacatcccagccccttgactttccagggtgatcctggacaggtttacctggagtctgtttcagaacctgtctcgcatttttatagtaaagattaagtatataaggggcttgaggtacataatagtctgttcaaaaaatgacagctgtgtattaggttattgacctaactttccttgccaagtaaaagtctaatgccctgccccattagattcactg

SEQ ID NO: 23982 - DNA, 1050 bp, Homo sapiens
tttccaaagcctctgacttctggttgaattagcagaagtatagtatctgaaactaaggaggtgatgggacctctcaacttggtgaagttaaaatctccgttcgaatattgtgttcagtaccaaggacactccaagggagaacatagagaaactgagtgtatgagaaatactaccaaatacggtatgttatgtagaatatagaattggggctctttagcctggggcatacttagcatagagacaatattcaaagggctgcgctgaaacacatgcagctatacctttagagccctaattctacagattatttgttgtatagatccaaggggtagaataggctcaaaggaacagtttctggcttcgtttttaaaaaggcctttttaattagctgcattgggtgggaatgagctcgctattatagttgcagtcaagcacaggcagcaggacaacttggcagaataatgtaatcaccattcatgcctcagagtggggattggaatagaaaagctttcagactccttatgctgctgagaggctgtgactgtagacctaaaagtatgttaggaaaggagtaaactaaatactaccagtcctatacagtatcacaaataagtttggttcttacatcttgaaaatgaatctaagagagctctgttggtgatactggagacaacttctcttagtgcagttcagattggccaacctccacctaatacaagtgggatcatatttcagaccagagtacttcaaactcctgagaataatctgttttcaagtaatctcaaaacacaccctgtaatttacaaacaacacattagtcccaaatcagtctcctctatttattagccagtctccatagagccatacataactcaaggtattttttttacaatgtcccagtatttttattattatgattactattattattattttaacaggatggcttgtggttttacatacaatcattagagacggtaaaagaccacaggaatatcagagtgcggaactcagatctcaaatattgtttatgaactgaaataaaagtag

SEQ ID NO: 23983 - DNA, 1027 bp, Homo sapiens
tcttcactgagtctcagttttccttacctgcaaaagggggtaacagttcctacaaggctgttttaccgaggctcactgaattaaatgagagaatgcatagatagcactgagcacggtggttagctgttgttaagtaagttagcattggacacagccgtaaaaatgcaggcgtttcaagagtgacctcgggaaatgacactgcccagaagaattgggcagaattgcagctgtcctccacctgggtcttctattctgaatctttccctcctccagtccatactctccagtgtcaacagcatttgctttccaagaagcaaatctgatcacgatgccccagtgtcactgggttaaagccactaagggttcccctgggctcaggatagaagccacactcctcagcctggcttgtgtgtcctcccacagtggggaccccacctcctttccacccgcactcatgctgtgctcccagcatgtggacctccactgcccctgccctaccccagggacttgtgcttgcctttttgtgcgggaatgctgacacctccttggccctgctctgcagagtgtcacctcctcggtgaagtgctagttcccagacactcggctcttcagcacttggctacttgctgagaacaatagcccgctggtctgctgggagctatggaaccaaactgcccacgtttaaattctggcttctccacgtggctgtcagcaagtttgtccatctctccttgccttggtatttttagtgagatgagaaagagaatattattgaattcacaagattgttaatgagaattaaatgagttagcgtaaggaaagcatgttagtacatagaacactgcttggcacacagtaaatgctcagtgaatgtccgctgtgctaacaacaatgttattaccatcattgtcattattcttattccaccaaaatgtaagctctttaagaataaagactgcctattttgttcactacctgacacaaaaggtacaggatatacagctgttgagtaacacgttgaccactg

SEQ ID NO: 23984 - DNA, 1026 bp, Homo sapiens
cagctttccacatattgcttgcaagccgcccaccacagcaccacaggccctgatgtgaggccgtccgctcacgtttccttctctccaattcttttctaggggcgctgcatcaacttcaccagggtcaagaacaaccagccagccaagtacccactcaacaacgcctaccacacctcctcgccgcctcctgcccccatctacactcccccacctcctgcgccccactgccctcccccgccccccagcgcccctacccctcccatcccgtccccaccttccacccttccccctcctccccaggctccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatg

SEQ ID NO: 23985 - DNA, 1048 bp, Homo sapiens
tcacacctgtaatcccagcactttgggaggctgggatgggtgggtcacttgagatcaggagtttgagacaagcctggtcaacatggtgaaactctgtctctattaaaaatacaaaaatgagctgggcatagtgacacacacctgtaattccagctacttgggaggctgaggcgggagaaccgcttgaacccaggaggcagaggttgcaatgagccgagaaacaacccaaatgtccatctactgatgaatggataaacaaacaattgtgatgtgtctatttaatgcaatatttctcagcagtaaaaatgaataagctaccgatacatgtaacagcatagataaatctcaaaagcagtgtgctaaggacagaaaccaggcatcaaagactacccactgtataaatccatttatatgatattttagaaaaggcaaaactatagtgatatttctagtttcctgggcttgggagtggaggtaagaactttttggaatgaaggaaatgttctacaccttgatcgtggtggtggttgtatgactgtatacatttgtcaagaagaattaaactgaacacttaagatgagtgagtttgtagtatgtacattgtacctcaataaagccaattaagaaaataagaaatggttctgatatatggttttttgggttttgtttgtttgggcagctgacctaaaatagaacctgaaaacagattggggaattcagaaagagaaataggacttgaagggtgtgggggatggtgtcaggacaatgatttctggttttggaagtgttaaggaggttgagttaatgagggcacagagagagaaaagagacatagagaaatatggggcatgatgggggggtctctactgcagcaaaaaggaaaaaggagagcaagaaattgagaaaacagtttttatacataggatttttgtatgtgttgcctattttgtctcaatttatttttatttttttctcttcattctcttggtctctccttttcctggggggtcttagacaccatgtgtaactattgcgtgcttccaaagtt

SEQ ID NO: 23986 - DNA, 1050 bp, Homo sapiens
cggcacatcggagtctgattattatagggtccatgacttgagttggctggtggcgcagtctcagcattttgtcatgactttgaccagctggagactttggtgccaaggaggaaggcttctcaaccatttaccggcagaagtgacccccggggcaatgcaagtcttctgagctgacagagcagagtgggtcctgcataactcgtgctttacatggaactgggcatctgctctctcctgctgacagtgggaaggatagataaggtgtccctctccaagttatccattctcctgcccaccagtccatgacaccccaccacccccttccactccctactgtttgccctttaattttttgttttgttttgttttgagacgaggtctcactcctgtagcccaggctggagtgcagtggctggatacagttcactctgcctcccaggctcaggtgtttcacccacctcaacctcctgagtagctgagactacaggtgcatgccaccacgtgcctatagtctcagctattcaggaggtaactggtaactctattgataaccaaaccctagatttttttttttgagatggagtcttgctctgttgcccaggctggagcgcagtgatatgatctctgctcactgcaacctccgccttctgggttcaagagattctcctgcctcagcctcccgagtagctgggactacaggcgtgtgccaacacgcctggctaatttttgtatttttagtagagatggggttttaacatgttggtcaggctggtcttgaactcctgacctcaggtgatccacctgccttagcctcccaaagtgctgggattacaggcatgagccaccgtgcccagcggccaaaccctaggtttttagttgccagggaattctcagacacaggtggaagagcaagtaggagaggaagtggacagggataagaaaacggataaccccatgacccaagagctgctgactctccagagccctatcaggccaaggccatcctcattcagctcatgtcagatttctgttgattgaagatagagacac

SEQ ID NO: 23987 - DNA, 1051 bp, Homo sapiens
ataagtaaatcaataattaaaaaatcataggactgtatgatcagtataataatttgatatatatgtgcagactgccatggagtaacagaagaggtgcacctaactctatcattagtggtcacagaaggcttcctggaggaggaaggtttatattgagccagggctggagaagaagggcttatgcacagttgtggagatgagaaagctaagccaaagcacactgaaggaatggcatgtctgttacagcaggcaagtcccagaggtggagatggaggttccttagaaactaagtccattctgtaggtgtatgggagacagggcagatgagtattgagggacaggtcctagagggtccaaggatcccatgtaaggaactgctggcctggaatataaatccctacttccctttgcatctgttccagtgcctggcaaagttatgtaataaatgttttcagataaaatgaaagtgctgggtaccaggaaggaaatcaaggcagagatttagccttggagaaacatgactccttgcttccctgcttaccctgtccagacctccaatattcatcttcgacatggtctccttccctgattgacataatctgggtcaggggcctctcctacacactcctgacactttctgtgatttccccagcatgggaatgggaatgttcacaccttattatatctgatcacatacctgcctcctctcttcagctttgagctccactgagggcagggacgatgcagccccctctggctagcacagtgctgctgagcacatactcggcccttgctagaagtgtgcagtatgaatggacaatttcccatggcctagaaaatttagtccaccctctaggcctggcctgccacaaaaatgatccagttttgaaaattacttctgtagctcttgctccgttcatggtgtccttaaactcccactcaactccaagctaactagtcttttccaaataagtcttaacgttcataatcatagcaggagctttgcttttactgtttactctgcttggaaaattctttccctattgaaatc

SEQ ID NO: 23988 - DNA, 1067 bp, Homo sapiens
gacaaagaatctaaggtacttgttcaaaagtggtggcaccagcagatcttagcattccaaggaatggtctggaggggccgtctggcccaaattcttcccttcagactggactgtacgtcctccagccaaatcagaatgacagccattcactcccccttagagacctccagagggtgatacgtatgaagtgcctttaaaaaatgcctgactttttgccctaagaatataactaaaaatgcacagaggttcagatctcacagtgtttattcagcattgtctacattagctaaaaatgcccaagagtagcagattgtctaaacaaaatattatacacttacacaatgaactattatgtagtcattaaaacttatattaaagagtatttttttcttttatttagcctttttttttgagacagggtctcactctgttgcccaggctggaatgcaatggccccatcatagctcactgcaacctcgacctcctgggcttcagcaacccacccactgcagccttctgagtagctgggaccacaggtgtgcgccaccacacccagctaatttttgtattttttgtagagatggggtttcgccatgctgcccaggctggtctcaaactcctgggcccaagcaatctgcccacctccgcctcccgaagtgctgggattacagatgtgagccactacacctggccaagaatactattaaaatatttattaaatggtttggtatatgtaagtgaaaaagacaagccataaaatagtatgctatgatcccatttttaaaaaattaacacagttaataacacagtattttttaaataaatgaaaataatttgtgcatgtgggggaaaatgaggaaggatatttacagaaatgttgtcaatgattcttatttctgggtgattagactgcagtggagttcctcgccttgccccttctttttacttatttgttttttcctaagccttctgtggtcaacatgtgttacctttatagaaagaaaacaaccacaataagagctttgtgggaagtgttcagagcaggagattctaaaccttaggagtct

SEQ ID NO: 23989 - DNA, 1047 bp, Homo sapiens
aatagtagtctctagatgatggaataatggttgatttttgtgttcttttttgtctttattttctacactgaataagtattaccttcgtaataaaaaataacaaaaaaaatttaaagctaagaaaaatccagccaagcttgaaaaagttggcttagatgactttgaactgtgtgtttcattttaaaatctatttatctaactttgcttccctatcgaacagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggt

SEQ ID NO: 23990 - DNA, 1040 bp, Homo sapiens
aaaatgaaatgtataaatatgacatttattataaatcatttaaaatgcctaaccaaaagcaatttattacaaccgagggagtcatgatgtctgcataaaatgaatgcaggccatttctgtgtagatatcttagtatgactataatgtggaaaaaacgtacttgtctaaggtcatttacagatttcattaatgacttgactattaagcagatggcttatgattaccaattaatttcattcatgggttcaaataaacatgcatgcctactatttaaatttctcttaattttgaaagaattgtgtataaatcacatatatgtattttaatctactggcagaatgacagatttgttcattgaagagaagtgtgttgagcactgtgtcaaactagacacagaaagccaaaggtaacttaagacgtaatccttactttcaaaaagttcacaacatagtatgtatgtgtggagaggggagggagggttgatatacaaacccaaaggtaaagtaagagctgttcaatattataggtatgataataaacatcctgtagcatttagtgaatggataaagaagggagtggtcagttcatcctggtggtgtcacatacgaaagttacattttcacacagagtcttgaaagtgtgtttgtattgcaaagtaagaagaggggaaggaagagcatttcagacagagagaacagagtaaactaagatctagtgatgtgaaataatggaggattcaagactctaacagaaacatggctcccacataaacataagaaggattgcagaagaggggggcagaagccagatcatgaaaatacatctatacattgctaagaagtttagcatacacagtacctttggaatattttaatcaggggaaagacgaagttatgttttagaaagaatacttcagtaacaatgtgacagatgaattgaaggaaagatgagtacagcattagagacaaaaacttgttgcattcgtccaagggaggaaagtagggtagtagcaataagcttggaggggaaaaagtggatac

SEQ ID NO: 23991 - DNA, 1032 bp, Homo sapiens
gattgcacaaaccaaaatgtatgtctgatgctcttgtttttctatgaagattttacagagtcattttcaatagttttaaaattataaataagatgcatacttaggaaataggatagaaaaatcacctgtgatccctcactcgttatattttggcatatgtctgtctgtctttttttttttgagacagagtcttgctctgtcacccaggctggaagtgcagtggtgcgatcttggctcagtgcaacctccacctcccagattcaagcaattctcctgcctcagcctcccgagtagctgggactacaggtgcatgccaccacacccagctaatattttgtatttttagtacagatggagtttgccatgttggccaggctggtcttgaacttctgtcctcgagtgatctgcctgcctcggcctcccaatgtgctaggattacaggcatgagccaccacacctgccatatatttttgtatatttcttttaagttttcttaattatttgacttttcagatctatatggatcaggactacaagaaacaacagaaatttagaaagttttctacacaattatacttaaggattgctattgaatttggctgatggaataagtatggccacatgttgtccagcaagaaactttaaaacattttttttggttctataaattcttacagaagtaaatgagccagtctcttctacagccgtgacgaaaaggcttcatgagttagaatcaccagatttctatgagacaatccagaattagatttttatatcttgttcatgtgacagaacacttgtaaaaacaaaatggtattctcagcacaccccctgaaattggcacatttaattcaacatatgaactggaaccaatgttgttatttttaaactcaagagatataaatccactgtcacacacctgttgtataaataagtgaagttaactattaattttttaatgaatttactgctttcttgtttgctttgctgactctaggcaggtgccaagggaatacaaaaaatatatgagat

SEQ ID NO: 23992 - DNA, 1031 bp, Homo sapiens
agtaagatttccggaagcaagggaatacatgggtcatattcaaggaactgaaagatggttggaagagttcagtataactagagccagggcatgagggctgtggatggagtttgggagatttactttgggagttgtctccgtgttttatataggttatagatgttgtcgaaaaaatagaaaatatgagtcagctgaaacaacaatcatacatgtaccactcagatacattgctgagtttttccttcacctgtatcatttttgcaaaattggatcacagtaggttagctattttgtaacctgcttttttttttaatggtgaaaaacatatatatttagaatttgccagctggattcaacttagatgatcccaattttttggcagcctctaaaagcagcatgctcaggagccagctgaacatgggctttcttctctccatcagccctgatcacggtgttgatcttggccacattggtgtcatagagctcctccacagcctgtttgatcttatgctttttgacctcgacatccacaatgaacacaagtgcattgttgtcctctgtcttcttcatggccaagtcagtggcctgggagaacttgttggtcgcatagtggtcaggcctgggggagaggcaaaatggggtcacctggcctgggcccagtagaagaaaggcttggtcctctttcagagcccaaggccaggtgagcctaggtgcatcagacagtgaggtagtaattgtaacctttttttttttttttcactttgttgtacatagctttttttggtcaataaatatatattcacagcatcatttttatgaacggcataatattagttgttttggctataccgtaacttagataattcctctttattggataaagttgtttctcattttttttcattactataggaaatatacatatatctttgtccatttttatgatatttttaaagcataaattccaagaagtagaattcttgttgcatggtgcatacaattttctaatggccaaattgccctccaaagct

SEQ ID NO: 23993 - DNA, 1046 bp, Homo sapiens
ctgtcactcaggctggagtgcaatggtacaatcttggctcactgcagcttccacctcctgggcccaacctttccacgcacctcagcctcacaagtagctgagactacaggctcgcaccaccatgcccagctaacttttttgtatttttttatagagacgaggttttgccacgttgcctgggcttgtctggaattcctaggctcaagtgatccacctgcctccgcctcccaaagtgctgggattacaggcatgagccaccaggcccaaacagtttttacatttttgtcatttgtcttttcaaccttcaaaacaatctatctttttcttttatgatttcttttttttggtgttatccttaggcctccatcttactaggattatataaatagtcatctatatattcttctgttctttttatggcttaattttttactttggagtatttgacgatatatctgaaatgtactggatgtatcaatgtatttgaaatgccttattgtacatgaaatacttataaacttgctttcatttctggactttttgttttattgatttctttgttatgaagacaaggcattgttttaattaggctaactttaaaatgcattttaatatttagttacgcaaaaccaccttcatttttctttttttcaaaaatctctcagttctttgtgcatgattattctcctgtatgggatgtaggatcattttatcaagtttccttgcaaaaattcctatggggattttaatttatatgattaaatatgtagagtagtttgtggaccattgatgtcttcctttctggaatatggtattttctacatttacgtaggtcttcccttatgtctgtctctaaaatttgtagtttttcccatattgttcctgtgtatttcctggaagtataacacttagtattttacatttctttttttttttttgaaacggagtcttgttctgtcgccaggctggaatgcagtggcgtgatctcagctcactgcaacctccacctcccgggttcaagcgattcccctgcctcagcctcccaa

SEQ ID NO: 23994 - DNA, 1133 bp, Homo sapiens
gatttgctgtacccaacggccatcagtaattgaagccaagtagccaggcacagtggcacctgcctgtagtcccagctactcaggaggctgaggcgggaggatgaggcaggaagatctcttgagcccaggagttcaaggccagcttgggcaatatagaaagaccctatctcatttttaaaaataattaattaattttgtaaaaggaaataaatttttttaaaaattgaagcccagtgagaagtttatgtatttctagacattgtatctgttgacaaaatatgtaagtatttgatagaaatttttgcaataatgaaaataactaccattattgagtacttaatagatagctggctttgcaaaaccccctgtgtattatctcttgtaatcctcctttaagtcaggtactcttactgtccccatcttacagtgaggaagctgcatttgacaaggtcacacagctaatgggtgggagtttggagagtggagttgtggatctcagactcaggacactatctcctttggttcactcagttcaacagtttggttttttgtttttattttatctaattgtcattgaatctacaaatctgtcttataggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaa

SEQ ID NO: 23995 - DNA, 1050 bp, Homo sapiens
ggtctccctgtgttgcccaggctggtcttgaattcctaggctcaagcaatcctcctgcctctgctttccaaagtgctggaattagtagcgtgagccaccaagccccacctggctctgagtcttaataaccatcaattgctgtttaagtcagcttttttgtatatttgtgtgtggttgttagaaacttttaatttacatttttctgccttccagaaagctttctagccctagttgtactgaatgcaactgatgattaagcagtaaactacattaaaaaatttttttgttaacaatcaaggccttggcagaacctttttcctcactttgctatacggaatgactcgtggttctgtggagctcacctcatgtatatctgtgctgattgatacaaagttgatatgtctgtctgtttctaacatctttgcttataaatattagatctccaagacgacatagatccacatctccttccccttctcgactgaaagaaagaagagatgaggaaaagaaagaaacaaaagaaacaaagagcaaagaacggcagattactggtaatgttattagataaataactgtaggaaaagtacagtgatgataaaattataaaagtttaatcttgaacatttaaatgttaagccttttatagtattcattgcatatggttttgagttttttttggtttttttttttttgagatagagtttcattcttgtcactcagactggagtgcaatggcacaatcttggctcactgcaacctccgcctcctgggtttaagcaattcttgtgcctcagcgtcccagagtagttgggattacaggcacccgccactatgcccggctaatttttgtatttttagtagagacgggttctcaccatgttagccaggctggtctcaaactcctgacctcaggtgatcctcccgcctcggcctcccaaagtgctgggattatagacgtgaaccaccgtgcccagcctgagattttgttttaattgcaccctagcaagttgctggttatctatggtgctcctgatatagaacgatagttaa

SEQ ID NO: 23996 - DNA, 1008 bp, Homo sapiens
aggctggagtgcagtggtgtgatcttggctcactgcaacctccgcctcccgggttcaagcgattcccctgcctaagcctcccaagcagctgggattacaggcacacaccacaatgcctggcaaattttcctatttttgtagagatgaggtttcaccatattggccaggctggtctcgaactcctgacctcaagtaattcacccaccttggcctcccaaagtgctgggattacaggcgtgagccaccacacccagccaaatttttgtattagtagaaacagggtttcactgtgttggcccagctggtctcaaactcctaacctcaagtgatccacccgcctttgcctcccaaagtgctgggattacaagcatgagccaccacgcctgagctttctgcagagcgctttcatcaatgtccttctctcttgtcctccctgcagaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtcca

SEQ ID NO: 23997 - DNA, 1034 bp, Homo sapiens
cagtgaatcatgatcatgccactgtactccagcctgggcaacagagaccatcttaaaaaaaaaaaatccttccattgaatagaaacttcaaagtccttcatcagatcatggcattagctactttagcaaaatagtgtaaactttggttctgagtaaaaatgacttcttccctaccacagttgtgaatgttaatatgctgataaaactgccaagatatatttgataggtaggggattaaactcatggtttgtcaaaagagtgtttttttctagttttattcttaacagatatgttgaggtattcatatttgtttccttttgtggttttaatgaagacaatttgtaaagtaatactgttatgtatatgctaaatgttggtaaatactaattaatttccatcatttgtagacttgttttgcaatgggatatatttttacttataataccaatttaggctgggcgcagtggctcacgcctgtaatcccagcactttgggaggccaaggcaaacggatcacgaggtcaggagatcaagaccatcctggccaacatggtgaaaccccatctctactgaatacacaaaaattggctggacatggtggcgcatgtctgtaatcccagctactgtaatctcagctacttgggaggctgaggcaggagaattgcctcaaccgggaggcggaggttgcagtgagccaagatcgcaccactgcactccagcctggcaacagagcgagactctgtctcagaaaaaaaaaacaaaaaccagtttaggctgggtatggtggctcaccagcactttgggaggctgaggcaggtggatctcttgaggtcgggagtttgagaccagcctggccaacatggtgaaaccctgtctttactaaaaatacaaaaattagccaggcatggtggcgtgtgccagtaatcccagctacttgggaggctgaggcgcgagaatcgcttgaaccctggagatggaggttgcagtgagcagagatcgcaccactgcactccagcctgggcaagagtgagactg

SEQ ID NO: 23998 - DNA, 1134 bp, Homo sapiens
agcagcgaatgggaccgaagcggtccccgtttctccgcctctcgggccagtcccctagttctaggcccattcggaacggctactgtggcgggggcagaaatggagtgcgggatgctgagagcctggactccgtcccgtgaccctcaaggcaagtgcggagaaaagcgtcttgcgcgctccgcggggacaggacgtggagggagcagcgtcggcaaccgcgggaggaaaaggccccggctctgcagggcggccggggtgcttcctcgcctcctgcctagccgcgtttcccgtccccggcaatcgggacccgcacggattgcccaggggagacggcgcgggacgcggagggtggcgtgcgcggcgctagcccgctgtgcttcactctctcggttcccacttcctcgcggcgcctgggcccagccggctctcggcgccgccttcccgcggcctggcctttcacgtccttctctttctccctcggccctcgtcctcctctcgtctttcccggccattcctctcagccgaacgcgccttcccagcaccttcttcctgcaagctcctccatctggactgcgaccgattacccagctcttcccggcctcctctccgcgaggccgaggctccccaggtccccagcgccagcctttcgcaatgccaagggctccgctttccctcgatctgggcctcgcccggcgagatgagaggagaaaggggactccggggtcttgccctcagcccgaccccaggccgcggccagagcctgaagtccgctgcctcctccatccctaagccctgggaccgggagacccagcgccagaagaggccactggcggtaatggctcccccaggctccttcctgggctccctcctcccggcttcctcctgctgcctctttccagcctcttcacacgcgccgctcgggagagccactgggcctctggaggctaccggcccgagcggatttctttggcctccgcctggggaaggcgaacaggctggaagctggccctgggtcgttccagcgaggggattatgtttgatctgagctcggctaccctcaagctgactgggacaccctgggccagttgggcactacctctctgcggctgctgggtgtgggtggcactggggact

SEQ ID NO: 23999 - DNA, 1079 bp, Homo sapiens
ttggcccctgaatgaacattccttccataggccttcaatacactttgcccttgacctcagagaacacatcctcccaaagagcctttggaaggaaaccactaaaaggtaaaagggaggcatttgcccttgctgtcctatgtcaatgttgggttggggcctccccaggacctgtcctttcttggggaggcctcaccccttctgggtcctttctgcctccctttcattctgcactcctccacctaagggcataccacaggggggtggggggcaggtttgttgagggagtcctttggcacagggagtaggaggagagcttgggcaccagagttaagcaaaattggtttagattactgaccttatagccctttaaacctgaaccagtttctttgtttctctttgcttgtttccttatcttacaaagggacccatagcccttatcttaaaggacttgccaagaatcagaggtgatgtctataaaattgcaaacacccagtaggatcttcataaatatttgttgacagaaggaagggtgtagctctgaggtgacccacgaaccacttttgatgggtggggcagtggaccttcgttgtctgaggcctctcccaagtcacccctttccccctccttctggctctgggcccggggcctgggctgtactggaggtgagcacctaggggttaagaagccactaatggtaaaggaaaattagcaccatcttgcagaccacacagtgcagccctccccaatctccttggtgggaccctttttgggccagtgactcaagcctctgcgaatacagggtggagagccaaagaggccaaacgtggtgcgtctcctgcctcaaaatgaagactcctacatgtcacacatgggcacggaccagagctgctgagatgataggccgggcgcataacaggcaccccgcacatcgcaccgcggacgcagcgatcctcccatttgtaccctaaggcctgagaaggccgctccacacctccgcgtgcacagtccctagaccagtgagggcggggacggggaaatccttttgttttatattggaaaccttacgccaaaggcaggca

SEQ ID NO: 24000 - DNA, 1632 bp, Homo sapiens
ctcctactatccctaacaagctgtcctgcctccgtttccctatcagtggcatggacgtacctaacctcctcagaggaaggctggaccacagcacggctgtacctaacctcctcgagggctagactctccccaccctcgactctcacaggatcttcttttaacgggaaagaggaggaggtggcaagtcaatgccaactaaattttctagggatcttgatggcctccaaaggcctttggaatatctcagtctcagcaacatgggtggtaagtgaagtgggccccaccaaaggtaagtgggctgtgggctattttgtagcccctgggaaactggcagacactgacagtatcttgagtcctggggttgggaattcttgagccataaagagccctgcaaaggtacaagatcactctcttatcctccctccaccaaccagccccactccctcagcctcccaccccacctcctagctgagcaaactggaagtctcggtgcccctttgacccctcttgtcccagaccccacacctgccagcgcccatgtctgtagctccctcccaccccactgctaccttgtgatggcgatggccttgggctcccagcctggcaccctcctatcctgtctccatcctccagcccttcagacctgacccttgcatcaaatttgcccagggctctccagtgccctcagcttacaggtcttttcttttttttttttttttttgagacggagtctcactctgtcccccaggctggagtgcagtggcgcaatctcggctcactgcaagctccgccctccaggttcacgctattctcctgcctcagcctcccgagtagctgggactacaggcacccgctaccacgcccagctgattatttgttttttagcagagacggggtttccccgtgttagccaggatggtctcgatctcttgacctggtgatccgcccgcctcggcctcccaaagtgctgggattacaggcgtgagccaccgtgcccagctgcttacaggtcttttctatgagggtgcctgcaagcctttccactcactctcatcactctcccttccctgtgtagaaaccaacacctgaaatagtgtctgcatggggctgccatttgagatctctgggcacttgcatgtcattttttaaaaatgtgatcagtaatgtatgtttattaacaaattaaattacgagatgtcaccgccagtttcactgctataattttaaagcagtgatgagcacaaatactattttgagatacctgcaacgactgtaatgtggtatgaaaatatctgtgatttctgatggtaacaaagtcacaggtaccgtggaaatgctaattctaccgtggtttgttccttacattcagaactagaggaaacactaaatttgcgtaaacgttaatgaatgtaaaaatgtaactttcccattcaagatcacagaagccctgagttctctctgtagactctgagataggttctaggcaaagaacccttctcacaattagttggacaagaggatagagtatgtagaaaggaatgacaaagaatgggggattgtgtctgtgcattttataatagacacacaataattgtacatattcctgaggtacacagtgatgttttgatacat

SEQ ID NO: 24001 - DNA, 1197 bp, Homo sapiens
tccaagtagctgggactacaggtgtgcaccaccacacctggcaatatatatatatatatatatagcattttcagtagaaacggggtttcaccatgttgcccaggctggtctcaaactcctgatctcaagtgatccgcccacctcggcctcccaaattgctgggattacaggcatgagccaccacacccagcctgagttctgtatatattctggatattagcctgatttttaaaatccttgatccctggaaggactgcgtgagtcaattctagtcccatgccactggtatcgaaggacgcctgagcagagggaagcactttgcgagtgtgtttacccctagtccacagaggcagaaacagatatgctgtccaggatcccgaggcagcccagtcattattacatctttattgaggttttacaaagtgccaggcaccatgctaatggatctgcatatgttatctcatttcctccctgcagcagccgtgggaagtaggtgttattattatccacattttaaagacgaggaaactaaacctcattacttatgacttacgtatttaatgagttactgaaatcgtaaagtaacttccacaaggtcaggcagctactaagcttcagagtttcagctgtaacctggtcttgcaactctgaagtgggtgcaactgcctcccaaacagaattcaaactttcacttcccagccccttgagttcatttccacaagtgtctggacactagaggggagagaacagtttgggactgggtcagggagggccggaggaggagaagggactttgcctccagtctcactgtcacgtggctgctctcccctcctgccagtttgcccagtatgcggagatcgtccacttcaccctcccagatgggactcagaggagcgggcaggtgcttgaggtggctggcaccaaggcgattgttcaggtgagtggggtcaatgggacattggctagttaaatcaatgaattaacccataaagttcccacactatctacaaactctgaaggcaggaaatggtctatttccctgagagcacagaaagtgcccagaatgggtagccccattccctccagcaggccccttagtggagaaactccctcttgttcccacaggtgtttgaagggacatcagggatcgatgccaggaagaccacttgcgaatttacaggggacatcctacgaact

SEQ ID NO: 24002 - DNA, 1058 bp, Homo sapiens
aaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaaggtaaagttttgagagaagagagagcactttcctcctcaaattagcttttcttctgtttttctaggagagatttaattgtagttagaagatttagtgataagaaatattgtgctctatcttatcagttataaatgaatctgtacttccattcaatttatgttccagttggtcttataattttgtggtagtgttattagttgccattttcacctaataattatttagttattagtttggttattagttattagcttgtagtgttattaagtcagaaagtaatatatacatacaatatacatgcaaatctatatgcatgtgttaatatatttttctatccctaattaatagtttttaatatctttttattttagtcaggtaaaagttccagaaatctgaaatacaaagatttttttgatccagttgaaagtgatgaagacataacaaatgttcatgatgatgagctggattcaaacaaagaagatgatgaaattgctga

SEQ ID NO: 24003 - DNA, 1081 bp, Homo sapiens
agaaataaattgtaggttttgttatgttctacctgcactttatgtttcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccaggtgaggaagcctgtaaggccaagccattattattaaagaaatagaagtagagaactaggctttttgtgactgttgaaatcgtgaaacagaaatcttgagctctttggctacctcatgtaagtatgagacagagcatgctaggaatagaagggttctaatattcccgctggatgtgaggggttgaggggggttgctttgcaattagactttggtcacctgatacttttacaactcattaactttctagcaattatggtggtgctacaactttaaaagcatttctcattgatattttgaagtaactgatatattttacatgattatgaattcattctgatttttaggtctgttttttctttcacttaactaaaatctctgggctgggtatggtggctcacatctgtaatcccagcactttgggaggctgaggcgggcggattgcttgaggtcaggagttttagacctgcctggccaacatagtgaaaccccatctctactaaaaatacgaaaaaattagacgggcgtggtggcatgtgcctgtaatcctagttacttgggaggccgaggcaggggaattgcttgaaccagggaagtggaggttgcagtgagcccagatcgcgccactgctctccagcctgggcgacagagtgagactccatctcaaaaaaagaaagaaagaaaggaagaaatcgctggttaaataataggacaaggtcctattcctaggaatattatatgctgatataataatcgaattattccttcacatttgatttattgggaatgtgggtacttagggatcagatggcatttttcttctgcaaaagccatttacgattcccaccagattttgttaatgaatgcccctcagttagcaacagcaaattgccctg

SEQ ID NO: 24004 - DNA, 1085 bp, Homo sapiens
tagtttgaagggaaaggagtgcctgtttcttaccccataaggactaggaaaagggattgctggcttgagaaagaggtgctgtaagttatcctctgcggccagaattctgaggattggaagattatggattttttaaaaaatgaaggcatatagaggaatggtagactactgtaattattcttaataggatgttgggaaatacaaatgctgacctattttattcagtaattaggggaagcttaagtactttaaatgcacccttttaaaattgccagtgttactgtgaattgtcttgtaaaaccaaaaagcacccccaatttagcctttctgtagatcttttacatatgcttaaaggatttgggtcgggattcttagtgtctttgtatttaattttgtgtcttcgaggaaggggagctatgaaatgtagtacttccataccttttgcctctggggacgttttttggtggcaaggaaaacttatttagtgctgatttacgggaatagaatggtttaaggaatttgttggagattgctcgtttaaaaaatgccttgggttcattatgatttggtaaattgtacggtattgctatatttcatccaaaataattttccatttcagggtaaacatttgaatgtacattgacacttctatttcctaaataataagttttgacctttcttattttgttttcggtcatcagttttgaaggattattttttcccaaatttgcttaggtttgctttcatccacaaccacgtgcccaggttctaaatttggaatggtgctaatagtgtcaaatgtgcaattctgggtaggtatatgtgggtggatgggatggcttataggttgtattaaaattttattttttttctccgttgaaatgtcagccccaccagaaactattaatattatgacattatctccttcaagaaatggatgtgatgataaaatgctttagtaattttgaatattataatattatgaccactaacattaaatgctgtgatttttaaaaatggctttcaattagaaggttttgataacttgagtctttctgtcatctctcagtaatgtgccattacta

SEQ ID NO: 24005 - DNA, 1031 bp, Homo sapiens
ttaccagtttacatagacaccatggcatatgaggctgcttagttcttccacatcttcaccaccactagatattaacaatctttctcatttttgccaacctgaggagtgaacaatatcttattgctgtttgataacgaatacatttgaggatcttttctctgttggctatttgcatttcttttcagacttgcttgttgatatcctaagcctgtttttttttttttttttttttgttttttgtttttttaggtacagtgaaattgaattttttcccttttggggtacagtgccttgtattttaacacatgtatagatttgtgtaaccacaaccattgtcaggattaaaaaaaaaattccatcacttcaaaaaactccctcgtgctaaccctttataatcccactctccccccaactataacttggcaactcctgagccgttctccatcactatagttttacatttttgagaatgtcatataaatgaaatcatatagtatatcacttcttgagactggactcttggactcagcataatgtcttcagattcagccacattattgcatgaatcagtagttcattcttttgattgctgagtagtgttccattgtaccaaagtttgtttatccatttgctcattgaaggacatttgggttgtttccagtttgggtttattattatttattatttaaataaatcagctatggacatttgtgtacaggcttttgtgtgagcataagtttttatttttctaggatactcaagagttggcttatacagtaaatgcatgtttaactttataagaaagtgccaaactattttctagagtgactataccttttttctgagatggagtctcgctctcttgcccaggctagagtgcagtggcatgatctcggctcactgcaacctccgcctcccaggttcaagcaattcctctgcctcagcctcctgagtagttgggattacaggtgcgtgccaccatgcccagctaatttttgtatttttagtagagttggggtttcaccatgttg

SEQ ID NO: 24006 - DNA, 1705 bp, Homo sapiens
gcggctccgcacaaaatggcggcgggcagacggcgggggcgggaggaggttgggggacccccgggatgggaagggaagctgtgctgtgctgccctgctccgtcgtttattcacttcgctacccgggagggcccgtccgggtactcgtgaaggaccctgcctcgagaagagctgcctgacgccgttgcactgggccgaggatcgtgaagagccctttggcgaggccgaggcggccccttccccagcagcgcccggcctgccgaggctgcgctgggcctgacagccgaggaagcggtggtgagggaatgccgagcagggaggaagcgttcccgtcgggcccgaagaggcggtggagtttgagccgagccctctgaccagcgacattgtgcaagaagcgtggagagaagagcgtgtttgtgtttggggttggggagggggtgtcgggatgaaggagggaatgttaggatccagcggcttttccgggctggtgttctgtgctgcgtagtgcaggtatgaaaccaaagaaaatatcacctctgtgggagactgaggactcataaatggttgtgatacctaacagtatttccaaatttctcagaggaattgtgaaaacagaacgttagtgaattgtttttgtgtgattcttagcttgggccccgttctcttaaaggaagggggaatgtatatatcacagactggaatccttgagaacgtttgaaatagatcttttgttgtttgaggtaattgttaatgagggatacttcagtattacaaaatcatggattgagctatagagtgaaggctacctgaagctaatttttcttaatcttaaaatttgtccttaggcgaagtttggggccaggaccagaaattgtagtagtttaaaggagtcccgatgaaaaacttgtcaccaggatccagcgatttatgttcaagtactttttccaacgagctctggaattttgcacaaaaaattttctgctttttcccctcatttgttgtaaaggattattttttcagggatgttgtgcttgctggttcagatttacaattaaaaattgataacctggagaaaaggattgaccaaaaaaaggtgaatttaaggaagttttcggagaaaaacaaacatgtaaatgacattcaaatagctttaaattttgttaatgattagacatttgagacttagtggacttatgttgctgtcttttaaaaaagtttgacagcattttatattttattttgtactccatattctgtaatatgtacttctaaataattacagggcgtcccagcatgttatacattaaaatatgctgggccattccttccttggggatttatttgtcttggaaccaagaaagggtaaatataacagttggaagaaatcacaaaatcttattcgtttttattaactagttttcataatgtgtttatggtcacatatttattgtatattggttgtatttgttttgtaatccttttttgcattttgttttggagggtgtatacggcaggtactctaggttaaaaaggtttaggtactgtagtttaaaaaagtcatcactttgtacttgactatcttagggtttttcttgggtgctcttaagtaggtgatctccggaaattttgtttttatgtaagtggaagaaaatgagacaagtagtttagtggaaagagaataggctttgcagtcggaagatctggat

SEQ ID NO: 24007 - DNA, 1072 bp, Homo sapiens
gatgaaacaggcttggattaaccagcttgctccgggtaacattgttagcaagcagtgggaccagagttatttcacaggatgaaataggcttggattaaccagcttgctcagggtaacattgttagcaagcagcaggaccagagttaaaacactgaatgtagggtctaagttcttaaagactgtgctgcactacctctctaaagctgaattagtagtgctaaattttacttaaggagttaactaattttgcatgaagtcattcactggcacccctcctagcagggtgggtatcttcagatcagtggaaatttccccaaagattagattattatggattgcataataggctgactaacagtcaatagttaggaagtgaacatgatgtagaaaagaagggccaaatccaaaaatgtgtttaaggctgatgctctttattatactgcaggttttctgcctcttgccatattgcctatagttttttttttttttttgactttgtataaagtaagaagatcacatagtccaatgttggacatgaaatgttgtgccattaactatatttgaatgaatttaagtgacaggtggtgggggagttccctgtctcctgcatatatggttttttcccgaaaagtttgacattaagttgcatatattgtggtcctttatctctaaatacttcagtgtgtatttcctaaaaatattttctttcacagtcatagttaccaacttcaatgaatttcacgtttataaaatccttttttatttttttgaggaagtgtctggctctgtcacctaggctggagtccagtgagtgatctcggctcactgcaatctctgcctcctgggctcaagcgatcctcccaagtggctgggagtactggctcaggcgcgcaccaccatgcctggctacgttttatattttttgtagagatgggattttgccatgttgcccaggctggtctcgaactcctgagctcaagcattccacctgtctcggcctcccaaagtagtaagattacgtgcatgagccaatgcgcagcctataaaattattcagtctactatttgtattc

SEQ ID NO: 24008 - DNA, 1027 bp, Homo sapiens
tgttataatactgacaaacgttactgaaatttgttttttttctgttagattgttggcactttggctataggaacgcaactgtattttatttggctttgaaactaaaaagtagcctggtgactgtcatgttaggctctcagaagatatttaatacattgagtgaataattctgagcttactcctttccactaaaaacaaaaaggggaaaaagaagggtctgttaggatgtatctcctcaccccaccccacagtggcatgcaggatttagatggaaacttgtaagaaggaaatttgtgacctactgtcattcccaattaaatgttcctgcctgccaataagtaaaacagaaacaacaaaaatcagtgtttagcaaaattgagatgtatggaagtgatcgagtagaaggcattaggcatgtagcagtgtaggagagccagtagctaaaaattaaatggaatagaagagagattagattgtctcctaaccatgtgaattgaggccttaaaaatgtagattctgacacccctaaatagaatttcttaacctttttgggtcatagacctttttgacaagtagatgacagactcttatagtttgaatttgaattttctgctttctgctcccctctccccaccaaaaaaactcacgttttcctgttgtatcacaccatctcctgttaaaattaacagcttgccgccaggcgcggtggctcatgcctgtaatcctggcactttgggaggctgaggcgggtggatcacaaggtcaggagatcgagaccatcctgggtaacatggtgaaaccccgtctctactaaaaataaaaataatcagccgggtgtggtggcacgcacctgtagtcccagctactcaggagggcgagacaggagaattgcttgaacctgggaagcggaggttgcagtgagccaagatcacgccactgcactccagcttgggcgacagagcgagactccgtctcaaaaaaaataaaaataaaataacagcttgccctctacttttagtatccaaat

SEQ ID NO: 24009 - DNA, 1047 bp, Homo sapiens
tcctatcttttttgtatggattctgattctggtcattaaaagcctttacgtagtagtgtccctttttctgagggagatacgttctaaggacctgccagtggatgctgaaaatacagatgtactatagtttatttgaccagtttccagtctctctgcaagcttttataattgcagaagcatgaaaagggaagttttcaagagatttctaactatatattgtatcattttggttaccctaatttcatgagatactagctccatcttaaaaagtagagtgttagctatatgaaggagagatctgttctggctgtaatatctttggtcagtaattattttgtatgaataaaggctgaatttgaacttattctctagatttattgctaagaaaactttctcaaaatttcttgggagtacttaacatttaaaaaactgtcttgaatggcctgatacttaatcttgtaattttattcccttgaattgattgagaaggacatacataaaagttaagtgacaaagtagaagtgctgttggtggggcacctaagttaaatttgaaaaaataaggcttcagaattatgtaattgcaaaaggaaactataataccttataaatagaaagcttgaagtataaataacaagcatccttttagttaaaacattttatttggagtggatatgaatggtagaagacaaactttgctaaatgattaaaaatgtagctaacctttttaattaaaagtgaaaattgtgcaaatgaaatatgagtatacagtagtctccccttatccatggctatactttctgcagttagttacctgtagtcaaccaccatccaaaaataggtgagtatggtatgagaatgacattttgagagcaaccacattcataaaactttcattatgctatattttaattatttttaattgttaatctcttactgtagctgatttataaattaaatgttatcacaggtatggatatataggaaaaaacacagtatatataggatttagtaccatctatggtttcaggcatccattggggatctt

SEQ ID NO: 24010 - DNA, 1050 bp, Homo sapiens
ttgtagaagaccactcttagagtactctagtattctggagaatacagtttgtcaggggcagttgtcttaaccttctataaatgtgtacttgaatcattgtaatgcaatgttgggcacattaggaaatacacagtacatttttgcctttaaggaattttaaatggagattgttccaaatgatacttattcacaattccatttagtaattagatcactctgattgaaatttgttcttttgctgttttattttgggggagaaacattatttgaaagagcttgtgcttatgaagttataagaggagtcttcaccaaatggaataagtggttcagaaagcattgtaataactacatgataaactgcttacataagcaatgcgtatcttttaggattgggtgaagacagttgtttttggaagatattttattatgtagaaggtaggcacaatttcatatgattcatgattgtttaaaaagaccgtgagtttgttacaaatgaactttttaacagaatgtaggtatcattgtttggtaagcttgtgtctgcagcttgtatctggtgaatcaaaagcctgtgtatttgatgtgtttttgtgtttcattctaatttgaaaattaacctgtgcatgttactaatgagtactttggatgtgaccagatagtttaacaaatacttgaggatcttttgagtaggagtagggtttatatgcctgggggataagacttagccatgaacataaaccttcaactgacattaggttgttgaaaaagaccatgtgtgtgtgagtgcaaaaacataagatagtaagaatccaaaaatggtgcaagcaataaataaaggttattgaatgccgggcgacgtggctcataccccagcactttgggaggtcaaggcaagtggatcacttgagatcaggagtttgagaccagcctggccgacatgacgaaaccccatctctactaaaaatacaaaaaattagccaggtagcatggtggcacatgcctgtaatcccagctactcgggaggctgaggcaggagaatggcttgaaccc

SEQ ID NO: 24011 - DNA, 1083 bp, Homo sapiens
atgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgt

SEQ ID NO: 24012 - DNA, 1064 bp, Homo sapiens
ctgtgtaacgtagaatgtagtcatttgaaggtgagtgtttttaaaaaaagatcactgtataatgatgctcagcgccagttttctctaaattctgatatgtatgctgcttgttaactaggcgttaaggaaatggcagaaggtaattttaattgcaacctcaatacatagttgtaatcttaagtagccctggccttagtactgaattgaattttaggcttactgtattcctatgaccgggcacaccatattttagtagtgtgtccatttattttgaacttttagttatcccacttacgcaacataaaatttatgtaacataagctgcgtacttacaagacaatgtcacatggaatcacctttctctaaaaggatctgttagtataaaaatacaaagagatggtataacccatttgtaatgcacacatttaagagacagtatattatagccttgcacatatacacctgtcttgggataaagacaattaatgttgatttaaatatttcctgactttatgtagactagtgatttttagtattttttgagaagaagctttctaaaataacttcatagcaaaaataagtcaaggtgcagtaattattctgggaccagctgtggactcagaaaatagtgtaaaatgatagaaatttgtagagaaaaatctttaaaaaataaagatgatttaggtagtttgatagtatagttagaaggaagtattttgcagaggcagtgaagtgtactataatgtagaacatactgttcagtcgtaatcattggtagatttgagcaggaatttccaagtaaattttatttacttacgtatggttggcaatcactgtttcttctatttactaatgtgatttatagatttagattgtaaagggtcagaagagaatatactaacatgggaaaaagctttgattcaaggccatggcctggaattggttgtatacttaggcttaaaaatctgtgtgttaacgctcttgttcttttcttccagtgctgcctttcgattttcttttcattatttactcactaggttttcgtcaacatgaatctgataatt

SEQ ID NO: 24013 - DNA, 1050 bp, Homo sapiens
aatttaggttcttcttttaagctcaacattaaaatgtgtggaagaaggtactatagtgctacacatttcactaattttgttttgggaattacagttggtttttataaaaatatttatgttaatatgggaatttactttttttgccattactttcagtggcaaaaactgcagttacttttgcaccaacctaacatatgaattgataaatatttttacaatttaatttctaatatggtaaatatcagtaaatataacacaaatctttgtagtcttcaataagtgtaaagcaatctcaaaaccaaaagtttgaggatcactggtataagggaataaaggaacttcatgtaaaagccttctgagtgcataaaatctagatttttgtattgtctgtgtgctccctgtttagcttgagaatagcactatgtgattatgtcatgagatggctcctaccttaatttttttccaattgaaattatatttatatctttttactagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaaggtaattctttaattaataattatttttagagataaggtttcactctgtcatcctcgctggactgcagtggtgcaacaagcatggctcactgcagcctcgatctcctgggctcaagtgatcctcctgcctcatcttcccaagtagctggcaccacaggcgtgtgccaccatgcctggctaattttttaatttttgtagagatggggtcttgccatgttgctcaggctggtctcgaactactaggttcaggcagtccttccacgtcagcttccctaagt

SEQ ID NO: 24014 - DNA, 1573 bp, Homo sapiens
ctgttgttttagtttaacttttttgtttaagtatggcacacatatagaaataggcatagaaacataaatgttagctcaacacattatatgtgcattaattcaagtatgttgaaattaaaacttcctcatacatgtatggtgctatatacagtattaaataacgacgactaggagaaaatacttgccatatataacacaaaaatagcaaacatctgtgaatctggtacctaggtcacaaaagagaacatttgacagtatctggaagtcccttgcttgcttcttcccaattcttacaccctcccttcttctcacaagtaaacactaacttgatttctaatgccatagttgagttttgcctgttttcaactttacataaacaaaatcgtatagtgtacattctttgggcctttacttccttagaagtatcaagttttgtaactttaatttttctagatcatttctgtgcttcagttcatatgatcgtagataatatctatagaattactttaaattaccctttaaggatgagctttctgttaagtaaaaagctatatgtatatctcacctgtaaggttttctttgtgtatgtgtgtgttttttaaaatagggtgttgagaaaatatttttatatcttaaaaaaaattattgtatttttaatttttgtgggtacatagtaggtatatatatttatgaggtacatgagatgtttagatgcaggcatgcagtgtgtaataatcacattatggaaaatgggatatctgtcccctccaacatttattctttgtgtatcaaataatccagttatactcttataattgtttaaaaatgtaacattaaattattttttactatagtcactctgttgcgctagctaatactgggtcttactcattctgtttttttttggtacccattaattatcccctcctctaccccctgttacccttcccagcctcataaccatccttcgactttctgtctccatgagttcagttgttttagagcccacaaattgtgggattttttagataccacaaataagtgggaacatgtgatctttgtctttctgtgcctggcttatttcacttaatataatgacttccagtttcatccatgttattttaaataactgaatctcattcatttttatggctgaagagtactccattgtgttatgtaccacattttctttatctattcatgtgttgatggacacttagtttgcttccagatcttagctaatgtgaacagtgctgcaagaaacatgggagtacagatacctcttcaatatactgatttcttttcttttgggtatatatacccagcagtgggattgctggattgtatggttgatcctatttttagtttcttaggacccttcaaaatgttctccatagtgatcgtactaatttacgttcccaccaacaatatactgagggttcccttttctccacatcctggccagcatttgtttttgcctgtcttttggataaaagccattttaaccggggtaagatggtatctcattgtagttttgatttgcatttctgtgatgatcagtgatgttgagtac

SEQ ID NO: 24015 - DNA, 1702 bp, Homo sapiens
ctgtcacgagtatctgctagagatattctttagtcagccaatcatatggcattgaaagtgagatacttgggaatttttttaagtttaaggtctaaattttggaaagctaaaatacttccttgcaatataaatgtagaaagaaaaaggagcctataaacaggactgagaaagtgacaggtgagaaaggaagggtacttgataattttttgagatccgctcagattgaagagtgacaggaagagttaattagagcagttttaaggataaatttgattataagcacagggaggaagcaagagtgtaatttgatcatgaatggaaacattcgagctcttacccagtactaattaaaaagaaaaatagtaattactgagtagctattatatgcccatgatagggggcactttgtagaggcttaggatgtatcagtggaccaaataggcatggctgtccccagacagtttacatttttaacttgaggtgacaaatattaaatataaaataaacattaaataatatgagttttagaaaatgagaagttctgtgacacaaagctaaagcagaaccagggtaaaggtgatgcaggattagtttgttttaaagttagaatttagtgtacaaaataaggtaaaaatgacttattaagtagacagacctactaacataatctgtaccagaagagagaaaacaaagaaaagaagcctcacatttgtgggtatgatatttatgctggacacatgggcacatagtatatttatgttattttgtttaatctttcaaaccgttctttgagttgtagttaatgtttggctgggtgcgatggcttatgcctacaatcccagcactttgggagtttgaggcgggtgcatcacctgaggtcaggagttcaagaccagcctggccaacatggtgaaaccccgtctctactaaaatacaaagattagctgtgtgtggtggtagtagtcccagctactcaggaggccgaggcacgagagtctcttgaacctgggaggcagaggttgcagtgagccaagatcgtgccactgcactccagcctgggtgacaagagcgagactccacctcaaaaaaatatattgttctcattttctagaagagatagattcagaaaggttaaatgagtcagggccacatggaggagttagaatttgaacgcaaaactttatgattccaaagcgttgcatatactaaattacctccctcaagaatgaaaacttcttgattttcttggatcactacttttctccagcctttctagttttcctaataatcttttcctcttctcatgtcatgcttttcttcctgggtggtttttttttttttttttttttcttcttttattgagatggagtttcactctgttgcctagtttggagtacagtggcatgatcttggctcactgcaacccgtgcctcccaggttcaagtgattctgcctcagcctcccgagtagctgggattacgggtatgcgacactatgcctggctaatttttctttttttttttctttttctttttttttttttttttttagtagagatggggtttcaccttgttggccaggctggtctcaaactcctaaacttaagtgatgcacccacctcggcctcccaaagtgctgggattacaggtgtgagccaccatgcctggccctcttcctgggtgatttctttcctgtcagtctt

SEQ ID NO: 24016 - DNA, 1043 bp, Homo sapiens
gggggaacaggctaatacatcaaatactgacaaagacactacacacctatcagaatggctaaaataaaaaatactgatagcaccaaatgctgatgagtatgtagagaaactcatacattgtgtgcaagagcaattgtgaaatagtacagccattctagaaaagagtatgacagtttaacttaacaaaactaaacacatgcttaccatatgacatcacttacactcttgggcactcatcccagagaaatgaaaacttagctcatacaagggcctatacacgagtatttatgggtactttgtttataattgccccaaactggaaacaacccaaatgttcttcagtggatgaatggctattttaaaaagttttatattataaaatttcatgtatatcacattgaaatgaaattacagagagagaacagattagtgatagtcagggttggtgggagggaggtggctattgctataaatgggttttagaagagatcattatgaaggaaccattctgtatcttggctggtggtagtcacactgatctacacctatgataaaatttcagagctaagtacacattacatgtaaaatgagtgaaatctgggtgttggtagattgtatcaattgtgtcagttttctgtctgtgatactgtactacagttatgcaaagtgttaaccattggagggaaactgggtgaagggtatatggggtctctccttttttcatacaactccatgtgaatttacaattatctcaaaagtgaaagttaaatattttttaattgctgacagctttcataaaactatagaattatatgtaggaatattaatgttaaattttagtgtaaaattttaacatatagtgtctgcgagcactttgaataatggactatgcacaagagagggtcgtattggaagtataaagatggttcaaaatgaggaaatctgttaattcaatactaccatattaaaaaaagaacatatgatcctttccataaatactgaaagggatattaacttcaacatccatttctagcatttaaaaa

SEQ ID NO: 24017 - DNA, 1031 bp, Homo sapiens
gacgcaaaccttcttggaagtcctgggaggttttgcaaagcttcgggagagaataaaggctgaaggcagctaaattctcttaccctgaggctaagggcaagtagtaggtaacaaaggagtgtaaaggaatttatctagataagtttatttacttttgccgacctttgatcatccgacctttgatcatccgacctttgatcatctgacctttgatcatctgacctttgatcatccgacctttgatcatctgacctttgatcatccgcgtgcaggactgctccctacaggcgggggcaacaactacccacagattgtgttggctccaggcctttgtcattaaatctgtactaaataaatacaagcagctccagcttattggggctgcgttctctcttcggcgtctctaaggccgagcagtttcctagctgcgctcacgcaaaatacctgtgtctgcgtacttttttcatccgtcgctcggccagagtcggtggatcagactcagcagctggtgcccctcgtgaggaacactgcaagggatcacgacggaacccccgaaaatgaaggcgaagagactgtgcagtcagtaagtcattggtgcccactcgggatatccaagttcaggggaattctcagactagagtttcatcatgagacaacagctgtccgcacaacagaaacagtatataaaagtattgaaacaactgcttaaagctagcagagcctcggtttcacaggctcagttaagggtcctaaggcaaactgttgtttcccataatccatggttcccagcagaaggcatgctggacctagagctctgggaataagtggggagaaatcttaaacaataccataaacaagggcaacgggtcccagtaacatctttaaccttatgggccttagttagggctgctttggccctgctgtacacagaagatcccaagaagggaagggagaaggaaccatcacctaccttaccgccgcctcctcttccctcagccctgccattactgggtaaagataccaaagaggaa

SEQ ID NO: 24018 - DNA, 1411 bp, Homo sapiens
tccccctaaatctaaaatagctcagttactattcttaccgtactgggtccccaatgcccagggaaagaggaagggaagttttggaagcacgggagccgtaggagtgtattggaaccagttaatcactgatcagagacccatgattaccttaaaaatcggaaataagaattttactggcttataggatacaggggtgaatatttcgattattagttatcaaaactggtcagaaacttggccttgggtcactcagaaacaaaaaattgtcagcactggctaagtgcacacagccaagcagagcacacaccccctaacgttgtgatttggagggaaaaaacagttagcaactctaaacatgactgtccctgttaacctttggggacgggaccgattagcccaatgggggctgcaaacccctttctaataatggccactgttgttattcttcccctacccctgacgtggttctctcaagatccaatttgggtagcacagtggcctttaaagggagggaaataacagtgagcccatgagttagttcagcaattaaaagccagccatatagaaccatcaagcagcccttagaatttgcccattttcatcattcccaaaaggtctgggaaatggggacttgcatgacttacgggctatcagtggcagtttgcaacctatggggccccttcaacggggctcccttcccctgtggcaattcttcaagataggcctatagtcgatattgacttaaaagactgctttaatactattccccttgcagaacagggcagagaacaatttacatttaccatactagctatcagtaatgaaagggcagcttgccaatttcattggaaagtacttcctcaaggaatgctgaacagtcctaccatgtgtcagcatcatgtaaatcaggctttgctccccagtagaaaaaaatttcctaattgcaagattattcattttgtagatgatattttactagcagacccaacagagccaatacttttgagtttatatgcctctgtcgttaagatgttaatcatagcacctgaaaaagtacagatgtcctcaccttggaaatatcttaggtacatactaacttcctggtcagtaagacctcaaaaggttaaattaaatactagcaacttacataccttaaatgattatcaaaaattactgggtgatattaactggcatccccccaccttgggcataactactgataaattacagaacctgttttctatcctaaaaggcagtgctgccctagactcacccaggtatttaacccccgcagcaaaaagggaaattgaggaaatagaccaagttatttctcagagacaactagatagcatagatccacgatattcagttcagttgtttgtttttcctgctaaacactcctctacaggat

SEQ ID NO: 24019 - DNA, 1085 bp, Homo sapiens
tactgaatcagtacaaatagctgcttttgtagataacttggccagaaatgtgtctaatgaacttctcttacagcagggtacaaatcaaaaggttcttgcacatctgcaagccctcgaggctgccttggaacatgtaggggagtgacaagatgcgctggcattctgacagcaattaaactgtgactgggagcataagcatatctgtgtcacctctctaccatggaaccaatcaatacatagttgggatgaggtgaaacaacacctcggggtgaccttacatgataatttaacagcagacgtaaagcaacttaaaactaaaattctagaatccctaaacgccatagatctacatgtccaacaaacagttatatggaaggatgtgcaagaacatctctcctggatagaccctcactccttgattggaaaaaaatattactaattatactcatgtttgtcttatgttatttactaattctaggatgcaaagccggaatacgagcagtaatcgctacgcctgacaaacctgctgctgtgcacatctgtactcttcaatcaacaaaacctgatgcaaaaaacaaaagggggagatgtaggagatcagtcagggtggtgggaaaagttataaggagagacgcaaaccttcttggaagtccaggaggttttgcaaagcttcgggagagaataaaggctgaaggcagctaaattctcttaccctgacgctaagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggcctttgtcattaaatctgtactgaataaatacaagcggctccagcttatcagggctgcattctctctttggtgtctctaaggccgaacagtcccctagccgcactcatgcaaaatacctgtgtctgtgtacttttttcatccgtcgctcagcctgagtctgcaggtcagacttggcaggattttgacttgatatattgtgtgtgtttggaaat

SEQ ID NO: 24020 - DNA, 1348 bp, Homo sapiens
gtccttggaattagtaattttgcttctagttgatccacacattcagaaatttatttaacttgcatgaatgctattttaagtacaggttgagtatcccttatccaaaatggttgggagcagaagtgttttagattttggattttttttcagattttggaatatttgcatatatataatgaaatatctgggggatgggagccaagtctaaacgtgaaattcatttatgtttcatatacaccttatatacatagcctgaaggcaattttatacagtgttttaaataattttgtgcatgaaacagttttttttaagtacttacatgggaatttccctcttgtggtgtcatgtcagcagcactcggggtttcaggttttggaacatttcagattttggattttcagtttagggatgtttgacctataccccagtagggaggtaaatatcttatttcagtgatttcttttttctgaagaaattatcatcattgctagatttagaaaatggcctatgtccccaaagatgatagcattttatgttttgaataaaacacagcctattattcttacatctttttctctgtgaggttctttggagattgttgatactagttaagtaaaccagttttgactgcatcttttgtgatttagggaaatcagcaagttctgtaaaatctgtggtaacggtagctgttaaaggtaataaagcttcaatcaaaacaggtaagactattggggaggagagattttattgtttattctttatttatgttttaaattcgtataataatttttagcatctaatacttgaagagtttagtagatatttccttgatatttaaaacctgacccattttgttggaattttatctttggcagataggcagatatatttttgtgcatgtaaacaatcacatatatataaagctatataactgtacatttttgacagctttgtaatcacaggttgctctgtcgtttccctccataaatggtttaatctttgtttccttcgctttttttagagttgtcaattcatattgccctctccagtttgtacagtttcttagatgcttgttacttttaaaaaggatgttaggagaattcattttttttcataaagaaatggaacactatttaaaataaatttagcaccttgcaactagagcaatctttttagtagtacctttcctaacagactaattctaaagaatctttgcagaaattacacagtattatttttgcgtgtgtgtgattacaatgttggtctgccacatgaaggttaaacatgtggctcatttgacggcatcaccaaaaagttgtatcttgatttaaatttgcttttaatctta

SEQ ID NO: 24021 - DNA, 1027 bp, Homo sapiens
tgacgtttgaagtagtttgtttatacttgcaagtctgtttttgagaaaaagtaacataagatttttcttgttaccttaatttctgttttaaaaggcatatatagaaataaatagaaaagctgctgagtctatggtaaaattttatacctgcttcccagtattgatggatggaaatcaactctcaataagtatggctcctgaaaacatgaatataaaagatgaggtaaatcagaccaccatttttactagctcttactaagtttttaaatcagatttgttacagtctgttatgttttctagttttccactttggttcacatttttctcacagacactgagaaagcttcttcctgtccctccaacaatcacccagtcacccatcccactgtttgagagttactttcatagtgagggaatcctattcttcatgtatgttgggatggaaaaaaggttgcattttgtctaaagacaggtttctctcttatctttctgccattatctgtcatctaaactagaattctggaagttatctttaattttttttctctcatttcttaaatttagttccttgtaaatcttgtttaactcagtgagcttgttccctcttcctcatcccatataccattgctttatctcttaaaaactcttactggtccaggtatggtggctcacgctggtgatcccagcactttgagaggctgaggtgggaggactgtgtgagcccaggacttcaggacccaagaccagcctgggcaacaaagtgagaccccatgcctacaaaacttaaaataattagctgggcctgaaggcgcacacccgtggtcccagctcctcaggatgctgaggtaggaggatcccttgagcctaggagtttgaggctgcactgagctgtgattttaccactgaacttcagcctgggtgacagagggagacctagtctctaaaacaaacagacctcctcctggaccttttgtatatacaaaagtaattgtcttttgtacatacacgctaccttcagttttataaa

SEQ ID NO: 24022 - DNA, 1067 bp, Homo sapiens
gggaggctgaggcgaggggattgcttgagcccaggagtttgagaccagcctgggcaacatagtgggatgtcgtctctacaaaaagtttaaaaattagctgggcatggtgacgtgtgcctctggtcccagctgcctgggaggctgaggcaggaggatggtttgagcccaggagttggaggctgtagtgagctgtgttcacgccaccacactccagcctgggtaacatagcgagaccctgtctcaaaaataaagtaatcattccttactttcatgatttggcctcttaaccaaaaattattcatttatttacatttggtatgccttctgtatttaatatgtatttcagctacatgttcattaaaattaaatttttatcagccatatattacctagaaaggcagggttttacataaaagtggacaatattcataaaaagcacttaattaaccaacaactagataatttctttgatatgcttctgataaatagagcatagaatggaatatgataaatagtgtgacatagaatggaaggtggggcacagatggcacataggaattctgaacctttcttgtaaacatttttaatcctctatttaaaagaatacctatcattctcttcagttttgccttggctttacaacattttaaggattgttttctcttgtttcctttaaataaggattaaccttacctttgtagtcatatatctgaaacctgaaagaagaatatattccaaacttttaaaacaattaaaaacatttttattgtagtaaaatacacaaattttaccgtttgtaagacataaatttaacattttaatcatgtttaagtgtttgttcactgatattcagcaccttcacattgtgcaaccatcaccaccatccatttgtgaacttttgtctcctcaaactgaagttttctatccttttgacaataactcgccattaattcagcccttatcaaccattatttctgtttttataaatttagttacctcatgtatgtggaattatatttgcttttttgtgactggctcatgtcacttagtataatgtctctaaggtt

SEQ ID NO: 24023 - DNA, 1290 bp, Homo sapiens
cttcctctgggtagaaagaagtttgttttattcttctttttgtttcagttacatttattataaactgtttttgtgttaagaaataagatttcacaggttcttggcctacacagtagtacatgtaggaaagctatggatagtccacctttgaaagcattaaattcaaactcaatctattttctccttctattccattgtatgctgatatcagaggtaagtaataggaccttatatgtggtgtccttgtgttgtcaatctgttaaaaatcttgcactatctaaagaaaaaggcaatttcatcatctaaatctaaattagagtatctttaagtaaatgtattatgataggtaccagtttaagcacaaatgagtggctcatttcacttgataatttcagaaaaaaatatataaaagtttttagctattcctcagcagaacatgcatttttaaaaagttgtcatttatatttttcaagctgttattcagttgtgttcaactaaattcaaaattaaacactgactgtacagaaatccttatcccagaaatatagtcccaaattcttagagttaaaagaaaattaaagaagtgaaaatttacataaacttctgcctgaattggtacttcacttcctaagtgcttacccagaaccttattcgtatagtttaagttggataacacatatggcttatttgtaacagtttttaattgactactatttaaaatgagttaataatcaactctatattatcttctcttcaacacttactgtttttgttagactgaaatgttacttctttgtgtagtatgtgtgacctttatttcaatatctatagttagcttgtatacaaagcatgtagcactccattctaaatactgaaaactagtagctgcatttttggtatcatgattatgaagatatttactgcagaattaagtaataatgagaatgggtttataaagaaggcaatatgtgtgtccataacctctacactcacaggtgagtttcttatattcccagtcatttctcaaaatggcgccacattttcattttcataagtaggtagattatggttttcttgtatggtttagggtttgtatcttgttgaaagggggaaaaatgacagtcttcatgttactgtgatcatctgtgtaacttaattactatttgttgaatggagtctcctttcagagctattcttgtgactcttttctaaatttagggtcatttgctttgtcgaccaattatatacacctttggttttctttcattgtttttctgagtcatgtctgtt

SEQ ID NO: 24024 - DNA, 2627 bp, Homo sapiens
tttatgttctttttaggtaaggttcacttataaaattttaaatcataatgcatggatcattagttttattgtagaactgtacacatattttattatttcagttaccactgttgggaataggacctgataatatttgaagtgtctcagattcacatttgacctttcaatgtcaggggttaacttgacagaggagggaaaatattggctgtaatcacatgagcgcaaaaggaacatatcaacagtcataatttatattatttacgtatttccagcaatacatcttacccattttatgctgattggttggatttcccagtgcttattacgaatgcatcaggaagtcttaacaattggcatcagcaggattctttataatggttgaattctcatcatagtttgatttttgtttgtgtttttgtttgtgttctttttgtttgtttttaaatacttttagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataaggtgaggagggtaggaagaatggcacagtgtgtctttgaagtgattagctccgctgctgtagctatgtagtaggagatgtaattttgtttcatactttcatctcctcactctaccccggaagctcccatttccttttcttaaatgattccattgtttaagccagtagacattcagagtattaaactcaagttcataatttattgacatgtttgaaaagcattatttggatacaatttggaaataactgtggtttaaaaaaaaaaaaaaaaagtctgcagtgaatctcctaaggtgatttaccactctgcttctgaatgggaaactgtttcctctcttaaattgaagcttcctttatcaggtcactgattgcctaactagacattgtgggacgaaaagatcagtaaaactgaatttaactacaacttgtacagactgtgcctatactgtttagtgactgttgacttagttttgtatacatgttaaataatttgcataattgactgtatttgggtaatgtttactgtttttttttgttttttgtttttttttccagaacattaataatatggttgtaaattccgtttttctgtatttcttatttactatttcagactttggctgagcaaaacactaagaatcctaaaagcactactggtagaagttccaaatctaaagaggtaaaaaatagatcacagaccctaacccttctttttcatctccatagcacagttcatctatcttataacttgtgcctgccttaacaatgttagtgactaagagtttagagcaagggataggaatgagatgttttgtttttaacttatctctaatcctaccattaatttactttttgaccttgagctagtctaaacaccttgtgttttcttgaggcggggggagcgggcaaaatgttatatggggacagaaagagagtagagtagggcaata

SEQ ID NO: 24025 - DNA, 1021 bp, Homo sapiens
aattcttctattttatattagcagtaggcttccctcccaaatttgggtattttttgcaaaaatgtataatgttgattcagacagtataatatgtttaatttaaagcaatttaaatactgttactagagcaataaattaggactttctttttaaagctaaaactccaaccaagagagttagaattgggaaaactctgccatcagaaaaagctgttgtgacagaaccagcaaaaggtgaagaggccttccagatgagtgaaggtaaagcaggattgttggaatgggaaggaaagttacacaacacaggagagtagttgaagtttaaagatctatctaagaagaaaagtagaaaatcagtggaatagagcaggggtgggaaaagtcaactatagttattagatgtgggtaacattttgatctttgtaatgtagagagaatggattattgatattagaatgtgacagattagaggaaatgatcctcgaaaggttttctgaccatgttgcagcatcagatagaaattatttattaactagctattatttgtggaccttgctttgttgatgcttgtcagcagccagccaatgaattaaacaagaagccttaatagcgtttataaaatttaacttgaaacaaataaggaagggtctagtgagagagaatactttagtcactcagcagatacttgtcatattgtattgggtatccttcataacaatgttaaaaagggtagacaaaagaaagtacatagctcttgctctcaaggggtttattgattcagagaggttaagcaaaaaatcaccttgccagtatgatttaaatagagcactgtaagggtatcgcttttaccattctctttgtagcaccctcattgccctctttctttcctatcctatcttctttaaggaaaacttaccaagtatgatttggtccaaggatttcaggtgggctctcagtgctgctcccaatatattagaggtctccttcctttactatttcctaaccagatgtaaaattagctt

SEQ ID NO: 24026 - DNA, 1032 bp, Homo sapiens
actcgggaggctgaggcaggagaatggcgtgaacccgggaagcggagcttgcagtgagccgagattgcgccactgcagtccgcagtccggcctgggcgacagagcgagactccgtctcaaaaaaaaaaaaaacaaaacaaaacaaaaaaaagaacttggccaagatgaaatagagaacttgagtaattctgaaaccattaaagatgctgaacttgtaatgaaaacatccttgaaaaagatacctccaagtcctgatggtttcactggagaattttgctaaacattcaaaagaagaattgattttgtgcaacctcttccaaagaaaatagaagagggaacacttctcaactctttttttttttttttttttttttttggagacagagtctcactctgtcacctaggctggagtgcacaatctcagctcactgcaacctctgcctcctgggttcaagcgattctcctgcctcagcctcccgagtagctggaattacattttatgaggaacttatttcaggcatgcagggctggttcaatactggaaagtccatttaataaactatcaataggctaaagaagaaaaacatgagtgtatcaattcatttagaaaaggcatttgatataaaaatcaacacatcaatattctcagtagatcataaagaaggaacttcctcagttttataaaaaggatctacagaaaaaaaatctggcatcgtacttaacgtttaaagtctgtgttccctctaagattaggaacaatgaaaggatgttcattcctgccatcgttaggcaacaaacttactactgcagttttccagccactgcaattctaggcaagaaaaagaaaaggcatatagatgagaaatttaatgaaactatctctatttgcagatacatgactgtctacccagaaaacttcaaggaatgtgtaataaaacttttagaatcaatgagtaaggttgaaggacacaagatcaacagacaacagtcatttatgttttctgtgtactgacagcaaacaagtagaaacca

SEQ ID NO: 24027 - DNA, 1044 bp, Homo sapiens
aaccaaagcccagagacttggaggaagtaaggtcagggagtttccaccaacagagggacaagaacagttacctggagagttttagctacagcatctcaattatctgcttttgattcacttacatagatgtttccagagatgggagatgttaactgaattatccaggtgattgtcttagagcaaagcaacaggtcaaatcaagtccaaccagtagccatctctgaagaaattaattggatcagtcaatcccaacagctaattctgtcaaaataatccatctagggttccgtgtttttggtgcatcaggaggctgttatgtgcccttacatgagaatccatgggtgattttgtcagggcctgttatgagtctgttagcatgtgcaaccaagccagagattgtgtgagggcctagtggggtgttcattgagacaggcgctgtgggtagaggcttgttttggcattgatagtttctgaccccatctcccctaccccagcttcatccagtccagtgttatcccttcctcctgcatgtgggagctgagtccctatgctggccaacatttgctaagggacagtcacactctaaaaatcctatacagtagataggaaaaaagacagtagggaggctggaacatatatttacacacgcccatgcagaaaccaatatatctatatctatatatattagagagaaagatgacatctagatatttatacacatgtttctttagcaagggactattcagggatgaagcagggatgaagcttttcccaccagacagtacttggagtctccagtgtgtgtgttgggatagggggttgggggcttaccctagaggctgggtctctggaccgccaaggcctgggggagagagaggtggagaaaggggaagaaggagcctgactttccacttccaggtgctgcctggaccactgacctagccactggcctatttataccccctgcaagacagagctagagcgtgctggcaggagtttttaatgagttagtagcctgagcattcagccgcaagactagtgcaa

SEQ ID NO: 24028 - DNA, 1073 bp, Homo sapiens
attttgatcagaaagggcaggccaagcttgctgggtgaagaaaaaaatattagctggctagcatggcctgtttctgggaggcggggcaatgttggacttggaaatgtggcaggaaatggaggtgtggctgggacaggcagaatcttgtaggctacatgaaggtgtcagcattttacctgagggcaatagggagccacagaaggactttgagcaggagtggaccataacccagcctctgtttttatttttttcttgggataggatctcgctctgtcacccaggctggagtgcagtagtgtgactgcagctcactgcagcctcaaactcttgcctcagcctcctgagtagctaggactacaggcacatgccaccatgcctggctaatttttaaattattttaaaaatttttacagagacagggtctcgctatgttgtccaggctgatcttgaattcttggcctcaagtgatcctccaccttccaaagtgttgggattacaggcatgagccaccgtgcctggccttagactgtcttagaaaggtctctcttgggatggtgggtgtggaggatggactggaggggtaaggagggggtggggaggcctcctggggagcatctgtgggaatcagagaagtgccaggtcctgccctatgatgctgccagtgggggaagacaggaggagcctttctgaagatgaaatccacaggagttgatgaccaattccacgtgggggtgagagggaggtgttgaggatgactgtgcgttggatgactcctaattctagctcaggagctggggtggctggtgacgccattctcggagggaatatgggaggggatgggccagggttgggggtggtaggctcaggatggccacatggagtctggggtgccagtgggttccccaggtggacaggcctgggaggcagatgggtccagggctctggagctctgggcaggagaaagcgcccgggatgtgtgagcatagccagatccttcagagtggaggagctcgcccagggaagcagatggaggggtgggtgccaaggcctggggaacaggcacatttgaaggg

SEQ ID NO: 24029 - DNA, 1027 bp, Homo sapiens
attgagctgtaacacagacaagtggatgttttgctgcggaatgaacacttagcagggtctgcctcttcctcctgtgttgtgacccaattcctcagcacagggagtaaggtcagaagttgaaaaggccatggtcattcagctgggtactggagaactcatgattttttcttttagattaggtcagtgcttctcaaaccattttcctgtctagcatacctgcagggtaggctaaatttgatagtgtctctggaggtagaggctggttggggaatggatgtggtagacagttgggggaatgtggtttaagaagacctctagataattctgttaagggagagatgggagcattttcccctttcccctgccagtctcattataatagatgattattaaaagcagttaatttctttcttttctagcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggtaagtctacagagttcctcaggcctgtgtgcaggaaaggaggctcctgagggggtgtttgggactagcataggttggtatcagaaatcccactgcttttaagatcgttgaaagatgactcactctgaagcagttccaattcttatattgtcctgactgctgagcccgtgtgggactatatgagagaacctaggctcaggagcctgttgcctcatagggagacgtggcctagaaacatgaaatagaaccatctggagtttcctgtgttcacttccattgttatcaagatgagaaaattcctgtttatatcttggtatattaattgatgtgtgagggtatcaactgtggtaagaatatctaagtggttacttttatttaaaaaatcttttctgtatccagttgacctgtattaattgctcttcaaggaaaattgggagtctgtggtctgcaaaag

SEQ ID NO: 24030 - DNA, 1050 bp, Homo sapiens
tcgggctatttgaagcaatgagatgaaagatgggatagtatttttgttattcctgtttatcttgagaactcattgtttgatatatatatatatatatatatatatagtcctcaggtgacctgaggatggggccgccccaaaacacaacagcttgcctgggagaagatcccagaggtcttgtgtggtatgtccagggctaaggggaggagttggcgggagtaggggtgtttccaggttcctggcatgctcataggaagatgcagtattcttcagcgaaatgccaccaagttcagagagtctgcgggttcctagcagtgtcttttggagtaccagtttacaagaggaaagttgaaagtagttccatattacctcctttcttttcctactcttttaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcagataactttgtaaattattttggcatggtactcataaatgtctggctgtagctcagaattttagctttacatgcacttgtccaacagggagacaagagcatcctggggtgagctccactagagtggcccgtctggaagtttcactgtggttgcattctttgttccagaagtggctggacaacacgcagttgctttcttctggcatcatcttatttagccctggcctagccagacactgctctcagggtttctctggtttgagtaaatgggttacattaccttgtctgccc

SEQ ID NO: 24031 - DNA, 1142 bp, Homo sapiens
tggctttttacatcttaaagagaaaactattatagttttgagtaagagttaaaaataaattaaatgaaaaattccatgcgtctgttcttaccggttttcaagtgctcagcagccacactaggctagtggctaccatgttggacagagcagataatggaacagttccatcatcacagacagtgaaggtgtagagttttgtcactaatgagcagtagttgttgttttgtctggtgaatattccagggggtacttaattcattgaacatgtattattagaattcaccatgtgccacacattgtgctgggtgctaaggaaagcttggtgaacccaaacatttttggtctctgccttccttgtgttcatggtctagacagggaggcagacagatttcagatgatcacataaagtgaaactaatatatgtgctaatattctatgaaagcataaagtaagataatctggccttgtcagtgaagttgggaaagccttcttgaggaggttatgatagagctgatatctgaagacagtttaaggttaatcaggcaaaggggagggaaagagccgtctagctgagggaaaaacacatgaaaaggtactgttgatgagagagagcatggcattttccaggacccagaagccaacgtggtttgagcacagactgcaaggctttgtgtgctatgccaaggatttaggggctttatctctggagctttggggagttgaagaaaatatttgaaacgaggggatgtatgataagttaggtgtttcagaaaggtcaggtgtatagcagagtgtggaacagctgtgatagcaaggtgggatggggagcagtagccataggtcaagggcataaattaggagaccattgcagcattgcccggcaaaagatgatgaaagtttggaatagggaagtgttggtggatacagggaaaagtggactgatttgagagatatttaagaggcaaaatcatcatacttaataacggatgggatgtgaaaggtgaagtagccaggtgttaggttattgtttgaatggttgtgccaatattaagatatggccagatttatggtggaggtggtggctgtgagtgggtggtggaattggttgggtgagtcttaagattatgagtttggttttgaag

SEQ ID NO: 24032 - DNA, 1034 bp, Homo sapiens
cgagtagctgggattacaggtatccaccaccacgcctggctaatttttgtagttttagtagagatggggtttcaccatgttggccaggctggtcttgaactcctgacctgtgatctgcctgcctcagcctcccaaagtgttgggattagaggcatgagccaccgcgcccggcctctaatcgtgaactatctatgggtaatagaaaatcttacttctgagagcccagagtattttttcctccccacagttttttctttcccctgagaaaaattagatattttcttatttacctgagagaatatatgataatatatagaatatatagatgattttctgtattaaaggtagatttacaatgatacaaggagtgttcagataatttttcctttagttcactggcatattgaaacttactggcataggttggaaagtgtttaaggaaaaaatgcttagtatgtttcttgctagaaatttatgaactatgaaattcttagatgtgttgtataacatctaatgctgcgtatttagaggatgagatcaaataataggaaacattaatttcatccagtttactctcaagttaaatgacaaaattgtgttattcaatttactctcatatctcactagataataagggagttatagtggtgttatataaggcagtgattaagtttgtagtcctgttactaaggctgagttaaactatgatactgtttaaatttgaagcaaaatatgaccagtcttataactaagtctttttaagagggaagtgagtgattcagagccttatgttgtttttatgctggtcctacagaccattcaggcacttcttgtaattccttaacctgaatttctgagttgtgctggggaagataattcagttctctgggttggcatcactagaaattcttggtctccaacttttaattgggtcatcaacagtgcttggaaatcttttttttttttctttttaagatggagtctctcgcttttgtcaccaggctggagtggcagtggcccgatcttggctaact

SEQ ID NO: 24033 - DNA, 1063 bp, Homo sapiens
gttagggcagaacattttaaattattggagtagattcctggatctcataggcagaggaaattttatcattgctgttttgttacgcataagtactaacattgtgataaataggctctcgccaatggcaaatgtaattgatgatggctggtgccagaatggttagatacctcaaaaaagagggatgcaagccagtaacagatatccacacttgaggaaacaagaagcagttgaaagctgtaagaaaaaggcatggcaagtaaaatacaccaccttcccatcacacacacacagataatgttgtacacttgagaatcattaactcttcagctttggcctgctcctttagcaaatacatttgcctatttatgtgatttaactgtccaactccaccctgagatattcttaaatatttaaggagatgctgaaatgctgcttgtaacttacttgttacttactattccttacttatacttaaatagctattttaggtactgaggatttctgtaggttctgaaacctagttagggttaactctaattttttttgagaaaagactgtcagattctttaaatactcagcctgcagttaactggaaatagtaaatttgctttacttgcccaaaggtcccccttgtagcatcagctctagtgtatttggggactttgttaaaaactcttcatgagttttagaggggtgaaggactgttacggaggtttaagactgcttctctgtgccaagaccaaagaggaactgtaccaattgttccttggtggcaaaggttattgttacatatcagtttttcatttttaattaattcattcagtaaataaataactctcttttgagtaccttttaagtgtagcaggtactttgctaggcactgaggatatagctatggataaagtagacacagttgacaatttagatgggaagtggatagactgaagattaaaacaagagggtgatgaattatatggaaggtatgcagggtatataagcagtgacagtatgtgttttgactaagtaaaggacagatgacaacatggtgagctctgtgaactct

SEQ ID NO: 24034 - DNA, 2036 bp, Homo sapiens
gacgtcattactctggatggcctaaatgaaaatgctgttgtatgcagtgaaagagttgctgaactacaaagaaaggtgagacacaataaaatgatagttgtaagaaacgtggcctttttcagtattgtttcaggaaatggtattgtttgtttttattttactttttactgtttcctgggtacatgaccaatgtcatttgactggtgagtacattgagctagcagctttagagaaatttcatggtgatctagagatgcatgacagctccctgcactggcagcctactttacaactaccatctgagaaggaaagcaattttgaaaagcctgtaagtttttctatttgacatttttttctgggcggggagggaatgttttatttgaaaaatttccaaattttatttgaaaatactttatttgaaaaattatatccttcagtaccagcttgtaacttgtacctgttcttcatctgatatccaggaatatgttccattagaggttggtataaaagaaatgtttatgtttcatagactgtaagacttagttctgtggtgtcttggaaaaggcatcccatggggctccaggcctttcatattgaggcagcctaactcttcctagttgtgccagcaagagtctttagacagtgttaagattaggcttattcatgggaacatccaaaagcttgtactttgaatgtttccctctggtcttcaatgcacaagccttgaaacagtccctggaatatttaagtatttctgtttagaagctcttgaaagacttgacttcagaggtgtcttgaaaattgtaagacccatgtttgaccaggaaggataatgaagtgcttaacgtccaaactggccagtgtctcttcaaagggaagtatctccttcccaaatgagcaacatactaatgtatatacatgtctcttccctctctctatttatatcattattaccattgtgtgtgtgtgtactagaaactggcaactctaggatgtcataaaaattttatatcagccttttttttttaaattaagttctggggcacatgtgcagaacgtgcaggtttgttacataggtatacaggtgtcatggtggtttgctgcacctatcaacctgtcatctacattaggtatttctcctaatgctatccctcccctaaccccctaccccgcgacgggccctggtgtgtgatgttcccctccctgtgtcattcttttatagaaggcttttatttgcttggatccttggatcccttggcattaatgttcctctggtcccgttgaatgaatatcctcttttgttgtctggtactgtaagtcccaaggtgggccctacttccttgtgatatagccttatatcctgttattcattaaatacagttagataaaatagtgatgtacttaatgttacttctcttttcctatgtataagattggtatgtttttgtaaagctctattagtttgggttacaaccacatttagacctttaggttcagattgttggtagaaaatgaacaaagatattatgatgaacttttatttataatttattacatttattaaagtttttttaacacagaatcactaggtttattttcttcagtattccaaactaggcattttttaattttaatctgataactggggatgaaaatgatagttaacactttgtgctcaagtactgtgctaagaggttacatgtatatatcaattcgtttttgtcctctgtcaatcctatcaaatagaattgttagagattattatcatccctattttgcaattgacacttagaggatttaggaacttgctcataattattcagcaattgggggaaccagtatttgaaactaaccatatctgtgtacttaaccaccataccataaactgttccccctccccccaccttttaactattcttggtgaaactaaggttaagattttgcattattttggcaagagtagaggttttgaaggagattgcctaaagttgagttcaataacaatgagaaacaaagtaacaacttttaaagtgttc

SEQ ID NO: 24035 - DNA, 1024 bp, Homo sapiens
gctattattccctgtattgtctttcagttgtagctctatctgtcttagtcttagatctaggagttatttaatgtcaatatcagaaaagcaaggagccagatgtggtagtactttttctgcatggcttagcttgctttcaggggcttgcttactccttggtttttccttatgctcctcatctgtgtcacagaagagtcattcatagttacttggttcacttttatatctactcctcataaatgattatttgggtatccacgtatgtatgatggagcttggaactgtgaaaagaacatagagattttgagtcaaaatccagttcagttactttgttagccttgtgtcttgagcaaatgacttcggaggatcactttcctgatctgcataaggaaataggaatagtaataaccttatacatcgtactattaaatggggtaagttatgtagcatttatatagtgcctggttgttagttctcttcactttgctgaaactagactactagagtctctggtggtttcctactttctatcattattttgtttttctttctcctttttcttggtagcagcacataattaatatgcttttttttttttttttttttgaggcagagttttgctcttgtcatccaggctggagtgcaatggcacaatctcagctcactgcaacctccatctcctgggtttaagcagttgtcctgctgcagcgtcccaagtagctgggattacaggtgcctgccactatgcctggctaattttttgtctttttagtagagacggggtttcaccatgttggacaggctagtctcgaattcctgacctcaggtgatccacctgcctcagcctcccaaagtgctggggttacaggcgtgagccaccgtgcctggcctaatatgctattttagtacctcttgttttggccatttagctctaaaaattatttaaggtttaagccttagatttcttttctctccccttcatatccccccacctttggagacctagttgcctgtctctgtgtgg

SEQ ID NO: 24036 - DNA, 1044 bp, Homo sapiens
aagtatggcttataaacaacagaaatttgtttcttgcagttctagaggctggttccaagatcaagtgctgggagattcagtgtcttgtgagggcctgtttgtcatagatgacatgttcctctgtgccctcccatggtggaaggggcagggggtctctctggagtcgttttttgtaatgggcactaatcccaaacatgtggcctgtgtcctcatgatctaattgctttccaaaagccttacctccttaatttcatcaccttggggattaggatttcaacctatacttttcaggggggacacaaacattcagaccatcacaagtcccctgatgttttattagaggaatcatttggtttttcatcgcattctacatggcagtgtttagaactgaattatatggaggagtctgatgttagaatctgtttattcctttgtgtgacttgaagggaaaaaggaattgattgagcccaagatgacaagagtggatgcagataagtttgtagagaggaaattgagagaaatcagttttgaggtaaaagcaagattatctgctgagggaggtgagtagtggtggaattaggttagaggcattgaggagagtggtttggtgaagacttacagtttatgttgaagtgaatttgagatggagctgaccaagggaaagtaaaaggattggagggcagttctgagaagtcagctcaggttagtgataatgattttataatattgtcagcctgtatagaatctctgatttgtttttcctgctaacactcaggaatggagatgatgaattacagtattgatccttggttcaggaatacattgaatgggtatggtagaaggatagcagtcaaagagagaagagttgatcacctattggtttcagcctacatagggaaagagaagccagaagagttgttattctaggagaaaatagaaggaccagagatttctttatgaagttgattagatgaggtgggaataagttactgagagcactagaagaataggtaattttggtcagattgaataagtagatttaaa

SEQ ID NO: 24037 - DNA, 1088 bp, Homo sapiens
tagacccaatagcattatcccatctcattgaaaattctcttaaaaatccaagttgtaagatccatataatatttcatccactggatatactgttgtttataaccattactctgttgttgaagatttaaaatgtttttactttagttttctaattaatatctttgtgtgcaaatatttatctcctttgatggctgtttccttaggattcatttctagaagctttttaaaggctcaaagctggctttttttccagcacatagaattttaaaatagaaaattttatatactattaacaaatctctttttctttaggagacacttctaaaggaggcatagctaaagttactcaatccaacttgaagtcaggcatcactaccactcctgttgattcagacattggatctcatttatccttgtcccttgaggacctgtctcagttggctgtaagttctctagaaactactactggtcaacacactgatactctcaaccaaaagacattagcagatactcatctaactgaagagactctgaaagtcacagctattcctgaaccagctgaccagaagactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttaccaacaagagttaccagagagtaacttaaccgaagagcctttggaagtttcagctgctcctggcccagtggagcagaagacgggaatacctacagtatcctctacatcccactcacatgtagaggacctcctctttttctatcgacagaccttgccagatggtcatctaactgatcaggctctgaaagtctcagctgtgtctggaccagctgaccagaagactgggacagcaacagtactctctactccccactcacatagagagaagcctggtattttttaccaacaagagttcgcagacagtcatcaaactgaa

SEQ ID NO: 24038 - DNA, 1050 bp, Homo sapiens
cccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatggtaagaagaaagtttcaggcttataaacgttatagtttaataatgtgtttaaagttagatatttatgttttgaggaagcttagccaatgaaaaatacaagcaagatcaagaaaaaaaatgaagttagatatttggagttctaaatgtattttccaatagaattgttagaatgactatatttcttctaacaatccataaaaagcctatttaaccaataatgtagttaagttacagtattaatagtaccagcctgagtttacgttcttgttcttaggagaagtagattctgatgtatgacagagagtaaagaggtcgcttgggctcctgagctcctaaagctatcacgtttctctaatcctcccattatagtatccttattctgaaggcagaaagagcctccaatttgctgtgctctaaattgctttttgtcctaaaactacatatattttctctttcccttttctaatagaactcttggtgttgatct

SEQ ID NO: 24039 - DNA, 2040 bp, Homo sapiens
tgagcacagacttcagttccatgcacaacaaagaatgtaagctttatgaaatagtcactaaacaacacttacaacaagcagtaacagcaaactccagggaagggggagaatccagtatccagagttgtcactttataatattcaatatgtccagttttcaacaaattataaggcatgcaaagaagtaaaaaagtgtgactcattcaaaggaaaaaagagaaattaatgaaactatccctgaggaagcccaccttaaatgtactcaatgagctgaacaataccatcagcaaagaactaagggaaaccaagaaaaggatttcccaccaaaaagaaatatcgacaaagagaaattataaaaaggaaacaaatagaaattctgcagctgaaaagtacagtaacaaaaattctttagaaggattcaatagctgagtagtctgaacaaagaatcagtgaacttgaagaaaggtcagatgatttatttattcgaggagaagaaagagaaaagaataaagaaaatgaacagggctatgggacatccccaagcataccaacatatgcattatgggattcttagagggaagagagagagagagagagagagagagaaaggggcggtaataatatttgaagaaataatggttgaaaacttccctaatttgttgaaaaatgaatttcaaatgggttaaactcaaagagacccacaccatgtcacattatagtcaaattgttaaatatttagcatagatgttggttctattagtagaaatatactttccttaatgaagtcagctttaacagattttttttttaaatctggttttgaagtcataaaatacaaaactatgagcttcttacaaagttattcctgccgtaaatactgtggtaatttatatatttaaaaaattgagaatttttttaaaacaagtgtttccaaaagcttattgatttttaagtaagttttgtatcacatggtaatacgtttcttttatttgtagaaagtagatttttactttttagtgcttgttgactctgtgtgtgtgtgtgtgtgtgtgtgtgtgtgtgtgtgtgtctattggtttacatgacggtgaagaactacttatttcttttttggtttgttacatgaagtctttgacattgtttgtttgtttgtgacagggtcttgctcagtcaccgaggctggagtgtagtggctggatcttagctcactgcaatgtccacctcccgagctcaagctatccttccacctcagtctctcaaagtgctggtattacaggcttaagccactgcacctggctgatgtgtcattaagctggatgatgagagaataatataacctgataaaactcatgtagatcttttgagaagagataattttaattgtgaaatagcatctggaaatcagtaaaagacatattttagctaaccagtaatttcataacatctttatctcagtataatttactataatacataaggtttgcccatttaaagtgtatagtttatttatagaattttacaatagcataattttagaactttgttgtcattagcccctctcccccaattccctagccctaggcaaacaccagtccactttctctcccaattcttttttgccaattctggacattttatataaacagaattgtaatgtatgatcttttgtgactgccttcttttacttagcatagtgttttcaagagtcattcatgttatgttgtaatgtgaatcagtacttcatccctttttattgccaaattacatttcattgtatagatactttgtttactcattagttggtagacatttggattttccactctggccattgtgaatagtgctgctatgaacatagtgtttatgtgttagggtaggtgtttcatttctcttggttatatacctaacagtagaattactgggacatacagtaactccatgtttaacatgttgaggaacttctaaacttttttctgaagtagctgcactatttacattcccatgagcagtatatgagggtttcagtttctccacgtcctt

SEQ ID NO: 24040 - DNA, 1120 bp, Homo sapiens
taaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaacttta

SEQ ID NO: 24041 - DNA, 1029 bp, Homo sapiens
ggtccataaggcatggataaggacagtaaatccctttaggcatcaaccttttgtctcatttccttcatttggaagtgagtttcttccttagaagcaggctactaacaatgtggaattcattgccaaaatgtcatcagaatgatagagttgccaaagatggtgacacagttctaagtaatataaagattattgtttctggccaggcgtggtggctcacacctataatcccagcactttgggaggccgaggagggtggatcacctgaggtcaggagtttgagaccagcctggccaacatagtgaaacctcatctgtactaaaaatacaaaaattagccgggcatgatggcacatgcctgtaatcccagctactcgggaggctgaggcaggagaattgcttgaacccggaaggtggaggttgcagtaagcagagatcgtgccagtgcactccagcctgggcgacagagtgagactccttcccccttccccaccaaaaaaaaaaaaagattattgtttccagaggagagctcattctactccaggactatcagaatcagtctagaggattttgggttttattaactagagatgagcaactaggagtccatctagaaatggttacaggatataagagaaaaccgtggtctataagaataaagataaacggaaggagctggaggcattcggccatgagaaatggtagctacattgaaaattcataatcatatgagcaatacaaccctatgaaatgctcagaaataacctaaacaaaaattttaaatgacctaatgcaggaaacactaatcctttttgtaaagatagaaaataataatttactaaattaaaaggtatgattctagaatggaaggctgaatattgtaaaggtatcatttattcccacataaatttatactctaaagtaattctgcacaaagttctaatggaactgttcttttgaactgtgtaatttatctttatgaatttatttttatttttaatttgtctgggtatatagtagacatagatattta

SEQ ID NO: 24042 - DNA, 1028 bp, Homo sapiens
ataccttgatctctggttcagataggtgagttatttgatcagatatatacacataagcatttataaatatttgatgaaggaaattgtatggatcattatttgggttagtgggctccatctagggcaaagtttctaagctttcttggttcacagtacccttagttgtttcactgatttattttctccgctttatatataataagcaattatttttttcaaatagcaactaaggaattagaacataaatactaattgttttcctctgacaactaatttaacaaatttgttatttatttttggttttggtttttgaaaaaaaaatttgttcataaataacaatgatgacttactaatgacatatgtgtagctgttggacactgtgcaacttcccaaaccatgagatgagattggaccctcttattttctgccttttattacagcagctgccaaaaatccagcttttgccaaggcacaacagcattgaaaagaacatagcactatctgatgttgacactttgaccttgagctagtagtttatcactgtcctttccctagaattttaaactatcctgcagcatccctgtgaatccactacagaggaggtgcagagttaggaaatgaataataccccatggaggcactagataaatatttcctatggagattttaagttaagggtgcagagttagtgtggtgtagggttttgattggtgggacagtattttgagttgtcgacgggatatgacttgattcactttagacaaattgttttttccatgattgtctataaatgtcattatatatatagaaattacaaagaaaggagaagttgcccctggtcttaggcagacatttttgttactttgatatgaaagagaaccaaactagcttctgatagtaactgcactaaagcctctgatacaacctcgcctgatttcccacaatgatggcattgaaaaaaaagaaccacaaaaatactcaccacaagttaagattgttaagtttatagccataaatgaagaaatgtt

SEQ ID NO: 24043 - DNA, 1044 bp, Homo sapiens
cacacataacaatattaatcttaaatgtaaatggactaaatgccccaattaaaagacacagactggcaaattggataaagagtcaagacccatccgtgtgctgtattcaggaaacccatctcatgtgcagagtcacacataggctcaaaataaagggatagaggaagatctaccaagcaaatggaaaacaaaaaaaggcaggggttgcaatcctagtttctgataaaacagactttaaaccaacaaagatcaaaagaggcagagaaggccattacataatggtaaagggatcaattcaacaagaagagctaactatcctaaatatgtgtgcacccaatacaggagcacccagattgataaagcaagtccttagagacctacaaagagacttagactcccacacaataatgtgaggactttaactccccactgtcaacattagacagatcaatgagacagaaagttaacaaggctatccaggaattgaactcagctctgcatgaagcagacctaacagacatctacagaactctccaccccaaatcaacagaatatacagtcttctcagtaccataccacacctattccaaaagtgaccacatagttggaagtaaagcactcctcagcaaatgtaaaagaacagaaattataacaaactgtctctcagaccacagtgcaatcaaactagaactcaggattaagaaactcactcagaaccgctcgactacatggaaactgaacaacctgcccctgaatgactactgggtacataacgaaatgaaggcagaaataaagatgttctttgaaaccagtgagaacaaagatacaacataccacaatctctggaacacattcaaagcagtgtgtagagggaaatttatagcactaaatgcccacaagagaaagcaggaaagatcgaaaattgacagcctaacatcacaattaaaagaactagagaagcaagagcaaacacattcaaaagctagcagaaggcaagaaataactaagagcagaactgaaggaaatagagtcacaaaataccct

SEQ ID NO: 24044 - DNA, 1008 bp, Homo sapiens
tttttttttttttttttgaaacagagtcttgctttgttacccaggctggagtacagtggcacaatctcagctcactgcagcctccgcctcccagattcaagcagttctcctgccttagcctcctgagtagctgggattataggcacccaccaccacgcccagctaatttttgtatttttagcagagatggggtttcaccatgttggccaggctggtctcaaactcctgacctcaagtgatcttcctgcctcagcctcccaaagtgctgggactataggcgtgagccaccgcacgtggtcatggttacattttatgtatattttaccacagttaaaaaaacttaagaagttaccaaaaatcttaattgaattttaaaagtagatgtctatgttccaaatcagggttgagtatacgaaattagcaaagtaacagaacgagaaatacaggaaactttaagatagcataaacagttaaatcagatgagtggaattcggtgagatgtctttagctgtgataaataattttagcatatgttgatattgtctcatgcatgtatttaacttaagcaagttcaaataaatatacttaacaaaagaggagagaaagaattttaaaagtgcaggtgttttgtgcatgcactctaccctttatgaacatatgactacggaagaatatgtaatgaaagatgggaaacttcattctcaaaattaattgtagtcctcgtttgccttttgtagtgtaggcatcttatcttgcttatttgggtatgattctagagtttgaagaaatgtctttttggtacaatatcagatacttcatcaggtgctcagattcaggtgcagtgctatgttacaagcttggaggaaaaagtggaccctcatgggtttcttgagcagacacgatgtcaatttcaacatatgccttcctaaggtaccttcaagggtgattttgaccctctatagcaaggttttcacctcacatgctgactttaaaccctgaattccattt

SEQ ID NO: 24045 - DNA, 1050 bp, Homo sapiens
ctatacccttgtagtatagtttgaagtcaggtaataaggaggcctccaggtttgttctttttgcttagtcatgcttcggctgtgtgtgctgttttttggttccatatgaattttaggattgttttttctagttctgcaaagaatgatgatggtattttgatggaaattgcattgaatatgtagattgcttttggcaatatggtcattttcacaatattaattctagccatccatgagcatgggataggtttccatttgtttgtgtcatcaatgatttctttcagcagtgtgtttctcattttccttgtagagatctttcacctccttggttaggtatattcctaaggttttgtgtttttttttgtttgtttgtttatttgtttgttttgcagttgttgtaaaagggattgagttcttgatttgtttctcagcttggtctttgttggtgcatagcagtgctactgatttgtgtacattgattttgtatcctgtaactttactgaattcatgtgtcagatctaggaactttttgaatgagtctttaggattttctaggtatacagtcatatcatcggtgaacagtgacagtttgacttcctatttacctgcttgggtgctctttatttttttctcttgtctgattgctttagctaggacttcgagtacagtgttgaatagcagggatgaaagtgggcattcttgtcttgttccagttctcaggggaaatccttttaaccttttccccattcagtataattttggtgtgggtttgccatagatggcttttattaccttaaggtatgtcctttctatgccgattttgctgagggttttaattataaagtgatgctgaattttgccagatgctttttctgcatcttttgagatgatcatgtgatttttattttaaattctgtttatgtggtgtatcacatttattgacttgtgcatgttaagccatccctgcatccctggtatgaaacccacttgaccatggtggattatctttttgatatgctgttggatttggttagctggtattttgttgag

SEQ ID NO: 24046 - DNA, 1052 bp, Homo sapiens
tggcaggtggtaggtagtgttcaaggagaccggttacctcccttttgtgtctggtcctgtgtcagtgtagtaagtctgccctggaggaattgcacagcttctgcatacttgctgtatagctgagccatttagcaaggttgacacctaggtggcatttgctatagagatgctagtcaaggtgatgcaagggatttccccactctccaggaagagcgtaaccacagggaaggggagcttgctccagttctgtgggtgaaagtgaaatgtgaagattgccacaagttctgtcacttgggcagaccaagttcatgggtgcctatagcatatccagcattggaacaggctatttcccttcactgtgatgtggggaaaactgactattgtattgtcttcccggagaccactggccatggtaataaaagggactaaccagtagagagagaccaagttcattgtatatactacatggtgatttagcaccagttaagagtttttacagaatgtaaaagagcatagagattcctctaagaatgaagaaattcctgatacatcgagagcattgcaagggcacattttacttatctatgtcctttctctggaagaggagcttaagatcagaggccagttcataggaataagttggatctaatgaagcctggtctgagggcgctggtgcaggcttcattcaggaatgacagatccagggtgtgagtccctgcaatttaagagaagaatgagtggttatcaccacagggtagggcccagtccagacaggatttagctggtcttgaggtgatttagatttccaagtcttaaggtgacctcagtctcaaggttgatataggtgaagcttaacatcagtgggaactggaagacaggttcacatattagattgagagcttgtgttagttttcctaaatacacaatatgttttacatccctctcagtctcaccatcagggcatgtcaaaggttccattgtgccagggtaagctcttccatatagtaattcaaaagggctaagtctcactttcccttttggtgccagctgaa

SEQ ID NO: 24047 - DNA, 1059 bp, Homo sapiens
ggttgtgtgtgccacatttatgtatccattcctcagtggatgggcatctgtgttgcttccacatttgcctattgtgagttgtgctgctgtgagcatgggtatgctgttagctttttaagtccctgcttactgtgcttttggagacatactcagaagagggattactgaatcaaatggtagttctaagtttcacctttggaggaatctcaatactgatttccagagcagttgtgccattttacattgccaccaacagcacacatgagacccattttatctacatcctcaccaatacttgttattttcttttttttttataatgaccgtcctagtgggtgtgaggtgatatttcattgttgttttgatttgcattgctctgatgattggcgatatagagcatcttttcacatgcttgttggccatttgtatatcaactttggagaaatgtctattcaattcctttgcccatttttggtcaggttattgattttgttgtcattgttgaattctgagagttatttgtgtattctgtatatcagaatcatgagttgcaaatattttctcccaatccgtaggttgtcttttactctgttgaatgcatcccctgaggcacaacttaagcctggtggtcccatttgtctatttttgcttttgttgcctgtgcttttggtgtcatattcaagaaagcactgccatattcaatgtcacaaagcctttcctctatgttttcttccaagactttgatagttttaggccttacacataggtctttaatccattttgagttaatttttttacataagactagagtccaacttcattcttttgcatgtgaatgtccaggtttccaagcatcatttgtgaaaaatctgttcttttcccattgagtggtcttggcacccttgtcaaaaatcattttggccagggacagtggctcacacctgtaatcccagcaatttgggaggccgaggtgggtggatcacctgaggtaaggagttcaagaccagcctggccaacatggtgaaaccctgtctctactaaaaatacaaaaaattagct

SEQ ID NO: 24048 - DNA, 1034 bp, Homo sapiens
aaaaatacaaaaaataagcctggcatggtggcaggtgcctgtagtcccagctactcagaaggctgaggcaggagaatggcgtgaacccgggaggcggagcttgcagtgagccgagatcgcgccactgcactccagcctgggcaacagagcgagactccatctcaaaaaaaaaaaaaaaaaaaaaaaaaaaagaacacattaatacagaagaatatatcacaatttttaaaatttttgaaaactgtttttccataaaattggggtattcttggtaatcctttgtactttaagttataccttaaaaaaattgttctgaaaagggtccataggcttcaccagatgccagaaggatccatggaacataaaagatcaagtatctttgttaataaggctagggaatgagaagagaaggagcctaggactgagccctgaggttagttaatggagggagagtcaataggggagactttctttgaagggaggttcaagaggcaggaggaaatccaagagagaatggtgttgtgtcatgggagccaaaataaattagtgtttgaaaaaggagagtagccacctatgtcagatgggtgaagacagaagattggcctttgggtttggtaagatgatgtcatgggtgatcttcataagcaatttcgctagaaggattacagagaccctaattagaacgggtagaaaggtgaatggacagtaagaaagtggaggcaaagggtatagacctgaaagtggcaaatttttttctataggggaccagagagtaaaaatttttggttttgtaggctacttgctgtgtctgtgactacctctgctttatagtgtgaaagtagccatagacaacacataaatgaatggatgtgactggttccaatgacactttatttacaagaacagatggctagctggatttggcacaccagctgtagtttgccaaccccggtatagacaactctttggagaagtttagatgggaagggaagtagaaaaatggggaagtagttgatgggggacaaggagcgtgt

SEQ ID NO: 24049 - DNA, 1032 bp, Homo sapiens
ttgaaggaacacgaatcccaaaggaaaaaagccaaagttaaaggttacataagagctagaaggagtaaggaaacatggttttctcttgcttcctgcccatggctgccaaacggttctctgaagactgctatgtgacagaagccctttcctttgaaaacctgtcacgtcacaacaagaaaaagatctctttctttggaggtacatttttgggcacaagaaaggctttttaaaatttttttggccatctttttcattgtaggagtctggtgcttgctgcctagtttgggagtagaggaaaagactctggctctttagggggatagagatgggaaaggagcatggcccagctgggtgtattagctctccctccgctgcacttctggaacctttcatataagggcttcaggataagggggttgcatagctttagggtcttatggacatttggaccatttgcttcataatcattttgaactgtttccttaggctctttattgagaaactaccaaaacatcgagattacaaatctgctgtcattcctgaaaagaaagacacagtaaaggtgggtcttcactttcattgttgcccatctaaaagcttcagagcagcacagactgacttcaagataaaagtagtagtctctgcatctgagtaccagatcctgcaataggagataaggccatttcaccacaacagttctgaagtagcaggtatggtacagtagggggtattttaaatcattttgggaaatgttgcagtcaccaacttgacttaagtcttcttttggattctgtaattttctggcattgttctaattctattttctgttttgtgtctcagaaattaaaggagattgcatttcccaaagcagaagagctgaaggcagagctgttaaaacgatataccaaagaatatacagaatataatgaagaaaaggtcagtatataacagctaagaagaaaattattttgcttttttaggctgtgccctgggattgtaatatgacatttcaatatatcctgtgcttttaat

SEQ ID NO: 24050 - DNA, 1930 bp, Homo sapiens
ttaacacctctgtgggagagaagaatcattcatctaattgtggtttactaagtccttgacttccaccatgttgaaatattgggtatgtaccatctgttccagaatgggtgactcagtggtatgaagagaccttgtaaggaaccaaataagtcttgatggtcagttagaaattatgagtctcttgaaaaaccaaagcctgaatcatccagagagaaacacttcttagaggagatagaagaaattccctagcaaaagttccaagggccactgagtgccattcacaattgttgaggacacccacctaccttgtccatggatgcccatcatgacaaccccattaacacctttgattccatggatccctgggtgaatccaacatcatagtccttgagttcttccaatttggttcaagaacaggagagctagagcaggaaatatcaacaaacaaccccctcttctgtctccaaccctgagatgcaaatgtcttttcctgtctccactcctactgtctggtgatctttgtgcagcaggtatgtgcctgaaggaggtctccaagccagtttctgtgtgctgtcatctgagatggggttccccttgccagttctcacaccccacaagacccaccatactgatctcctggctagcacacaccaaccccagggaagccttttcttcacacttggaacctagatcttgatttccttttgtgaggtcagaatttgtttaactggaatgtggcacagcattgaattcttctgccttgtctattccagcctcagaattctgtttttctcccactttgcagtggtctttgagttttaacactgtggaacagtatctttccccgatgatgccccagatggaaggtttgagttctgtccctgggtcctctccataccctacctgtttaatggcccgatgtcttgatgccttctcgcatcaaggctctgcgcctacagtccttcatccaaccaggaattccagaacccatcaggtaccctagatcttctgaaccagtgggatcagagtccccgttttgagtagtacagagaagaaagttccccctttgtgtttacctccctttttgtctgcctactccagttcccccttccccctgagtgctcaagctgcctaacatcttccactgccttcaaacaagggaagccagaaagttccaagcctcttcgtccacagtttacttttgtccagtacagccttggtgacctctgggagctctctccctgagaaggttgtctgagtgaattagatgaaatgtggtgggtgggttatttggtatgtcatctataaccatgagctaggacggcatgcgcttgcctgggcttaatgctgttactttccattagaaaaagatcaccttatcattcatcagacactctacagaatctcagaattatggttctgcacaatgtaagtgagggcatacatccacctacccaggaactgaagtggaatctcccccaccccacttgtggcatctccccacgattgctcttcagacaaatcctcatctgtttagttgtcattctgctggggacaatgcaatctaagttatttcatttagttattttcatccccttcccctctctcattgtatccttcaccacagacagctcttccagtttccaataattgtttatactccttatttctttttctttttttttgagatggagtctcgctctgtcacccaggctggagtgcagtggcgcgatctcggctcactgcaagctccacctcccgggttcatgctcttctcctgcctcaacctcctaagtagctgggactacaggcgcgtgccaccacgcctggctaattgttttgtattttttttttttttttttttttttttagtagagacagggtttcaccatgttagccaggatggtcttgatctcctgacctcatgatc

SEQ ID NO: 24051 - DNA, 1035 bp, Homo sapiens
caaatttctactcattctccctaagacccagagcagacccaggacctaaagaaattacatcatctctattttcccttggctccagcccactcttgtttgaacctcccacttttgttgttccaactacttcttgagatgaaggaagggcagaacattggccctcttcactgaagtcttcaccccttaatccagggttcaatttttagttcaccttagcctgtttgagattagaagctgggccttaacttacaggtgtgtccggcatcattcaatcagcctgttagatccagaatccagcactgtgacgctacataaccatgggctctgtccttccagttcctttagtgccttccctcactggtaggttcactctgagggcttccttccttgaactccagtggcaactatagtctgtttcccacaatttgttgtgtgtgttttttgttgttttgcagcgttttcatattgtcttttatgtaagtcatgtttctgaactatcgtataaatttcattagggtaagaatcatgtttgctttatgcactgtgtaacatgccttgcagtcagtataggcacttaaccttattgatcagttgttccttggtgttgaataatgtgttaggtagccaggtggacctgtgtcctagcctggagaagctctatgtcaccttgtaggaagccatctgaatttgactcagcatcatatgctgggcctgtgctgcacttgagctttctttccagccgccaggagggatggttgtcctggccaacagcgaatttaatgggtggtcaaaagaagatgtgcctgcatagaaggctgaaagagggagctggaagtaggaggagacaaggagatagtgacaccagtatcttgtcacagaaatcaaggaaggcaacagtttaaaggaggggagggagatcagtggtgccaactggctcagaagaggtttgctgggttaaatctcaagatgagcccatgagatctggtggttagcagaggcctttcctgacaaccccattttaagcacctcttcccc

SEQ ID NO: 24052 - DNA, 1081 bp, Homo sapiens
tttcttaaggctctttgaattatcaaaatgggaagtggtacattttcattgtcactgctgaagacactcagttggttactcttttaattccaaattagacaaactagttctatttcttagtgcttccggaaagcctcctagaagaaaaaaaataaggatacatttgtaaatgacaagtgatttttctgactttaccctaaaatcatggaagatatgtaaaacaaaccctataggctatccgttccttgtgtacgtaccccgagagagcctactttttataaaagctaaatatgtgaattacaaatggctgggctataggttttacttctttttcagctgttggatatcccacctgcctgttttcctctcttctctcccaagccatgcctctcggactccgaagttgaattacatataaccacatgggttgtttggaaacatagtcagtctttatttctagccgcttcatgaagtaggtgtgtgagaccctcagaggaaaatagagaagtagaaacactttgttaattagaaatgcattaagaagctgcatggatcttaacctttgcttgtaaaggaagaggtaataattgattacactgtgggcatacaacattccaggtgctatcttcagtgagggcattttcgagacagaaaggaaaactaatcacaagttctaatcccgagggtaatttagactttgttcacttgcacagatttattggatgcctcctgtgttgaagcaccaaggctggccctggggctgcagcagtgaataaggcagacccagtccctgcctaacagggactgaacacatgctcacgtgtgtgatatttgttccaaaggaggaacacaggttatctgggagagttgattatagcgaggaagaaatcttagtcttttctgtttgagttaaaggaaacattagcatatggttttagagcagaggccctgactcctagatccttatgccctgttctgtcctgcagcccctgcattcagtctgcagtacttccctcccactcagcaccacacccttctgcccctcaccccatcaccaccacaagctttgaagaaataaagg

SEQ ID NO: 24053 - DNA, 1010 bp, Homo sapiens
cctggccgacatggtgaaaccccatctctactaaaaatacaaaaaattagttgggcgtggtggctcccgcctgtagtcccagctacttgagaggctgaggcaagagaatcacttgaacctgggaggcagaggttgcagtgagctgagatcgcgccactgcactccagcctggcaacagagcaagactctgtctcaaaaaaaaagagtgaagtcctaaatcagtgggttaatccatctgttcttccaggacagatgatattgaataatgaaatgtttgtcaagcagagagaggactgaggataattcagtcaaaacaaacatttggagcaaaaattttgaggtgtgaaagagcctggcctgttccccaggaaagaggtcaaatctggctaaagcagtgagtccaggggaagagctaaggcagttgagaagtaggaggggtagctttgtgtgacaggtaaagaagatgtcattttctgagccagtgtgcatcaaacttcactaccagatgaatgcagaatagaattatgtacactctgcaaagcagcgggggaggagagttagtctcaagcctcacttgtttttccacttctttgttttatctttgacctgtgcaaattttacattctattcctgagtgaatgtttggtatgacatgaaagagatatttcaaattacctaacattttataaatgcaatgctattcatacatactgctttgaaccctggggctatggctgtaggcggtaaagagcctgtgaagtattttcagcaaggaaagtcatgtcattatattgccgtactacagacgggtggagtgaaggggaaaaactggaaggagggaacagcttttgccaggagctcaatacaacttacctcagtgacctgtggatgggtagacaatgaggaaatagaagcccacaaggactgcactgctagtaccttatgaaggcaggaatttactcctggactttctgaccttaaggcctgtactctgtccatatgcttccctg

SEQ ID NO: 24054 - DNA, 1072 bp, Homo sapiens
gaatgagcgagtgcaagaaagagcagggaaacctgccttataaaaccattagatcttttgagagctcactgccatgagaacagcatgggggacctgtcccggtgatacagtcgcctcccaccaagtctctcccttgacacctggggattacaattcaagatgagatttggctggggacacaaagcctaaccatatcaactagcaattttcaaattgctcccagaactctaacccaagccctacctgccatgcatgaagaagggaaataaagtggctcaagagtgggtgggatcttaaatgtgagccccccagagcaggaaatggagcatgaactccaggaagcttctttatctcttcccatctgccactcttgacataggggacaggtgtggggaacttaaacccttgtcctagagctaaagaacctggccaaaagaaaaaggtagaaaacagcaagaacccaaaagttaagcatctgacatttaagattggcccgcccggcactctatctttgtctaaataccttacccaatgacttccagataacgttaatggagtggatctctctgtgcaggaaaaaaaaaaaaaaaattttttgttgtgctctttacccttcaaatagaatttattgttaagggaagaaaaatacatggctctataggattgaagtgctccattgccagaagcctgcaggtccatgattcacaggagcagatctgcactgaacccttgacggttctgcaggtacacaggaagatgaatgatctggggacgtaagagtgccccagaagacagaaatctgtgtttctgtcctttatgctttggggaaatgaatgtgagattggtttctaacaaatacataggccaggcaaggtggcttacacctgtaatgccagcactttgggagaccaaggcaggtggatcacctgaggtcagcagttcaagaccagtctgggcaacatggcaaaaccccatctctaccaaaaatacaaaatttatccgggcgtggtggtgtatgcctgtaatcccagctacttgagaggctgaggcaggaaaatcgcttgaacccagg

SEQ ID NO: 24055 - DNA, 1888 bp, Homo sapiens
ctcagcctcccgagtagctgggattacaggcatgtgccaccgtgcccgactaattttgtatttttagtagagacggggcttctccatgtttgtcaggctgttttcgaactcgcgccctcaagtgatcggcctgccttggcctcccagagtgctgggattacaggtgtgagccaccgtgcctggccttcttctgtcatcttaagtgagaaaacatagtatagctttcatcgttatgagggttttgatactaacttctgttacgttttgaaaaaaattttggcctgtttgtctttcattgtgtctatcataaaaatttgatttttatacaacgagaattcatcagtattttggcttttcttacttaagttttattttagatgttcagatttctaaggtgagatttatttttgcatgcgatataagatagggattgaacttttcctaaatagaaagcctgttatccccaatctatttattgggtatttgtagtttcccttgtagtgtatgaattctaccttaagcatttcataagtactcttacagtcatgggtgttttaaggcctctttttacttccattgacttatttgtctgattctgtgtatttcattgttttaattaccaccatttttatataatactttggtttaaaacatacttcttacttttttttttttttttggcatttctttctccaaataagcttataaacaacttaccatgttctgcgaaaaatactgggatttttcagttggaatcacatgaaacgtacaggttattttggggagaatagatagctttacaatgaatcttcctatccagagaaagggaagtagacctttccgtttattctagtcttttttgtgtgttcatcaaagttttaaggccaggtgtggtggctcatgccccataatgccagtgctttgggaggctgaggcgggaagactgcctgaagccaggagtttgagatcagccagggtaacatagtgagaccccccgccaaccctcatctctacaaaaaataaaaactagctgggtgtggtggcgcatgcctgtagtcccagctacttgggaggcagatgtgggaggatcgctgtagcccaggagttggaggctgcggtgagctatgatctggccactgcactccagtctgggcgacagaaggagactctgtctctaataaaaaccaaacaaacaaaataaatgaaacgttttaaggttttcttcttacacatttcttgtgaagtttcttcctagatatgctgtagctgctgttgttgctgttgggaatgggatcttttctgttatactttgtatcccatctttgcccgcatattagaaatgcagctgctctgtgctgcctcttctgacacttctgtccctttctccctcaagtcctcatggtatattgtctgtacctccgtggcaatactgtgtgcctgagtgtgagttcccagtggtggggtgctcatctcactccatttcatgtcaccagtacctggcacaaagcctagcatgcggtaaatccttttaataaacgccgtggcatcagattgatgagagggacagtgagcttcacctcttcaaagtgtgacagcctgggccaatgtgagcagcagaatctcaagcagccctggctccaggccctgcaggctgtgatctggataacagattgggcaccctccttgtccccgcaggaaaaaggaggtcctgggccatttttccacgtgcagacatcagggaggagccctctgagcctctatctcattattatcctgagacccacagcccccttgttgttagccctcattagtgctaactagttgggagaactgctttcttagcttccaatcatttcaaggtagcacaaacaaacttatctgcagcttc

SEQ ID NO: 24056 - DNA, 1052 bp, Homo sapiens
tttgctcctgatagctctgccttccctccagcaactcctagaactgagttccctgaagcctggggcactgacacccctccagcaacgccccggagctcctggcccatgcctcgcccaagccccgatcccatggctgaactggagcagttgttgggcagcgccagtgattacatccagtcagtattcaagcggcctgaggccctgcctaccaagcccaaggtcaaggtggaggcaccctcttcctccccggccccggccccatcccctgtacttcagagggaggctcccacgccatcctcggagcccgacacccaccagaaggcccagaccgccctgcagcagcacctccaccacaagcgcagcctcttcctagaacaggtgcacgacacctccttccctgctccttcagagccttctgctcctggctggtggcccccaccaagttcacctgtcccacggcttccagacagaccacccaaggagaagaagaagaagctcccaacaccagctggaggtcccgtgggaacggagaaagctgcccctgggatcaagcccagtgtccgaaagcccattcagatcaagaagtccaggccccgggaagcacagcccctcttcccacctgtccgacagattgtcctggaagggcttaggtccccagcctcccaggaagtgcaggctcatccaccggcccctctgcctgcctcacagggctctgctgtgcccctgcccccagaaccttctcttgcgctatttgcacctagtccctccagggacagcctgctgccccctactcaggaaatgaggtcccccagccccatgacagccttgcagccaggctccactggccctcttccccctgccgatgacaagctggaagagctcatccggcagtttgaggctgaatttggagatagctttgggcttcccggccccccttctgtgcccattcaggaccccgagaaccagcaaacatgtctcccagcccctgagagcccctttgctacccgttcccccaagcaaatcaagattgagtcttcgggggctgtgactgt

SEQ ID NO: 24057 - DNA, 1032 bp, Homo sapiens
gctgagtgtttagaacaaggaagataatggtggacggtctgagcttcactgggcaacgtggtgctgtggcgtcagtgctatgccagagggcagagcaagcctccaggtcctggccaggccccttgccaggtatctcatctcctctcagccttcttaggatcataggagataatgtgccttgaaagttgatgagtggactgtaaatgctggtgatactgttgccccgtgaaccaagatcaatgtgctttccacaaactcttggaagtagtagtggctggtattgggattgtgtggggaaagatgaggtcatgtgttttgggtgctcagacccctctctcccagcactcggtcccccaaccccatgtcctctctcccccactgcttggggcaggtctgcaccctgaccaaggaagacaatcgctgcgtgggcaagattcccgaggatgagcagctgcatgttctccccctgtacaagatggccaacacggatgagtttggtagcgaggagaaccagaatgcaaaggtgggcagcggagccatccaggtgctcaccgccttcccccgcgaggtccgacgcctgcccgagcctgccaagtcctgccgccagcggcagctggaagccagaaaggcagcagccgagaagaagaagattcagaaggagaagctgagcactccggagaagatcaagcaggaggccctggagctggcgggcattacgtcggacccaggtgtgtggggggagggtgcccgcttggagtcacaatggcactgtcctcatgggggcccctgctcttccacgcaccctcctgcatcacactggaactggggcctctgcttaattgtcagtcagaagggtatctgcagcagccacagccagcctgataggaggccgtggggatgcaagtacagcaggacttgttatctgcgtggaagtgagcttggtagaggggaagcactgggtttctcctctagtttgcatccctcagagaatcagaggctcccctctgagctctagtttgctcccctctgaga

SEQ ID NO: 24058 - DNA, 1031 bp, Homo sapiens
tgcctccgctctgccaggaacatgaacggactctgggcaccctagctttggctgcagcccaccagagcctgtcagtgccgggctgcgtacatagaggtggcaaacatccgggaggctcccagggccttagggaaagggggaatggagagtgacaagtacccatatttcagcggtacttgcagaatttcagttttacaagatgaagagttctgaagatggatggtggtgatggttgcacaacatatgaacgtatttaataccactgaactgcacttaaaaatggttaagatgggccgggcgtggtgacacgcgccgaggctgaggcacgagaatcgcttgagcccaggagttcgaggctgcagtgagccgtgattgcaccactgccctccagtctgggcgacagagcgagaccctgtctcaaaaaaaaaaaaaaaaaaaaaagttgataaggtttatgttatgtgaattttaccacaataacaaaattgggaaaaatatacaggggaggaggaaaggaaaagctctgtttgcatttttgggtttccttgggaaggtgatttggtcggtcattagagcgctggcattgttggcattgttagagccctgcaccttacaacatcagccccttctttttttcatctaacgttcactgtgtaccagacactatgccaagctgtgcgaattcaaagatgagaaaaactgttcttaatggagctcatgttcctgacaaggggcagaacacgcgtgtaatttccagtcagtgcggaaatgctgttagaaatatttcaaaggcgctgcttgttggagcaatgagttcttgaaggaaaacgtgggaggggactttcagggttttccctggtctgactcttgacctcccccatgtttcgttactgtgtgttttctccccttctccctcttcctgagtgctggcctcatgtgactgtggaccagacctttcctaggcttccatggtccaaaagagatttataaagatgctctcattcattacctaaagaactgggccagtttgt

SEQ ID NO: 24059 - DNA, 1047 bp, Homo sapiens
ttttagaatataagaggagattacttcattggtcttgaggttagagcagtcttcatgacaccaaggacagagatctaaagggaaaggctttttttaatgggatcattttacttaaggaagagatgctcatctagtttagtttagtttagtttagtttagtttagtttagtttagtttagtttagtttagtttagttagtttagtttagtttagttttttgagatgcagtctttctctgtcgcccaggctagagtgcagtggggtgatatcagctcactgtaacctctgcctcctgggttcaagcaattctcctgcctcagcctcctgagtagctgggattataggcgcgcaccaccatgcctggctaatttttgtatttttagcagagacggggttttgccatgttgaccaggctggtctggaactcctgacctcaagcaatccaccctcctcggcctcctaaagtgctgggattacaggcttgagctaccacgctgggccagatgctcatctttaagtaatgggcactttactgtaaggacatgtgtgaaaataggaaaactgggactcttccacatttgggtttcatggaacccaggaagagttgcataagcagttctctttgggaagagacagcctttcgggcagctgaacatggttttgggaactggaggttcttctagatcctgatttttcttcttgctccccacctcagcaacagttttctgatttcttgccctgttgtctcccattggtgtgactattattctgcctattctttctgtctttgttctgtggttctagtttgaactgcctcagggacgagctcttactggttcaactaactctcactgctctgttgagctaagcttttgcgccaactggaccactggccagcctagagattgttgcccttggcgtcacatactcactcctggtctgtcagctttggatgatatggtggggtccctgggaagagcacattgccaactgtgagaaggagcttcctccagtcccctgccctgcccctattcttaccaggaaagt

SEQ ID NO: 24060 - DNA, 1049 bp, Homo sapiens
tgtatttgttgaaattttgttaacagacaattcagggagtaacctttgtagagaagctgcacccagtgtcacctgagtttctttattattcatttatcatgtaactagcttcagaaataaatttaagttttgagtataagcatggttgtaggcaattagaaaatttcagctatagctttgatagctggagctaaggagcaattcttattcaaagatactgtgtcatttagtggaaaaaaatctttagccgttgcaaaggattggattggtatgactgtaatgtgtcctgtcaggttctgttaattggttctaaggtaaagcctcgtcaatcagttatcacataattattgtaataatgaccttacatgattatatcagaaataaaggcaaaactatatactttcaactatctttcaacatacttaaaacaaccttgagtaattttagtgatattttgcttagaaaaggtaaaattcttgaaaggctttaaaaataggatgaataaatttaattatatgactcaaaacagtcgagctgggaccaatgggttaaagctatatgatattaggtattaattttaaaaaagtaaatgacaattagctgttcagaaaacatggcacaagccattaagtcagtttttttttttttttttcctggagatggagtcttgccctgttgcccaggctagtgcagtggcacaatcttggctcactgcaacctccaccttccaggttcaagtgattctcatgcctcagcctcccaagtagctgggattacaggcatgcgccaccacgcccagctaatttttgtatttttagtagagacggggtttcaccatgttggccaggttggcctcgaactcctgacctggtgatctgcccacctcggcctcccaaagtgctgggattacaggcgtgagccactgcacctggccgtaagtcaattatttttcagagatgttgagtttctacaatgacttgactagttgagacctaatccaatcccagctttgtgtcagaaatcaagacatctatttttttctttctagg

SEQ ID NO: 24061 - DNA, 1431 bp, Homo sapiens
gtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggtatgaatttctgaaattctgtcttcctatgactcctagttgtgacctaaccagtttttttctcatttaatcaatgtagctattcctatattcagtaacacttacttctatagccttaaatagataattttttttcttctatttttttttttttttttgtagagatggggtcttgctatgttgcctgggctggtattgaactcctggcctcaagcaatcaatcctcttgcctcagcttcccagagggctgggattacaggcctgggccacccacacccaaacagaggtttaaagagctttggagaaaccagcctcgtcctccagtctctttgtttgtttgttttgagactgagtcttgctctgttgcccaggctggagtgcagtggcatgatctcgggtcactgcaa

SEQ ID NO: 24062 - DNA, 1050 bp, Homo sapiens
ggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgcttcggcttgtacagaactgggggagtgggatgttgtgggcagaccagtctccggtatacacgtattttgcccctgtcggagcttgcgtcgatgcctggggcttggaaaccaccgcaaaaaaccaggctgcaaaccagcggaccgacttttgggactccgcctcttccagccgggattacctggcgtgcttcggcctttggcgtcattccgaaaacataccgcaagccaatcagcggcaaccttgctcttcggggcggctgttcgttggttgatatgccagagcctgttctgttgtctgtattggctattgccgctgtcagtcagggccgtgggtcgaaccttcacctactctttgtctgtacaagctcttgttgtctgggtgagcggcggaggcgctgctgtggattggtcacagggagaaacctctgatctgttcctattggcccgtccgtcaag

SEQ ID NO: 24063 - DNA, 1059 bp, Homo sapiens
gttactacactcccagcaatgttttaggtactttacagatattaattcatttaatctccttaacagtcctatgagaaaagtactattattttcattttacaaatgaaataagcactgatagattaaataatttgtctaaagtcatacagctacataaaaacaaagctaggatctcaaccccaagcagtctggctcattacaacactatactgcctcctcctagctttcttttttaaagggggaggggaaaaacggtcctttgaagatagcacccttttagaccgggaaaaggtatagtaatgctgctgtaggagggtcgtgggaaatgtatctggcaaagtacacagcaggccactgtctacagatcttttgttacctagctgagcattgtgaaggtgtctaaagcagtggctttcaaccattttcctacaactcacaataagaaataattccatagtgcaacccagtatgtgcagatacacatacacacacaacttatttaaaacaagttacctaaaagaatacttttagctgggtgtggtggctcacgtctgtaatcacagcactttaggaggccaaggcaggagaatcacttgagttcaggagttctagaccagcctggacaagatgaggagacccccccatctacaaaaaatttaaaaattagggttggccgggtgtggtggctcacgcctgtaatcccagcaccttggaaggctgaggcggtggatcacctgaggttaggagttcaagaccagcctggccaacatggtgaaaccccgcctctactaaaaacacaaaaattagctgggcatggtggcacgcgcctgtaatcccagctacttaggaggctgaggcaggataatcacttgaacccgggaggcagaggttgcagtgagctgagatggcaccatcggcgacagagcaagactccgtctcaaaaaaaaaaaaaaaaaaaaattagggctgggcacggtggcttactcttgtaatcctagcacttcgggaggccaaggagggtggattacttgaggtcaggagttcctgaccagcctggcc

SEQ ID NO: 24064 - DNA, 1059 bp, Homo sapiens; identical to SEQ ID NO: 24063

SEQ ID NO: 24065 - DNA, 1038 bp, Homo sapiens
agagtgacaggggcaagggggctgagggactgggcacctactgtggtctccgcaagtccttcctgtatcctccccaagagtctgagccctgccctcaaagcccctctgcctctgccaccttccccagtgtctcagacagcctgcttcaggtggccatgccccagaagctcctggtgacagaagaggtgagattctcaggagagggctttgccgtcccccagggttctttcaatccctgtatccccatccctatattctcccctaattggtacctttcaagatccttctatactgcctgccccctttcatgtttgctctccatttccctgtttctctctttttctgtcacctgcccttcgtccttcaggaagccaatcgcctggctgaggagctggtggctgaggaggagcgcatgaaacagaaagcagagaaaaagcgactcaagaagaaggtggctagagcatggctggagggtgcaggggagccaaagggatttgggagagggaaagaggaaactttgtgggaacaggagagagctcaagatggcctgcagtggactctcttgccaggaggacacaaggggcccagggactggggggtctctcacaggccatctggtgcagtggttctggaatcctactgtgctgcctaggtaggaatctgcctccttacatgaggcctcttgctggtgcctctcttgtctgctttttcacctgcaaaatgaggataataatgatgcctgtctcatagagctgcaaagatggaatgcgaaatcttagcccagcacacgacatacagtaagtgttcaaaatacatcattgttaccattactattgcagcgtcaaaaggaacggaagcgacaggagcgtttggagcagtactgtggggagcccaaggtgagtatctagggcaggtactaagagcaccaagtgccaggaaggtgagggccaagaaagcaggcagctcaaggtgatcccaactctgtacctgtctatctttcttccaggccagcactacctcagatggagatgagagccc

SEQ ID NO: 24066 - DNA, 1034 bp, Homo sapiens
tgatacacactgttcaagggcggggcttagcggagcagacctccatccagaggccattttggtgggacaggtttgagttttgttgtccaagtcttcagtataagaggtggcagtgctagctgggctagaatttgggaaacctcaatggggagagaggttatgactcagccagttaatttgactggaccctaccttcctaactagaaggatttgccctgagagttctttgctcacccctggttggggagcaggatgggcataggtggttgtgtttgtccaaggggtgattatattacagtggttccataagaggcctgcccatctggctttcctgtttttgagcagggacctgcatgcttttgggatgtctgtagggctcctgacctctcaaaggccacccaccactactcaatggtatttttgccttccagctgagctggctccttgttctagcttctcaagtaaatgttccctccccagtaccttagcctgccctggacttgtagcttctccaagagtcacgtgactcctgacactttgccccattttcaccctcctaattaataggggtctgacccaacagcctgagttctgagttcccaggactggaaagtagagtgaccaaccatcctggttttcctggaactgagggatgttctggagtgagggactttcaatgccaaaacttggaaaatgctgggcagatgggaaagagttgatcaccctactggaaatgttccagagaggcagtatttagaagggagtactgaaggggcaatgcagttgcaaagaattatttttttgcatatgcataatggctgacagattcttagctccacaccagtggtcactgtctgtttccatgttgccatttttcttccagttgcccacatttgctaggttgtcattgactcatgcaatccttgatccctggggcaatcgcagattcctcttctgtgaccacctcccagccccacctcaagtctggccctgagttctctctgctgttaccttttgcagtggccagatatata

SEQ ID NO: 24067 - DNA, 1051 bp, Homo sapiens
atcctggaagatgtggcagccaggaacctcgggccttagcctctttaggaatcccctttttagcttagtctccatagccccttttcatgtccgacatcaccccacacttttcttcatcacacctccagcctttagcctcacctccttttgtgcctttgctgtttctcacagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttc

SEQ ID NO: 24068 - DNA, 1051 bp, Homo sapiens
gctcccagttacttcctatcacatcctcctattttaattctcagcatagcatatcatcaatttgtattttcttgtttgcttagtttaattattttccttcttgttagattgcaaactccatgaaagcctgaactatggcttttttgttcactgttgtatccccagtgcttagaacagtgaacagtgcctgacacatagtagatgctcaatatttattgagtgaatgaatatggccattgccgagctgacccactgggtaatggaaagaacgcaggtcctgctgagaggccaacaccatccactggtcagtactcctgtaggaggccacttagctcccagctcctgtggttctgcagtaccaagtggcagcccctgggatcctctgctcatagactcatggttttcaagggatagctttagggtgtccttctcctagacctcaaatgacctctccctgtctgtgttccgaactccatcctggacccttctttgctttgggccctaatttgtgtctggttgtccacaggtaggtcctctctgctctttctttcagagtgaaagaatcaaagtatccctggaaggcacaacaccactttgcaagcataaattccctaatcatagttgcccttaataataataataatgccctaaaatataatcatctactagatatgatgtgggcattgagctaaacattttttacatcaaactcaatctcagaaagactggtggtgttagccacattgtcggccagtgaaactgaggctcgaaggagaaataacttgctcaggtcatacagttagtttgtagctgagttgtgactaaaacccaggtctctcggattccaaagcttgtgctcagaacccctgcagtgtacaaagtacccaaatagtgcccattacagatcaacttccgagaactgggtcttgccttcctagagtggagtggtgtttcctccttcactcattgttcatttcatatatataaaacagaacatgatcatatttcaatacgtaacttctgtacaaccaaaaattaaaacaccacatta

SEQ ID NO: 24069 - DNA, 1047 bp, Homo sapiens
cagccctgaggcatttgcttttaacaagctcccatgatgatgtcaactccccaatttatatctctagccctcttgcttgaacttcagactattgacaactgtttacagaacatctgctcttgagtgttgaagtgacatctcaaattcaagatgaccaaaacttaactccttcctctgccctgaaacctgttctatctgcagtcatctccattcagttcatgtttatgatacagctaaaattgctcatcagcatctaatgaagcaacgaagcaactttgtcaatcagacattgttgttttactttctttttcttccataaacttactctatggtagttcttttgttagtatggactttgaactcttcctgggcatctccagacctggtctctcatcaaaaggctgatctcatctaattagggcctgaggactgcaagggagggaagatcaaggggaatcctagaaacctggattccgttcaggcaggaaagcagattgatgatcaatggcctgggtccatgccacttactgcttgtgagactaggaaagttatttactttccagacgattcatagatcaacctaggggagggggtgttgattaaatgagaatatgtatagtcactgatgcatagtaaaagctcagttaactactggtagtaatgctttatcttaggatattctgagctagaaataaagtaaaaaatgaaattgatttgggagcctaaagaaattatcctgaaatgcataaagagaaacatgtaaaatactcattgaaaagctgaaatggaaaatggtcattttcccatagatattggtggttcacttcataaatctttctgaattaatcctttaattcagtatgtatttattgagcatttactatatgttaggctgttaggcactgctctaaatgctgaagaaaaatccgtgagcaaaacaggtgaaaatccctacatttctgaagctaaccttctattgggggtcatatattgaacaaaataaataatactacgggttggaggaaaggagatgattcatttggagtt

SEQ ID NO: 24070 - DNA, 1034 bp, Homo sapiens
tgccaccatgcctagctaatttttaattttttttgtagagatgggatcttgctattattgtccaggctggtcttgaactgctggtctcaggcaatcctcctgcctcagcctctcaaaagcactgggattataggtgtgagccactgggcctggccatatttgcacatttttaaagtttcaaaagatatgtatcaatttatacactagtatcttggtgtttggaggttacaagttattctctattttcttttctttttttttgtatattttctgattcctttatggttaatgtgaattagtcatgtaattacaagccattttaatttgcattaaattactagtaacacattttaggctttgggaattcaaaaaatgaataagagaaggagaaacaacatttattgaattttttttaacattttaggcaatgagctgaatcctttgtataatttaattcatttaatttttaccataattgcatgggatattatgtttccagtttacagataagggaactgaggctcatagaagattagaaactagcctaagattgtacattcagtgggatttgaaaccagatctgacgccaaagaacttatcgatattcatacaggtttaaaatttttccatgacaccacaggagcttgcagtattagaggggctcagaacccacaaacccaaagacttcaggtccaggcagacccagatcagtggctcatgagtgagacaaacatagggtcatggagatgcatagaggggagatctggctgcataatcagggagtgagatctgatgtgaacttgatgtcagatttcaggaatcagcaattgaggctagagcttttcccgaaggccaaagaatgtgggtgcagtggcaaggaggaagagtagggacagatgggttgtctggagtagacgtggggaagtttctgacacaggcagtactggacaaggttgtctgcacgaggtttgttgattcatatttcacggttaatctctttgcatttatttattttatagcattaccacttttgt

SEQ ID NO: 24071 - DNA, 1112 bp, Homo sapiens
atcggtggtttctagggtctgccatgggtcttactaattatttggaaccaaatataacagaaaacaagtttggaattctaaaaaatcccttaaaaacctttttaaaaaatcttggacacagcagctgtgaatggtctgggcctgcctgtgcagttattgctgaaattactggggctgttgagtatttggaaatcaaatcccagaagtgaattggctgtgccaatcagttgtaaaaggatctggccctgggaggtttgatgggtaggggcaaatggggacatgggaagagggtgggaggcttcaggactgcatgaactgagtagaaagatttggcctttggggacagagcatgcaacgggcagctgttcccggtgacctgggcatctgggacttactgagggagagacgtgatcttggcctagctgaccaccatcgaaaccactcatcggaggcgtggatgcagtttgctgggaagatgagcaccgatctgtctggtggtcacatggagggctttgcagatctctgacactggatatttccccttgccctggtgccaaggactaggggagagatcactctgggcttgagtcagggacagggatgccaggcacagcgaaagaagatgactgtggtacaaacccagctgatgaagtggaaaataaataaaagagaaggaatcaagctggttcatgtaggaagcatgcacacactcatcccatccattgttccacatcgggcacctccctgagctagctgccactcctgctgcactctgccactccttggaaggcagcacagggcagtggttagagccttctctttcagtgtcagacaggcctgggttcatgtccaggtctgccactttacttactagctgtgggatgctgatgagcccaagctctctcctagcctgcttcttgatcagtaaaatgacaatgactagagtacctagtatatggagttactgcaggacttgaatgtgccaatacatctaacatgcttagcatagggcctgatcatggttggcatttgataagtgctagttgttatcattattaatattactaatcatcaaagaaagatcttcagttggatatttgggcaaaattatg

SEQ ID NO: 24072 - DNA, 1061 bp, Homo sapiens
gaacaaattaatggcattcgtagcaacctggatgggattggagaccattattctaagtgaagtaactctggaatggaaaaccaaacatcatatgttctcactcataattgggaactaagctatgaggatgcaaaagcataagaataatacaattgactttggagactcagaggaaaggatgggaagggagtgagggattaaaaaaaaaacagccctgtgagtttccagttttaataaagctctgagaattaaaaaaataataatgtaaaggtgtatagcatgaaattagactatatgtaatgtctgtagaggagtgaatcccactggccgccccttacccacagatattcctggagggacttggagttttaagtctcggttggttcctggaagaattttgcccaaaattaatagtggcccttcctttctctgcagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccaggtatgacccttctctcagggcagcccctggtgacaaaaaacttccttggcatgttctttctgtactttctccagccgctcccagcgtgtggataggcagtcacccaagacactcatggatgccagcacagctgtaagggctccctctcagccggagctcaggctgttctggttgtattttatacccaacatgtactcagtattaaaaggagtgactagagaagaagcatgaaatccaagtaagacgctgttcagtgttgtcacatctcgggcctcagggcttggaagaggtcaagccctctgattcgtggtcggctgttccctctcccacacaaggctccctcctgggaaaggaatttctgaccatgagtagaacacgctggggagatatttttagactcattatttgtctttggggtggccttgaggtaaacctgctttccttgttatcatgctggggttggagaagggaggctgc

SEQ ID NO: 24073 - DNA, 1034 bp, Homo sapiens
agcagtgaggaaacagcctcagtcttacaaccacatggaacggaattctgccggtagtctgtccagttgaatgtggattttcccctcaagcctcctcagaacagccgggccagctgacacattctgacacatttgctttggccttgtgaaaccccgagcagagaatctagttatgccatactggacctctggcctgcagaactctgaggaaaataagtgtctaaggtgctgaatttgtggtaagttattatagcagcaatagaaaactaatatacttctcactgaaagtcaaggtaaaaaaaaaatcaggaatactactgtagtggaaaggatcctggatggggtccgggagacactggttttcatcctgctactcattatctcccatgatgtgttaatcacttacccttcctgagctttctcttaccaattaagtgggttattttaaagttttttccacaggacatatttttcttttgtgaactttatttttttcagcaaaatttacctattttagtgtgcagctctgaacattaaatacctaaaatcaccatcacaaggtatagaacagttacatcaccacaaaattccctcatgccacgcctttgtagtcaacccatcccaccaataatgtctgtggaaaccagtaatctattgtccctgtgattttgccacctccagaatgtcatataaatcaaatcacacagtatgtagctttttgagtctggcttcaatttagcataaggcatttaaggttcatccatgttgcatgctatcagtagtatgttcctttttattgttgaatagtgttttgttgtatgggatgtaagtaccacaatctgtttatctgccaattgaagggcatttgagacttccagtttttagtgattatgaataatgctactgtaacatttgcatataggtttttgtgtgaacatcactttttgttgtctcttaggtatataggagtaggattgctggatcttatttaagtgtatgtttaattattaaagaaaatgccaactattttccaa

SEQ ID NO: 24074 - DNA, 1049 bp, Homo sapiens
tgtggttgtgaagcccacctgaagattctcaaacacacatttcttggggatgcccagaagaggtgatgcaataggtatcctaaaatgtctaaccaggggttcatggagtgtcaattatgggtccagtgtaagaggggaaaagagtgagcagaggagggaactggggaggtgatgacagagagaaatggaaggacccagggaagtcagagagcagatgcagtgagaataagggcactggagagcttgaaggacaggaaatcatggctggtgttaacgtttccagaaaaatgacatgttccagggtacaatttggaagtgtgtgcctgttatggactgaatagcaacccctgccaaattcatatgtcaaagccctataccatccaacgtgagcatatttggatattgggccattaaggaggtagttaaggttaaatgaggtcagttaaccccaataagggtccctcattattgtgtctttaaggaggtacttaaggttaatttaaagggtgagaccctaattaaataaggctctaatgggaaaacataaagttttttttttttttttttttttgagacggagtctagctctgttgcccaggctggagtgcagtggtgcaatctcggctcactacaagctctgcctcccgggttcacgccattctcctgcctcagcctcccgagtagctgggactacaggtgcctgcccccatgcccggctaatttatttgtatttctagtaaagatgggtttcaccgtgttagccagtatggtctcgatctcctgacctcgtgatccgcctgccttggcctcccaaaatgctgggattacaggcgtgagccactgctcccagcctggaaacataaagttcttatagagaaagagacactcaagagctctctctctctccccacatgcacagaggaaaggccatacaagggcagagagagaagatggccagctataagccaggaagagagccttcaccagaaaccaaattggttcgcatcttgatcatggacttctagcctccagagctgtgggcaaataag

SEQ ID NO: 24075 - DNA, 1027 bp, Homo sapiens
tgaagaaggtaaaggtataaaagaatggctactccatagacagagcagcccctcaatcattgttgagagctgctgggagtgggaggtaattccccaccttcctgcaacctgtgcaggagagaagagcggcattctgtagcttaggaaaaagttcctaggcaaagaaaggcagatcccggcagggtaatgtctctggtaaaaggcccgagggatatggctctgctataacaggatctagatcttacacttcaaaaattatctttcaatgctcagaatagtatttgggatactatagtcccctgacaactgtggacatatcaacctgatatgagggtatatgtgagaaatgcttgcagatacacattaaatctgtaccaacaaaagaatatggaaagaaagaaagagcaagaaggggccaggaaggcagcctgcaccatcgtttctttggcatggggagtcatctctactcacactttctcataaatcttgttcggatgctctggccattcgatcatgcacacgactctgctgggcatggtctctgtggttgagtagtagccctgggggaaggccagcaggagagccaggacccagatgacacagatgaccactttggtggctgtggctgacagccggggctggaggggatgtatgatggccatgtacctggaacagagaagaaagaacaaagttctgatctggtcaccaaaatctgtatcagagattccatatttttcctgccaataagaaaattcatagaaaccctttgattcctgatgatttgtacaattattttccaattccttttccatattctacccttaagctttgtgatatgccatacaatgccaacatgcgtaagaaaagccagctagatttttcagtatttcagaacctatctagcagcattcaaggagagacattttcatcattgaaatgcttgtgctggggacaggacagccaagtacaggtaagtgaaattagaaaaataagaacaatgttgtaaatttattcaatgtaaagactg

SEQ ID NO: 24076 - DNA, 1048 bp, Homo sapiens
acttaacaaagagtgagtacagctgaaggagccggggagcagcaggtatatgcgtcaggtatgaggaagaaaatagattttggaagttatgagaactgtagagattgagttgagcatagtttgtgattttgagggcctctaaaagtattagggcagcagcagcggctgcacggagacatgatggccagcctgaaacagtaaggtcaagttgtttggacaaaaaggctacaggacgcgatcctggtccttacataagaattccgactgcacagccctgcactttggctgtgtgtaatgaaaagggttgggatgagtcagggagaactagagtgggggcaatttctaaagctgtcttcaaggaatggaaagaggagtggggaaaggatttaggatctatggggtcagctaggtttccttttgtgagcttatataatggttttgttaggatggccaaaccaggtatccaaaggcgaaagtatccaaccatggccaggaaggaaaggagttcttgttttgtagaaggggttggggtttgagagatcagtcagacacgattggcagggagagcacgtgtgtttttatgagaattatgccaagataggtaacagatgaggaagaaatttgagcttgattgaagtaatgggggctgtctgtgaagctttgcggcagtacagcccgggtaatttgctgagcttgatgggagtcagggtcagtccacgtgaaagcgaagagaggctgggattaatggtgcaaaggaatagtaaagaaagcatgtttgagatctagaacagaataatgggttgtagaggcaggtattgaggataggagagtatatgggtttggcaccacggggtggacagacaaaacaatttggttgataaggcgcagatcctgaactaacttgtaaggcttgtctggttttaggacaggtgaaatgggggaattgtaaggagagtttataggctttaaaaggccatgctgtagcaggcgagtgataacaggctttaatctttttaaagcatgctgcaggatggaatattggcattga

SEQ ID NO: 24077 - DNA, 1018 bp, Homo sapiens
gacaccttgtgataattacatgatctctgaaattctttgccaatatacaaagtgaaatttttattaacaacttgcattcacttgaatatttagattttgaggcatatttttccacttttctccaatttcaacattagggtggaagataatttatatcattatcctgtgacctatgaatctattgctgatttatatcaaataagttcatgtcaacacactcttaaagtcattactatttctgttttctattaaagcataagagcagcagtgattgtttttatatttcgtacgtaagatattgaacattgctgccagaataaaaatacatatcctcggaatcagcggggaaagaagaccctgttgagcttgagcttgactctagtctggcacggtgaagagacgtgagaggtgtagaataagtgggaggcccccggcgccccactgtccccgggagggggcggggcggggtctgcccgccttgagggctgccggtgtaataccactactctgatcgtttttttttcactgacctggtgaggccgggggggcggggggcgagccccgaggggctctagcttctggtgccaagcgcctggccacgcgcagcattcttatacaccaacaacagacaaacagaaagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcagtgccatccccatcaagctaccaatgactttcttcaccgaattggaaaaagatactttaaagttcatatggaaccaaaaaagagcccgcatcgccaagtcaatcctaagccaaaagaacaaagctggaggcatcacactacctgacttcaaact

SEQ ID NO: 24078 - DNA, 1046 bp, Homo sapiens
tattattcaaattatgattcttttgtgcactaggaaaggagtcttctgtacagatattttccctctggaagacagtggtaaatgtgggcatagagaaaacactacttatttgcacgatcctcatttagggaaaggacctcatcctacttcttgtttctgcagcattgagccaataccaggcaattaattttccaatgccttttgccttacaatgttgtcaagtgcctttatctatttttcacttagctatgggatcacttttatttcatgagttttctaattatttaattagaaggaccattagttatgcctgagtttttcctttctttgatcaattctaggctccgacgttctgctaactcctagaattcacctaaagaagcaagtggccacagggtgctgtggctcatgcctgtaatcccagcactttgggaggccgaggtgggagttcaagaccagcccggccaacatggtgaaaccctgtctctacaaaaatacaaaaattagctggtcaggatggtggtgtctgtaatcccaacttctcgagaggctgagatgggagaattgcttgaacccgggaggctgaggttacagtgaggtgagatcgcgcctttgcactccagcctgggtgactgagtgagactccatctccaaaaaaagaaaaaaaaaaaaagcaaatggccagtcagagttctaagcaaatggccagccggagttctgttttttctttattatgctacttattaaaatttattgaatgtctgtacagaaattagggaggacagtaggaatgtctttaccctctagtaagtctgaatagtccttacaagtttgggacagactagatggtccctaaaatcaagaacagattctggttttctttgtttataatgttagattttaggccaattaatattccagttagaaccttggggatccctgcaaagaggtcctgtattatttcagttctgcttttcatatctttttttcagttgatgctagatcaagttggactaaatcttcttggatgtgtctatttggctttg

SEQ ID NO: 24079 - DNA, 1035 bp, Homo sapiens
cccgagttgccgcacttgaagcggcaccagacggggcccgggagattgtacctctacctctcctgccggggctcttagggaatgccggttgcagggcttgtgtttggagctgaactttttatttcagtcttgcctgtcattgtacctcagccgcctcctctcgggaattaaaaactttgaacgccagctttactaagtcctgcataggggtttgggggccctccactgcctcatccaggattagcggatatcactgcccgcagcaaatatgttaggagttgtagaagtagtggactggtatggcactatggggaggtggaaatgagaatgggggtaagacggaagccaaggagttaggtgggcagggttaaaagaacaaatgggaactaacaggaattaaaacggtggccgaatggcagcagaagaactaaaatggcggcagagaaaaaaggaagtaagatggcggcagtgaggaagcaggtagtaagatggcggcggcggtgcagaaggagatggcggtggagagactaagatgggggccgcggacaggattaacggcaagagaggctagccacacttcaagtggaaggctaaccagagggacttgcaccagcgaaaacacttggtggcagtggtccgacgagagtggaggtcccagaaccattgaacaaatttgatttttgactatttgcctcgcctctgacaaaaattggtaaggtcgtttaggatactgaagtcgagtgtgccttcggggagccagcgagattggtcgtctaaggtatattgcggccaggcaaccatgcagaagaaaattagtcgctttcgttttaaatcttggtcgagttgtaaagttgggaggttgtgcaggaggcaccctaaaggggtgttttgcgcgattttggactgggtggacctcatcctcttccctttatggcagcagtctgagggacagcagaagcgtcctctggggtcactcagaccacgcggttcctggagcctcggatcggctacttcagacacggacgtctccgagtt

SEQ ID NO: 24080 - DNA, 1055 bp, Homo sapiens
ggcagctaaaggaatggtaaaaaagcaatcctttagatctatcactatgagaggccagtattttgggataattgttggggagggtaaccctggttgtagtgcacccatgtgttgaattacagcattaacagcccttaaatctgttaacgttctccatttccctaattttttcttaatgacaaatacaggagaattccaaggggagcaagtaggctctatatgacccttttgcaattgtttctgcaccagctcttttaaagcatccagtttttcctgtttcagtggccattgctctacccaaaccggtttggcagttagcgaaacaagaggaatgggagccagaggctcaacaatggctgcttctaaaaatgacaccccaatccggtccaatctgtttgtcctattaactctaaaggttctgattggccatttttatcttttcctagtccttttcctgggttatatcccatatttctcatcatttgtctactattactactatattgatccataggaatagatatttcagcatcccattgtgttgcaataagtctttaccccataaattaacaggaatagatgaaatgataggctgaattgtgccttcgtgaccatccgacccttgacatggtaaaatcaaggaactttgaaaaacttctgaggcagctcctactccagcaataaaaatggatgccttttgcttaggccaatgctcgggccattggtttatagcaataatagagacatcagctccagtatctactagtccttcaaaatcttttccctcaatagttactgtgcaaataggttttttgtcagacacttgattaacccaatatacagccgttcctgttggattagtactaccaaagcctcctgttcttttcactgtgcttcttctagttttatgtaaggtaacagcaacaactgagcaattctttcccctggggaggcagaccacggagttgaggaactaataacttattgaatttctctggtataatcacagtcaattattcatgtatgtacagtaaccccttttaaatttagactag

SEQ ID NO: 24081 - DNA, 1049 bp, Homo sapiens
ttgcaaagaaatgactccattctaaaatataaccatttgatttttaagttaatttttcaggggactaatagctatgatgtcattcttagaatctcaaagctacaagtaatgttagcatgtatagtttattcctctactcagttttgaattctcttacagtctacaacatattcccaatacaagatattctcaatctgcttacataccctcatgcaggcatttaaaaagttataataatcagttgaaagacaaacttggactttttttccctacatattccttctcattcattttctcatcagtggttataatgtataactataagaaaacactactctgtgaaccattgagtgaagtataagaaatatacactgtgcccatttaaaaatgtgtgagtctaaatgaaagaaaaatatctttacactttgcagcttaggattctttttatgttcatatataaaatattaagtctgtttctctttattctttcaggaacaaacaaaattgaacactatactatgtcagacttttgtattctgttatttgtggtctttgggtggaaacctaactgaaaactactatgattcttttgatacatttattagaacacaatttgatgataatcctgatgccagggtaagaaccaaataaattatattttaacataataattctgaattatttaaattttaagattaaaactttaaaagctttagttctattgaaaatataacttatacactaaactggttcctaaaattattcatgtttttccaaccatagacaacatttatcatattttttaagttaggagccctctcccagtcatattaaaaaagtaagatgtataagtatataaaaactctctactgtaaacaaatattgaattctagttagtaaatttatttttcacagtgtgaaagtaacagtgtgattggttagctatcctgaattgctggaatgtacttgctatatattctaagattgactaaataagtaaatatgttgagaataatggcaatgaatttctcactgttagagaagggatt

SEQ ID NO: 24082 - DNA, 1810 bp, Homo sapiens
gcaaaagcaagaggcctgggggcgactggggtggggcgtctcctagagcgaggattgctgcagagtgcgcgtgcacgcccgcacatccacacccacggctacacatcatatctgcacacgcacaaaaccacacaccctcccacgccggtcccatatcctttctgcggggtgagcagcagattcccggaaagggggaaatgtagccgcaaaagcaaagccgggggcctggcgcccactctggcggcgactacagcccccacgctgggcacactgcgagctgggggtgcccggcgcgggagaagccgcgcccagccgggctggtagcccagcggggggcgcggcagggcgaggagcagcccgcgctgctcccgcccctcgggtgccagcaccgcccctgctgcggcgggtgaggggcggggcggggcgcggcgtatataaggctaggggcgggcgccgctcttttgtttcttgctgcagcaacgcgagtgggagcaccaggatctcgggctcggaacgagactgcacggtgagtgcggcgccggggcggggggcccacccagggtgtggtcggatccggtgcaccgggcgggcgcgccgcaaccgcgacaggcgcccttctcggaccggacgcaggggccggcgaccacgccctgggaccgagaagaggggtgcgggacgcgcccagatcctcggccttggggctgctcggcacgccttggcgcgagtgccacgtcgagaggcgtcggcggggagcgcggaaggggacgctggcccccaggcccaggtcaagcgccttggtttgcccactaggattgttttaagaaaatggcagacaaaccagacatgggggaaatcgccagcttcgataaggccaagctgaagaaaacggagacgcaggagaagaacaccctgccgaccaaagagagtgagtgtgcctcggtctcccgcgccccagcccagcccctcaccctgctcttccttgcaaacccactcctccaccccccaccccgccgttgtccccggtgtgggcggccccggccactctttcagtttcacaaagcgccttgtttctccccagccccaagcttccttctaaatccccacacctcgtgggtgcctcgcccacaccgggaagcacctcggttgcgggtgggggttgcagctcccctccagcgcccgcttcccgctctccacagccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggctggcgtggtctgagtcttttagttgagtatgcgtgggcagtgccactgcagcaaagcccctcgatggagtagagttcctgccgcaaaggggaggaggtgggtcgcagaatgggctgactcggagggagtttttaattttggctttacctgcttctccgtaagatttcatgacttgttagccacttaactcttgctcgtaagcaatctgtgtaaaatttaaccccactttgtccccaggttgcgttggaaaatgctttttcaaaagagcaaggtttgcttttgataagcttcgaaagccccactgtttccctctggcctcctcctagc

SEQ ID NO: 24083 - DNA, 1023 bp, Homo sapiens
caccattgcaaccatcaccatcacctccaccatcacaccaccactaccattatcatcatcaccattgccaccaccatcactaccatcactactaccatcaccacctctaccatcaccattgccaccatcacacctcaaccaccacaccactaccatcaccatcaccaatgaccattgccaccacctttatcatcaccatcaacagcaccactatcaccacaccaccctgtccccattgccaccatcgtcaccaccaccatccctattgccaccaccaccaccatcaccattgccaccatcaccatcatctccaccatcacaccaccactactattatcatcatcaccattgccaccaccaccactactaccatcaccacctccaccatcagcattgccaacaccttcaccatcaccaccaccaccaccatccctattgccgccgccaccaccatcaccattgccaccatcaccatcatctccaccatcacaccaccactaccattatcatcatcaccattgccaccatcactactaccatcaccacctccaccatcgccattgccaacatcttcaccatcaccaccaccaccatcttcaccatcaccaccaccaccaccaccatcaccatcaccactaccaacaacaataacgacatcaacaccaacacccatacatcatcttcttctaccctgcctatgaacaatggccaatagaagaccaatattatgcagatatcaatcaatgagcttcagagggcccagtgcaggaaatgaggcttgagtagtataaatttaaggcactttggggttcagcaatataaaaatctgtgaggacattttgttttggtttggttgtcataataattaggggacattattggcagttcataggcagagaccagaaatgtttgacattctgaaatgcatagaacaatcctacacatcaaatatttgtctcatgcatgactttgttttaactctttactgtattataacatatatatggtggccaggtgtggtgg

SEQ ID NO: 24084 - DNA, 1048 bp, Homo sapiens
ttaaatcattcaacctttcagtcactactatgtgtaaggcagtctgctaggttccaaggaatgtggggctaagtgaataagatgcagctccttactttaagtctggcaaggaagatgcattttttacgtagcttccacagtgcattgtgaaacatgccataaggaagggataaacactgatgacaaagtaattgccaacttttactaattttgtcaaatttcagagaggtactctactgtgattctagcacttttttcttgagtgccttcttaactcctttttttttttttttttttaaagacagagtctcgctctgtcgcccaggctggaatgcagtggcgtgatcttgtctcactacatcctccacctcctgtgttcgagtgattctcctgcctcagcctcccgagtagctcggattataggcacctgccactgctactggctaatttttctatttttagtggagacaggtttcaccatgttggccaggctggtctcgaactcctgaccgcaagtgatccacccacctcagcctcctaaagtgctgggattaccggtatgagccaccacgcccagcaccttcttaactctttctgggctacttttgattttgggtaaaattgtttgagatttcaagccggttgcagtgatgtgcacatgtagtcccagctagatgggaggctgagagaccctatttctttaaaaaaaaaaaaacaaaaaaaaacaaattgagatttcaagtagagtccttatctttatctgatttataatttctctagctttttgaagattttcacatgtaaaaatgatagtggataaatgagcaggtggtcatattgttatgctagtttcagaagtatctgatactatttatttttaaaatgtaaaatacaagactacgtaggccattaatctacttagtcccaactttttttgtttttatttttttaattggcaaaaattgtatatatttatcatgtataacatgatgttttgaaatatgtatacattgtagaatggcagctccaactttttgaaagttgtacc

SEQ ID NO: 24085 - DNA, 1030 bp, Homo sapiens
taattaattttagtgttgtgctaaggaccatgatgtttttcatttccttaaaattataaggtattttttcagtctttgaagttattcattaaaattgagaaaagaacccgtaagcagtatacagatcagagcatcttaaaatttggtaatttttttttttttgagaccgagtttcactattgttgcccaggctggagtgcagtggcgcgatctcggctcaccgcaacctctgcctcccgggttcaagtgtttctcctgcttcagcctcccaagtagctgggattacaggcatgcgccaccacgcccggctaattttgtattttttttttttttgtagtagagatggtgtttctccatgttggtcaggctggtcttgaactcctgacctcaggtgatctgcccacctcagcctcccaagtgctgggattacaggcatgagccactgcgcccagccagttatttttatatgttagccatgtcttgatttatgttaaagatctgggataaggcagacagtttcctaaaggaacatattacctagattacatgagaaggaagtgaggagccaggaaaagataggctgttcttgggttggtaaggaccagtggccaggtgggtgttggcagaggaaagacaggcaaggtgggtgtgaagcttggaaatggatctgtagctacaggatgttggaaacagaaaaccagctctcacgcctgatggaatgtcttgagagctgggtaccaggaagtgaaaacactgcccaatgaaatgaacaagagatgaatgaattgccttgttaggcaccttccaccattccctctctgctacatccctgatggccctcttggtgtttgttaaccatggtaactgcctgtagaattgtttttagttgttggctctctgagttgtagcaaagtagaattatgagttcatccaattcatatacacagtcaattagcctcatatctttttttttttttgtcttgaggccgggtctcactctgtcacccagactggagtccagtgacataaa

SEQ ID NO: 24086 - DNA, 1048 bp, Homo sapiens
tcaggaacttcgacatcacttgggcaggaccagccaagtccagataagatacggggactgggccccaggtaccactgtgtcctcaggttacaaagaaaatgtatgatattgtgtgattttatgtatgtatgtgtaattaattcttgttataggtgctaattgtgtttttcttgttgttgtttttgagacagagtctcgtcacccagtctggagtgcaatggcgtgatctcactgcaaccgccacctcctgggttcaagtgattctcctgcctcagcctcccaagtagctgggattacaggcactgccaccacgcctggctaatttttttgtatttttagtagagatggggtttcaccatgttgaccaggctggctttgaactcctgacctcaagtgatccacccatcttgacctcccaaagtgctgggattacaggcgtgagccaccgtgcccagccgctagttgtgttctataaagtttacatgaacaccaagttagcaattactgaacctctgttcctagaggaatctcagggtgaggttcctctgagcctctggttataacattttttcgatggatcaatacgtaaccttgttttatgtgtatttctgctaaaatacatcacatattatattatatatgatatatattatatatcatatataatatataatatgatatataatatatataatatataatatgatatatatatcatatataatatataatatgatatataatatataatatatattatatatcatatgatatattatatatgatatatattatatatcatattatatattatgtgatatatatgatatatacatcatatatctgagatatatgttacatgatatatatctcatatatcttatatatatttagcagcatttcagcactacacttgggagccatttaaatagcgaaactaccaagaaacagcacaaaaaggtgaaaacatgggactaaatagaccatgaaaacgacacttgtttacaaaatgagagctgaaagaaggaggcagagcattgctttgttg

SEQ ID NO: 24087 - DNA, 1033 bp, Homo sapiens
cattttcctcattttatgtttatgcttagtcccttccttctttcttttccgtattaccgtatatcactctcagtgatacaaagacatcctttctcagagaaagtctcccaaagatcagttcatcctaaccaactgtttactgtacctttcagcttgcatgtcttatcacttcaaaccaaacatgtctaaaatcagactcacatgcctcctaaaccagacataaaccacaactcttttccgccagtgctagagtattctctatactttgtattaattattcctactcctatacagagctttatgtttgttgtaggtccctttattttaaaatccgtgaagaaactggagcagacataaagaaatgtaatttaacagttgacggtaggattttggaggacttgctaacattttaaattggttagcctacaaaacaggggaaagtgacttagttcatgtttgtggtgagtttttgagactggatttaggataactgctctatatgtggagaacattagaacaaagggacctgaagttatatttcagtgtcttagcgaggatttcaggaactgcttggtatgaagagttgtgtcagggtgagtctgttgtacttccccagctagaacaagtcatctttcatcattttcatatgtttggctttgtttctgtaggtctctatcccttagtcttcatactgttttaaatgcttatttacttatccttattccccatttaggctctaagcactaagtgggtactgcaagtgctcaaaaattttggttgctagaaatagtagtgttaagtcaatgagaaatggtcttaaaatatagacccagggcagatcttttcccacctcagtacaatgagctgtcatgtgccttacttgactgggaatctatcacaaatacatgtgcagacatttctagtttagataacattaaaaaaacatttagcgaacagtatgtattctgctccctccttatacatcttgcagtacattaaggatttccagttttcctttccctcaaacagttgc

SEQ ID NO: 24088 - DNA, 1028 bp, Homo sapiens
ctaagctcactcatgagcaagtccattgttgctaagataagtttctgttttcagaacagggatgcatttctatgaacaaataaaagagtgtagatcagttctttaaaatgaggcaaaccaatcagttattccaaagtggaccaagttcctctatactgaaaacttttagaaatgaattaaacttccctctttcacaaagttcataaagaactctttaaatacaatatttcacccatttttctattcactttgttgggcagatttgaaccagctttaaatcatctgtagccacaaaagaagttttatcacactttccacctacctcatgactttgtgaagattgacaaagtaatatatgtaagtcattaggtacataattaaaagtgaaggaacttgctattaaaccactagagggacgacctctgtgtggcaagaatttttattcactgctgtgtcctcagcaaatatttttgttcactgctgtatcttggcatataataaataataaataatgaaaggatgggtggatgctccttgttgttacatatcacaggactcacagaattctacctggaaaaaaaaagtagaaaagccgatttccagtcagaaagggttgttttaaatgttttaaatgctgaatgaatgtatcagtttcaagtaagactactgcgtgaagactacacatattgcaaaacctacttactaagcttcccggttctctttcttctggatcttgctcctggatcatgctctccccctatttcatttctctttctctgctgtggaatctctttagccataggttttctcttgaagagtgtgtttgtacgggtctcgataccccatttctctctcctcttgagtctgtcccttaaacacagggcataggtttttaaaaatatgcgtatatagagttatatgtatatttaatagatctttttattctcttcctatttctaaaaataactaaggaaagctctctaaaaaaaaacagacaaaccctagagtttctttttattttggcaagg

SEQ ID NO: 24089 - DNA, 1047 bp, Homo sapiens
taaaccccagagggagccactgaccaaaattttatcattccctcattttccttttatagttttactacatgtttgatttcctaaactagatactggttttcaactttatactgtatgtattcttttttttttttttttttttgagacggagtctcgctctgttgcccaggctagagtgcggtggctgatctcagctcactgcaagctccgcctcctgggttcacgccattctcctgcctcagtctccccagaagctggaactacaggcggccgccatcacgcctggctaattttttgtatttttagtagagacggggtttcactgtgttagccaggatggtctcgatctcctgacctcatgagccgcccgcctcggcctcccaaagtgctgggattacaggcgtgagccaccgcgcccggccaatactgtatgtattctttgaaatttcctttcactcatctgaggcagatgttcttaccgttgctgtgattcattctttttccaattcattctgtgcatattgaactgttgagcctttgaatctgaatagcctttttttttttttttttgagacggagtctcgcactttctcgcccaggctggagtgcagtggcgcgatctcagctcactgcaagctccgcctcctgggttcacgccattctcctgcctcagcttcctgagtagctgggactacaggcgcccgccaccacgcctggctaatttttttttgtatttttagtagagacggggtttcaccgtgttagccaggatggtgtcgatctactgaccttgtgatccgcccgcctcggtctcccaaagtgctgggattacaggcgtgagccaccgcgcccagcccctgagtagcctttttaaaattcagttacaaaaactgccgtcaacattcttccacattctctaggtgcacacagacaaaagattccctccccgggaatttatttaagagtgaaattacggtatcataggaggtatatgtgtttaacttgactaaaaatatgaacaaatttttcaaagtggttgtgctgatt

SEQ ID NO: 24090 - DNA, 1026 bp, Homo sapiens
ggtgatccacttgcgggcctcccagagtgctgagattacagacatgagccaccacgcctggcttcgtgctataatttcttacctagcccacactttttgtcctttttatttcagccatcctagtaggtgtaaagtagtatctcaggtggttttgatttatatttctctgaaatataaattatgttgagcatcttttcttgtgcttatgggccatttgtatatctactttgaagaaataccttgatcctttgcccattttttaattggataatgtgtctttgttattgaattgtaatagttttttattccttatgtaagtttttttatctgatagatgatttgcaaaaattttctcccattctgtgggttgtgttttcactttcttggtggtgtgctttgaagcacaaaacttctaattctgataatgtcccgtttatgtattttttcatttgttgtgcatttgatgctgtatctagaaaatcactgcctaattcaaagtcacgaagatttaaacttgtgtgttcttctaagagttttatagttttagctcttacatttagatatttgacccatttagaattaatttttatatgtggaatgaggtaaagggccaactttattcttttgcatgtgagtattcagttgtcccagtatcttttgttggaaagactattctttacccaatgcattgtcttggcactcttgttaaaaataggttgactataaatgagggtttatttctagactctcagtctattcacattgatctatatgcctggtgtttttgtttgttttttgacacagagtctcactttcacccaggctggagtgcagtggtgcgatcttggctcactgcagcctccgcttcccaggctcaagcaatcctccaccctcagccttccaagtaattgggatcacaggtggaagccaccacgcctagctgatttttaaattttttgtggagatggggtttttccacattgcccaaactggtatcaaactcctgagctcaaagtgatctgcctg

SEQ ID NO: 24091 - DNA, 1095 bp, Homo sapiens
aactttgttctttttcaatattattttgggtattctgtgtccgtttcatttctgtattttagattcagcttgtcagtttctgcaaagaagccaactaggattttgaatggaattatgtcgaatcggtagattagtttggagagtattgccatcttaataatattaaatctgctgatacatgaacatgggatatgcttccatttttgtaggtttttaatttcttttgacaaacttttgtagttatcacagtatgagttttgcacttccattgaatttattcctaagaatagatggtccccagtttatgatggttcagcttatgctttttttatcttatagtggtacaaaagcaatatatgttcagtagaaacagaactttaaggacatacaaccatgctgtttttcattttcagtgcggtcttcaataaattacataaaataggctttgttttaggtgattttgcccaactgtaggcttacataagtgttctgagcacgtttaatgtagactaggctaagctatgatgtttggtaggttaggtgtattaaatgcattttcaacttaaaataggtttatcaagtttattaggatataaccccattgtaagtcaaggagcatctgtattctttttactgtcttaaatggaatttttatcttacttatttatctatctattttgaaaggttctcactgccacctaggctggactgcagtggtgccatcatggctcattgcagtctcaatctcaggctcaagtgatcttcccatctcagccttccgagtagcccacaccacatgcacatgccaccacagctgactgaatttttaattttttgtagaggtgaagtcttgttacattgtaaaggcttgtctcaaactcctgagctcaagtggtccccgcctccacctccaaaagcgctgggattataggcatgagccaccgcggctgttttttaaattttatttttgaattgttcattgcaaccatatagacaaacaattgattttttttttcatatagatctcatatcctacagtgttactgaacttgtttattcattccaagagtggtttgttttgtttgttggttggtt

SEQ ID NO: 24092 - DNA, 1030 bp, Homo sapiens
gccagatctaatcttttgacagtgggaccagttcattttgctaaccccaacttgaagatcctcacaagccttgcagtttcatttatatcctaaatgttatatttcatcaagaaatttgtctagtctctgtgcagatgagccaggtttcccagcatagcccagatctcataagtacatgcatcaggggagcaagtcaggcaggtagaccttgtgtctgccctgctacactgtaggtccttggtagaagaaatgtaggagtttgtatgtatgtgttttcttgccctttctagcttctgcatataccaagaagaattaaatagagtaatagagaaaagtcagaggaaatcttaggatatttttcagttgaatattctgttcactgcagattttgtttttgtgttttattttcctctttttatttacccccagatgaaattctggttagatactttcccaagcatctaatctgtaagaaatcctgttttccttagaaaattttcacctagctttctctggagtggaaaaagtctaaatgtctttttttttctcattgagtctaattaaagcatagatttgcacctccaggtaacagtattgcaacaagtgtggggaattcgtctcaacacaattaaggataaattacagccaagtattccagcaatgtctcattctgaattttgccacctgtaaaacttcacagtggagagcactgtagaaattggccatgccattgttcattgactttttaacaataaggtcttttctttttaacttacacaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccacca

SEQ ID NO: 24093 - DNA, 1070 bp, Homo sapiens
gcttacctgctaacatttgacctgtttggaaattggggattgtttttcctcattgaaattggtgagggttggaagaatacgcaaacgaatgtttggtgtggaagaacgctggaggagtaaacttactatactcacaatttggattacaacatagtttggttaacccagctctggtgaaccaaatgtacaagtattatttccttatggttcatcttataaaatattttataaattggttgctttctttaagctctccacaaatgaaaaatcagtcccaaaaatctataaaagactatttcagcgttaattgaccattaaggaaatacatactaggctgcatgtggtagctcacgcctgtaatccccacactttgggaggctgaggcagacagatagcctgagctcaggagttcgagaccagcctgggtaacttggcaaaaccctgtctctacaaaaaaaaaaaaaaaaacaaaaaccaaaaaaaacattagccaggagtggtaacgtgtgcctgtaatcgcagctactcaggaagctgaggtgggaggattgcttgagcccaggctgttgaggctgcagtaagccaagattaccccactgtactccagcctgggtgacagagtaagaccctgtctcaaaaaaaaaattttttttgaacaataaagaaatacatactaaacatttacacagttattttgggaattgcagaggggatatttgtcttctttcccatccccctttctctctctctctctgtgtgtgtgtgtgtgtgtgtgtgtgtgtgtatgtgtgtgtgtgtgtatgtatgtttaagatggttagaaatcatgaaactccaccgggcacagtggctccctcctgtaatcccagcactttgggaggccgaggcgggaggatcacttgaggtcatgatttcaagactagcttggccaccatggtgaaaccccgtctctactaaaaatacaaaaaattagctgggtgtggtagcacacacctataatcccagctactcgggaggctgaggcgggagaattgcttggacccgggaggcagaggctgcagtgagccaag

SEQ ID NO: 24094 - DNA, 1073 bp, Homo sapiens
gataacgcctactctacacctgcaagtatcattctcccaccctaccttttctcctggctgattccagcaatgtgggactggctggggggtaaggggctagcacatggtacaagaccagctcccaagagcaagtgttgagtgcaaccactatggaaaacagtatagaggttcttcaaaaaacaaaaaattaattaaaaattaaagaattatatgattcagcaatctcattactgggtatatatccaaaaaaattgtgaaatcactgtcaaagagacgatctgtacccccacattcactgcagcactattcacaatagccaagttacagaaacaacctgagtatccgtcgacagatggatggctaaaggaaatgtgggctctgcacgcaatggaatatcattcagctttttaaaagaaggagccaggcatggtggttcatgcctgtattccccagcactttgggaggttgaggcaggaagatcacttgagcccagaagttcgagaccagcctggccaacacagtgagaccccgtgtctaagaaaaatacaaaaataagctgagcatggtggcacatgcccgtagtttcggctactcgggagactgaggtgggaggatcgcttgagcccaggaggtcgaggctgcagtgagccaagatcccaccactgtactccagcttgggcaacagaacaagaccctatttcaaaaaaataaacaaggagaaggaaatcctgccgtttgtgacaacaaatggatggacctggaggacatcatgctaagtgaaataagctagtcacaggacaaatattgtatgattctgcctgtatgtgggatcgaaaatagtcaaacttaaagaacgctggttgccagggaatgggggaagagggaaatgtgttgttcggtgggtgtaaagttacagatatgagatgagtaagctctgcagctccgctgtacaacatagtgcccatggtttagagttgggcacttacaactttattaagagggtcaatctcatgttaagtgttcttaccaaacacacacacacacacacacacacacacacaaagggacacaag

SEQ ID NO: 24095 - DNA, 1026 bp, Homo sapiens
tgaaattagttctgtagccgcttgtcaaaggaataatgaggctgttggttttttagactttgggaaggtgcctgttctcatgctgctaataaagccatacctgagactgggtaatttataaagaaaaaaaggttaatgaactcacagttccacatggctggggaggcctcacagcagaagggaaaggagaagcagaggcacgtcttacatggtggcaggcaagagagcatgtgcaggggaactcccctttataaaaccatcagctctcatgagacttattcactgtcacgtgaacagcatgggaaagacctgccatcatgattcagttacctcccaccgggtcccttccatgactcgtgggaattgtgggagctacaattcgagatttaggtggggtcagagccaaaccacatgagaaggattatgtcagaatgatttgggggtgctgttttaaaatgcacatcctgggcttcacccctgtaatttccgctccagataggacagaactgggaatccacaacaacttctagggtgattctgaccacagccaggcttgagagctttgtggtgtgtactgctactcacaggactgggcagtagacatgaatgagatgatctgcctttgtcagagtccttcagagcttctgttgtgggtaaatattgggaaagccaatcctcttcaatagggttcatatgaaattttataagccatttttataagtcagaaatagttgatggttagcaattctatgcagtttcactgatagagccaggaagtgaggctggttggggcttggagttgaccatctcctgcctgctagctttgccgccttggccaaataatttggactctccaagcctccatcttgcatctccagaatggggattgtgacatctcctttgccagattcttgtaaaatgtagagtttaccgtgtacatgtcaagtgtccctggtacctcagtagctactgtttttatcctattgtgataaccattcccatcttcccccctccccccacactgcc

SEQ ID NO: 24096 - DNA, 1035 bp, Homo sapiens
aaagtctcaggcaggtctcaaagctggcaagtttaaactaagtgatatttagtctgggtgggatactgatcatgcatttttctttcttttttcttgctctaaagggcattattagggccgggtgcagtggctcatgcctgtaatcttagcactttgggaggccaaggtggcaggattgcttgaacccaggagttcaagaccagcctaggcaacaaagcgagacctcatgtctatatttaaaaataaataagtaaataaatagagggcattatcaggacagctggcagcatttgaataaagtctgtggattgagtgatagtattctaccagcggtagttttctgttctttgttccttctcctctaccactgctccacttgactagccttaaaaaataaaaagcaattaaaataaataagatggcaattttatgactaggtaaactggtattgtaagaaaatgtcttttttgggaaatacagaagtatttagacaaaaggggacatcatgtgtgcatcttactctaaaatggtttggggaaaaatgcatatagagagagagataaagtaagtgtagttaaatgttaacatttggggtatgtaggtgagtggtatgtggaagttcattttactattcttgcaacttttgtataagtctgaaattattttagtatttaaaagtttaaaaaaaaaaaggccctcctgtggctgaggtggtaggagggttagtgtgaaaagatgggagaggggctatgggatggagaggggtggggcagaaccctggaaggtgaccccctgggagtggatggctgaagacatgtgaatgaagagaggagaaggggggaataaactgaataagaaaagtcccccaaacagagcaccttcccaccgaaacaggagggattaccttcgggaaatgatgtgggcagactctaaggcattgccaagttggaattacagaattcaggagtggtggctcacacctgtaatcccagcactttggggaggccaaggcgggtggattacttgaggccagga

SEQ ID NO: 24097 - DNA, 1048 bp, Homo sapiens
aataataacatggtcatttccggagtacttgccatgtgccaggcatcattctaaacatgtatgttaactaatttaatcctcacaacagccctgtgaggtggcgatttcggtcagcatcatctcattacctccacatgcagggagggaaaatgaagtgtggagaatcgcagcaacctgcctaagggtcacatagctaacaagtggcagagcccaggaacctgcgcgaggcaccacccactctgcactgcctcccgtcacacagcaagatgggtctatctcccagaggcaccttgacttctgcactcataaaataggccacacagtagagattcagtacgcattgttgaatagctttcatctctagggcagttttctgtcttcaagacaaacagtggcctgagagctctgagaatttaggtatccagggatccaattgctttcttatttactgagagataggcatgtctctggtgagatcctgccaaacataaactcctccttattaataaatttaggaattgtctggaaccaccacgatggagactatcaacaatatgtacatcagttctctgagttgaaaggtgtgtgcacagcactgcccctgatgtctgtgactttcggtcagagacttaacctctctgatctttagatcttcactggtttaaaaagaaagagctgggtcagtattaccaacctcaacaggtcattatgaggattaaatgagacaacacatgggaagggtctcatccagtgctggctcgtagtgggatctccatgaaggtaagtctatccctgtgccttccaggaggggcaacagctatgtgggatttcataaaacgatgcattataggacctgctccctgccctcacctagcttataatttaggcaagaagagtttctgaaaccacagacatagaaatcataattccaggccacagcaggggagaccccacatggcagtgcctggtctggtctttagagcaggcatgacctatgcccgtgggcccacatcccttgtagctgtgatttggggcaggaacagtgatt

SEQ ID NO: 24098 - DNA, 1107 bp, Homo sapiens
ttcctcccggccctggaagaatgcctggtgtgtgtgcatccccctctccagttagcaattaccgaacaacttctgtggctaccaaggagagcatgatagggtcccagccctccagagcttacaatgtaagagaacaaacaggaacatgagtctttacaatacctgcagtgagcgccaacaaagtggaataaaatgtcacctgaaatacctgagaaaggggcttctcaagcttggagaaggcagaggctttggagagatgtttgatctgagccttgcaggagaccgtccaagtgtgggttctagtactacctggatgcaagccttcctccgcctgtgtcccagcaaggaagagttgccttcttaatgaccccattcattgtccctagaacgtggtgatttaccagaagtcttcagaggcaagccatcttcaattcagaaggggaatcccacatgtgtgttgaatatgaggcattgtttaagacacctcctgccctcaccacattggcaaactgacagcgtcaacttgaaacaagtctgcacattgtggccattttcactccacaacaaatgtttgtaagtggccacctaagcctgtgaacttcctaactttgataattacaaacacgaggtagataagattgaagcaaacctggcaagttatactgacttgcagctgaagcactctgagaaacagaacaatttgttcacagaaaaaggaaattaaggtgtttctacactctttaatttccaaggtctttgtttaaagtgaatgagttcaaatgagggaagacacattctgctcacgtttgatgtcactcactactcatgtcgcagcatagggtgtcacagcctgtgtcccagcttcttcccatgggcaccatgctcttcagccatacagactcggacattccactgccaaccagtatcctcaccaatgaccccaaggtgctgttgaggcacttttctttttcagagtttactgacatcctacccaccactgagtagcatgttccttgcccatgattcccttctgtactccctcccccaataccctgtataggccaagtatcccttatccaaaatgtttggggccagaagtgtttcgca

SEQ ID NO: 24099 - DNA, 1002 bp, Homo sapiens
aacccaggagtttaagaccagcatgggcagcatagtgagacctcatctctttgaaaagaaagaaagaaaaaataaggggctaaaaaatacctaaaatgtagtgccatttataagaatgtttgtaactcccaagagaatgataattgcatttggttatacaggagaatgccctggtgtttaggagatctgggctgaggtatttgagggtaaggtgttacaatgttgacaactgactttcaaatggttctgcaaaattaaaatgtgtttgtgtgaatacatacataggggagggaggtaagcaaagccaatgtgtgaacatgttaacgatgattgatctggatgaaggacagatgggtgtttattgtacttttcctataactttcctgtaaaatggaacttttcaaaataaaaaattgaagacactcattgaacctataaattgtggataatacatatgtagtgaaatatattcaatgaaaaacatgcagaggtatgacaagcagtacctttaggacaacattacttctgggagggcagataaatgaatgacagatcggatacttgagctatatcaataacactttatttctttaagaaaaaaaagaggtggggagctctagattaatatgggaaaatgataagctattcaatctggtgtccattagtgtctctacttactttctgtacttaaaaaaaaatatatatatatgtatatatattttttgagatggagtctcactgtcacccaggctggagtacagtggcgcaatgtcagctcactgcaacctcctcccaggttgaagcgattctcctgcctcagccttccgagcagcttggactacaggcacgcgcctccatgcccagctaacttttgtatttttgatagagacagggtttcaccatgttggccaggatggtctcgatctcttgacctcgttctctacccacctcagcctcccaaagtgctgggattacaggcatgagccactgcacccagcctat

SEQ ID NO: 24100 - DNA, 1046 bp, Homo sapiens
taggacagttctgtgttagggttctccagggaaacagaaccaaggtgatgtatgtatatatagcgagtgagtgagtgagtgtgaatgtgtagagggagaaagatttaagagggtaagctggcaggctggagactggcagggaagagttacagtctaagtctaaaggcagtctgctagcagagttctattcaatttaatgctcaagaataatcctctttggcaccattcattctctgtccttccagcccaccaggatgggagctgggagctgtgcccctgaggccctgggcggcagccacaccttgtgaatcccctcttggggtcattcttccctcttcttgaaagataacaaatgtttgcagccacatcactgtagcccattctgtagaagtctgacagccttccttccctttgtcctgtctttgtccattttaatccaaaagggcagtatttctgctgaggtggttggttgaatccatgcttcacagccccagtctcattatctgatcgtccagccacaccattggtgttctcttaggaacacaccttctcatttttttgcaatgaggctaggctgagaattttctaaattttcaagttctggttcctttttgcttaacaataatttacttctcacattttactacaagcagtaaggagaaaccaagccacaccttcagcactttgcttagaaataacttgtgctgaatatctaaattcatcactcacaagttctacctttcacaaaacactacaaaataactcagccatgtttcttcccactttgtaacaagaatcgcctttccactagttccaataacatgttccccatttccatctgaagcctcaccggaagcacctttaacatccatatttttggggttttgtttttgtgtgtatgtgtttgttttggttttagttttggttttggttttggttttggttttggttttaggacggagtttcactcttgtcacccaagcaggagtgcaatggcacatgatctcagctcactgcaacctccacctcctgggttcaagagattc

SEQ ID NO: 24101 - DNA, 1026 bp, Homo sapiens
taggtgtggcctgaacactgggattttttttttttttttttttttttttttgagatggggtctccctctgtcgcccaggctggagtgcagtggcacgatcttggctcactgcaagctccacttcccggattcacgccattcgcctgcctcagcctcctgagtagctgggactacaggcacccgccaccacgcccggctaattttttgtgtttttagtaaagacggggtttcaccatgttagccaggacagtctcgatctcctgaccttgtgacgtgcccgcctcggcctcccaaagtgctgggattacaggcgtgagccaccacgcctggccgagcattgggaattttaaaagctctctggatgatttcaactctgggtgaatcacactttgcagagtttgattcagtgggtcgcggtaggtcgagcctgagaatttgcattctaacaagtttccaggtgatgcttatgctgctggtctggggactgagctttgagaaccactggcatagggacattgtctgcactagtaatggtaaacacccagttttagcattgcaaattgggtcactctcagaagcaaactggagagtttcatgtcaaattattgattgctgagccagtgctggatgctctctgaaagaacatcaatagctctgccccagctttgagctgagaaacctgacgctgcttaacatgccaattctcaaaaatattcattggaatttcccttttacaactgtacatacagccaggcacggtgactcacacctgtaatcccagcactttgggaatctgaggtgggaggatcacttgagctcaggagttcgggaccagcctgggcaacatagtgcgacctcacctttactaaaaataaaaaaaattagccgggcatggtggcacatacctgcagtcccagctactcgggaggctgaggtaggaggattgcttgagcccaggaagttgaagctgcagtgagccatgatcaggccactgcactccagcctgggtgactgagaccctgtctg

SEQ ID NO: 24102 - DNA, 1028 bp, Homo sapiens
gagacaatcagcggtgtttcagtgacaggtggggattgatgagttgtgtgacacctgacatgctaacctacaaccacgtgccttcccaggaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaaggtaagacctgccctctccctccaggccagggaggcagcgtccctgcattgatggctccgtgtggtctctgaccctctctcccccagtggcacaacctgtctcgagaagaacaggccaagtactacgagctggcccggaaggagcggcagcttcactcgcagctctacccaacctggtcagcccgggacaactatgtaagtgcacactctgggcagaggacgctcagaccccaggaacagcctctgcaagaggaggaagggtgaaggaaagcaactgcatttatttttatttattttattttcttttattttttgagacagaggctcaccctgtcacccaggctggagtgcatgcagtggcgcgatctcggctcactgcaagctccgcctccccggttcacaccattctcctgtctcagcctcccgagtagctgggactacaggcacctgccaccacacccggctaattttttgtatttttagtagagacggggtttcactgtgttaaccaggatggtctcgagctcctgacctcgtgatccgcccacctcggcctcccaaagcgctgggattacaggcgtgagccaccgcgcccggccagcgactgcatttatagaggactcttaagatcagggagaagcccatacttctctagaaataaggaaggtgttttaattctcaggaggtcaacaagtcctgaggacggacttcagttgatgcatttccctttgaactggactctgccctcgatttcataacacagggcacggggttagctgt

SEQ ID NO: 24103 - DNA, 1034 bp, Homo sapiens
tggttcaaaatgcaaaaagtacagaacgatatatgtattgtgaagaaaccaccttccacccttgtccccccagccactcagtttttctgctggagacaaagctactgcttccttgggtataactgtgaaaatggtctctgcagagacaagcaaatgtgcttatgtacttttaaaaaataaaatggtaaaatagtgtatagactctgtcctttgctttttcacttaatacatcacggaaattgtcccatattgcctgtaaagtaaagcactttctcatttgtctttatggccatatagtatctcactgagtgaatgtgcttttatttatgtaaatcagcccattaatgaacatttaggtttttccagcctttccctattataaacagtatgacaaagaatcacactataaatgtaaacatgtcggttttgcacatggatgaatatatctgttagataaattactagaatgcagtatcaggccccgcatgtacaaaacatgtatgatttcattaggtactatcaagctgtagaggtggtaacagtttactctccagtgtgttatgcactctggccaatgtacatgttatcagactttttgatctttgataatctgactaatgaaacacagtagttttacatgactcttttttttttttttttttttgagatggagtcttgctctgttgcccaggctggagtgcaatgacgcgatctcggctcactgcaccctccgcctcccaggttcaaatgattctcctgcctcagcctttcgagtagctgggatcacaggtgtgcaccaccacgcccggtgtgctaaaaatacaaaaaaaatacttttttgtatttttagtagaaacagggtttcaccatgttggccaggctggtcttgaactccagacctcaggtgatccacccaccacagcctcccaaagtgctgagattacaggtgtgagccacggtgcctggtgacgtttttctgttttgcttttttttgttttgttttgttttaatgagtgaggttgaacatttgttca

SEQ ID NO: 24104 - DNA, 1029 bp, Homo sapiens
ggagatcgagaccatcctggctaacacggtgaaaccccgtctctactaaaaatacaaaaaaaattagtcgggcctggtggcaggcgcctgtagtcccagctactcggaaggctgaggcaggagaatggcgtgaacctgggaggtggagcttgcagtgagccgagatcgtgccactgtactccagcctgggtgacagagtgagactccgtctcaaaaaaaaaaaagaaaaagtggagggtgggaggagggagaggatcaggaaaaataactagtgggtactaggtcaaatacctggctgatgaaataacatgtacaacaaacccctgtgacccaagtttccctatgtaacaaacctgcacatgtacccctgaacttaaaagttaaaaaaaaaaaaagtatgacatttaaactattatctttgggggattaatatgtgcctaggagattgacccttgtctgttttacagggtgaaagattgtctgctggatattctccatcatatgacaaggacaagagtgttctggctttcagaggaatccctgtatgtatcacccacaacttggtaccttctgccagggcttttgttgtgtgttactgtgtggtgccagaactgtggtagacgctggggacacaagggtggcatagaccttagcttccaagagctcacacttgaggggagtgaggggagggtgtatggaacacaaacatacaaaacaacttctatttaataagataattgccataatgaagcaggctataaaacgcagagagaataccaaaggcacaccacagtctgaaatgagtgtatgaatttttgtttatttacattcaaggtggacatacacttgtccccaacatcacccaagttccacatcatagttaaagttttccaggtacctcaatttaaaatggacttcaaggccagtaagtggctcatgcctgtaatcccagcactttgggaggctgaggcaggcggatcacttgaggtcaggagttcaagaccagcctggccaacacagtgaaactcc

SEQ ID NO: 24105 - DNA, 1070 bp, Homo sapiens
tttgttagggacagggccttgctttgtcccccaggctggagtgcagtggtgcaatcatagaatttgtgggttcaagcagtcttcccacctcagcctcctgagtaattgtgtaccaccaggcatagctaatttttttttttaagagacaggttcaccgggcacagtggctcacgcctgtaaccccagcactttgggaggctgaagcaggcaaatcacgaggtcaggagttcaagaccagcctgaccaacatagttaaaccccgtctctagtaaaaatacaaaaattagctgggcatggtggtgcacgcctgtaatcccagctactcagcaggctgaggcaggtgaatcacttgaacctgggaggcagaggttgcagtgagccgagatcatgccactgtactgcaccctggcagcaaagcaagactccatctcaaaaaaaaaaaaaagagacaggttcttgctgtgttgctcaggctgatcctcaccttatcctcctgagtatctgggaatataagtgtgagcttctatgtgtagctaaaaaatattctaatataggaacatcatttggacatctgtgaagtttcttttaatggaattttatctttatggtgacaaacccagcattaatacattaataatttttactttaaatacatatatatatatatatatatatttttttttttttttttttttttctttccagagacagggtctcactctgttgtccaggctgaagtgtagtaatgtgattgtagctcactccagccttgaactcctgggctccagctgggactacaggtgtgcactaccatgcctagctaatttttaaaaaatttgagatggagacggtctcattatgttgcccaggctggtctcaaactcctggctcaaatgatcctcccactttggcctctcaaagtgctgggattacaggcatggtggcatgtgcctatatctctggctaactttaaaaaaaaaaaaaagtaaaaaataaatgtaggctgggcacggtggcccacgcctgtaatcccagcactttgggaaactgaggcgggcggatcacaaggt

SEQ ID NO: 24106 - DNA, 1481 bp, Homo sapiens
tcagtttactgtgcccatgatgaaatcccacaagtaacttagtggtatgagaggacaaacccaggatcttgatgagtgctgaaggttagctgttacaccagttagtagtagaccgaagttcagagcctgcagtctggcttccacattatgtttggattctgttttaggcggttatagaaaattcagaaaaacgaacttgaattagggagatatttgttctccctcctaacaatagatgacaaagcagggagacatggattcggaatacgtttgagcatcttctacactgttgagcttttgtttcctgcgcaactcctaacagcaaaatcagataattgccattttagtcagaaaatgcttttcatttaattgtttaatcgaattatcttgttgctcattataattggtgttccttaagattagggaaactggcctacctgtggcctcagttctaccagactcccaggtgcagaggggtttggtacagttgtggaagtgaatatgatatagggcaaattctgttctttaaaggatataggactaacagttcacctttctggtgattagatttataatgcaaactttgaattttaggaggaaagtgcaaacacaatgaattaagatgtattaagcatgttttttaaaatctccaaagattttacagatagtaacagggagggagcttgcatacatacatacatactttgtttaaagttaaagaaactgagccaggaatttctcttttccagataagatttgtgaccaaatcagtgatgctgtccttgatgcccaccttcagcaggatcctgatgccaaagtagcttgtggtaggttcagaatgtgcttatcaactggtggaaagatagcataaaaattatttttatagaagtgatgtttgagttgaatgtctctttttattagaaactgttgctaaaactggaatgatccttcttgctggggaaattacatccagagctgctgttgactaccagaaagtggttcgtgaagctgttaaacacattggatatgatgattcttccaaaggtgtgttttaatgattttgctcatttttttctaggtaacagctgtgaggtttgaagaaactcctagaatgttcctgctaatcctaaactccagttgtatcttactatacactaagccctattctgttcattctctaaaaggtccgatggtttaggtatatttgatttcttcagcagtgtttagaattccagataattgctgtaaacagcaggtatttctaggacgtaaacaagatgttgtgttttttgcttataggttttgactacaagacttgtaacgtgctggtagccttggagcaacagtcaccagatattgctcaaggtgttcatcttgacagaaatgaagaagacattggtgctggagaccaggtatcttggtgtagaggctgttttaatctcttctaacattaaattctggagcttgatcacattggtgac

SEQ ID NO: 24107 - DNA, 1080 bp, Homo sapiens
acacagtgaaaccctgtctctactaaaaatataaaaaagttagccaggcacctgtagtcccagctactcaggaggccgaggcaggagaatggcgtgaacccgggaggtggagcttgcagtgagctgaaatcgtgccaccacactccggccagggtaacagagtgagacttaaaaaaaaagccgtggaaatctgggtatggtagcttacacctgtaatcccagcactttgggaggctaatgcgggtggatcacctgaggtcacggtttgataccagcctggcaaactgaaaccccgtctctaccaaaaatacaaaaaagctgggtgtggtggcaggtgcttgtaatcccagctactcaggaggctggagaatcacttgaacccaggaggcagaggttgcagtgagccgagatggcgccattgcactccagcctgggccagagcaaggttccttctcaaaaaacttggaaatctgttgggaagtagggggagggcaaggttaaaacctatgcaggtgtgtcaattagacttgttccaacttgagaacctgaattttgcatgtaattgaaatgttccagaacaagtctggcagtttcataagggagtttttagatgccaatacattgcagataaccatattggctacattaggggaatgagcatggataggtgcctccaagttggtagaatagcatgagaagttttcaaaagtaaccgctttaaggttatgttcagtatttgctaagtaaacaaagattccccaaccttgagggagcttgtggaccaaggggatagtgttgtcctgcccagcctaggggaaaagtatcctgaaggttaataaggtggtggaggaacattaggccacagggagcagagggaaagcataacagcaggggatgataagggtgattatagtttagaaagcatgaaagtatgacttaaggaaatgtctttaggttgaacattctgtatataacctgcctttctaaagtttcaaaggggatggatacccatcaggggcaaagatccaaatcctgagggtagaatgaggaggatgtatactaaagtcttttggctaaaag

SEQ ID NO: 24108 - DNA, 1025 bp, Homo sapiens
ttctgctatttgggccagacccaccccttccccaagccagactgtggtctggtccttcagttttccaggtcaggtgggggcaagtgtccttcaggagtgggagcttgggaggcagagcctgtagcagctctcctgatcagcactccttcctaaagagctcaagtgccccgtgtgtcttttggaatttgaggaggaggagactgccattgagatgccttgccatcaccttttccattccagctgcattctgccctggctaagcaaggtactgcttctcttcttctagctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggtaggggctgatgcttaagtggaggggtcgtaatgggctccctgagtcctgtccccgctgccatcacttcccacctcagcaggactgggtaggcctcagaatccctggctctggctgtcttcttagtgactttgatttgtggtgagagcctcagcaatgcagacgccagaggcctgaaaacagagccagccccataatagctgcccatcccctcacccataggccttcagttttggcccctgcccagcatgccttctttccttcaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggt

SEQ ID NO: 24109 - DNA, 1092 bp, Homo sapiens
ttttccttgttcatggaagcatgaagtgagatacgttttgctgtatttgtagcactggtttcttaggccaaaggaatcaggttagtgtgatagacagtgtccaccaaggacaccttttcttgatgacctgttgcttttttttttttttttttttttaagacagagtctcaccctatcacccaggatggaatgcagtggcatgatcttggctcactgcaacctccacctcctgggttcaagtgattctcctgcctcagcctcccaagtagctgggacctacaggcacctgccaccaggcctggctaatttttgtatttttggtagagacggggttttactgtgttggccaggctggtctcaaactccttacctcaagtgatctgcccacctcggcctcccaaaatgctgggattacaggcgtaagcccctgtgcccagccaggaatgtccatatttaggttctctcagtggttgacactgtgtacctcataagtgagaatgtctagtctgtcatttctgagcaggaaggagacatcataggtgatgattagatggcttcctcttttctcatctttagtgtccactaaattccttttaaaaagatgtacagaagtgtttcagactccattgtacttcaaggggccaggcgcagtggctcatacccataatcctagcactttaggaggctgaggcgggaggatcttttgagaccaggagttagcctgggcaacacagtgggaccccattgctattaaaaaaaaaattagccagttttagtggcacacacctgtagttccagctacctgggaggctgaggggaggatcgcttgaatccagagggtcaaggctgcagtgagctgtgattacaccactgtagtccagcctgggtgacagagtgagaccctgtctcaaaaaaaaaaaaaaacaaaaaaacaacaaacaaaaaacagtgctttaaaaaaattcccaacaggaattgagtttgccatgattgacacaccaaaagtcctattaattgaatcatggccagaagaagtcatgtaccctcttctttatgactgttgctggatgatgtctagtggctgttcttcta

SEQ ID NO: 24110 - DNA, 1046 bp, Homo sapiens
acctctgcaaagtctgtcccttggagaagatgtgaaagcagatctgtcaaacgcaaggatgtccaggcttgagtgttaaagaaaacaccagtgcagcttatgatgcagcttgtacagcgtaattccacttttcgtaaaatactgtatgtgagtacgcatatgcatgggaatagcatatgggacaatagttaaccaaatgttatcagtggtttgctctccgtggagagattaaggtgattgaaacaattttctttctgttcactcttctgtattttctttttcttttttttgaggcagagcactttgggaggctgaggtgggcggatcacttgaggtcaggagttcaagactagcctggccaacatggtgaaaccccgtctctactaaaaatacaaaaattaaccgggtgtgattacatacgcttgtaatcctagctactcgggaggctgagactggagaatcatttgaacccaagaggcaaagttaccgtgagccaagatcacgccactgtactccagcctgggtggcagagtaagactctgactgaaaaataaataaataaagatgaggaaactgaccaggatggtggctcacatctgtaatcctagcactttgggaggctgaggttggaggatcgcttgagcccttaagtttgagaccagcctgggcaacaaagtgagactccgtctctacaaaagataaaaaaaaactagccaggtgtggtggcatgagcctgtggtcccaggtatacaggaggctgattggggagaatcacctgagcttgggaggctgaggtggcagtgagccttgtttgcaccactgcatttcaacctgggcaacagagcaagactctgtctaaaaaaaataaaaaataaataaaaataaaaataaaaaagatgaggaaactgaggcttggagaggttaagtatcctgctcagggccccccagctgactctggggccaagatgaaccccagtaagaatcaagagcagcattcagaggcaaacacgaagccccatttctagcccacatactggtgtacttaa

SEQ ID NO: 24111 - DNA, 1045 bp, Homo sapiens
acgcggaggtggccctttgaaataggattcgcaacgcatttattcattagagaaatacttattggttgcttgcaatattctgtagttaacaccatccgcaaagctaggaccctgctctcatgaagcttgcgttccagtgagtgtggctattagcaacactaccccaaattaaaaattatccgccattactcattttaacccaatcaggaggagcgaggagaacgtacaagatcttcccaaataaaaggcagtctctggtcgccaccgtggggactttggctaaagaagttatcaggttttcgtaaaagcagaaaagtctaaaagatctgactatgcccttttgatctgtgatagttatagcttggaacatgtatgacctatctgtgtaatttttttttcactcagtacaaacagtggcattgtgggaatatgagaggcagtaatttgtagtgaaaacttgctaaaagcctaattttaggtttagtgtttgccattcacttaattggatgataatagacagatttcctcatctgcagactagagttggtaataaccatccgaaaagtttgtgaggtataagtggggtatgtaatttacaatatgtttttatatgtactctcccttagttcccctcaagaaagagaaaccactccatctgatactgcagaaacctttgtgctgccattcaatgccagtcctccgtttcctggtagccatcgttagcatttttctactcattttctttgcctgaagcagaatctcttcctcagcatccgttctcaaaataactgtgatctctgttttaaggtcatgagaaacaaatagtgtgacttgaaagagttgatctcagaaacttgaaagagttgatctctttctgaaatgtccttaacgtagaggggtattcttgttttaaatgatacctgaaaccagatactactggaggaagtatctgtctgtgcaatcacatcttgacaattttctgaatgttactgatgccatttagtaaggggaaacacaagataatactaaccgtcacattatctgt

SEQ ID NO: 24112 - DNA, 1809 bp, Homo sapiens
atttattttttgagacggagtcttgctgtgtcgcccaggctgaagtgcagtggcacagtcccggctcactgcaagctctgcctcccaggttcatgccattctcctgtctcagcctcccgagtagctgggactacaggcgcccgccgccacgcctggctatttttttgtatttttagtagagacggggtttcgctgtgctcaccaggatggtctccatctcctgacctcctgatccacccgccttggcctcccaaagtgctgggattacagatgtgagccacagtgcccggccttttttttttttttttaagaataaaattattggccaggagcagtggctcacatctgtaatcccatcactaatcccatcactttgggagaccgagggaggctgattgcttgaggtcaggagttcgataccagcatggtgaacatggtgaaaccctgtctctaccaaaacaacaaaaacaaaaattacgaggcatggtggcacctgtagtcctacctattcaggaggctgaggcaagagaatctcttgaacctgggaggcagaagttgcagtgagccaaggtcctgccactgcattccagcctgggtgagttagtgagactctgtctcaaaaaaaaaaaaaaaaaaaaaaatttaaaataaaattatcaaatccctttatttggcaaaggaggaagctaaggttttgaaagtggccagtggctggttaggatgttaaaaccttaattaaaggcttaatttcacgccttttatctcgaaatgcagtgtttttctaccataccagtgatctttaatccctggaagggcttgttgaaatgtatgttcttaggggacgatttggctgtagtataccaacttggagaaataatgtacctgtcatgctgacaatcatgtaatgattaataatctgggtcctggagcctactggtttgttttaatagccaagcaactagctttatgatcttagggaagttactttacctcttgatacttctgtttcctgacttataaattgggggttaattatagcaccaaacctcaaggttgcagtggaattattaacaaatgaattaagtatacgtaagatttaggatagagtctgggacaaaggaaattcttggtacattgtattttgttactgctactactgtattgttgatttcattgacatgaaattttctctgttggcaactcaagagtagagtttgtagtctggtagatacactgaaactttggtaaatgcatcagaaatggaactttctgcttggttgtattttttattaaccaaaaacttttaatttcgtctgtggggaaaagtctaaaataattaagtctttttttctgccacagtatctgtatggatattgatcctccttaagtcgattattacaagtacgcagaattgttcttctattgtggatattaaactacatctaaaaatggaactactaggctggacatagtggctcatgcctgtaatcccagcagtttgggaggtcaaggcgggtggatcctgtgagctcgggactttgagatcagtctgggcaacatggtgaaaccctgtctctacaaaaaaacacaaaaattagctgagcgtggtagtatgcgcctgtagtcccagctacttgggaggctgaggtgaggctcacttgatcctgggaggtggaggtggaggttgcggtgagccaggatcgcaccactgtactccacagagtgagaccctgtcccccccgccacacacaaaaaaattaaatataaaataaagatggagctactaaagatagtgttgggtctaatgtg

SEQ ID NO: 24113 - DNA, 1090 bp, Homo sapiens
ctcttgaggcagcaggctacagagccaacactgacctctgcaatgccaaccaagcctgtattgctctacgtcagcctcatcccagaccttggtttataaataaagacaagatttattcttgtaagaagtcttgccaggtgcagtggctcatacttgtaatcccagcactttgggaggccgaggcgggtggatcatgaggtcaggagatcgagaccatcctggctaacatggtgaaatcccgtccctactaaaaaaaatacaaaaaattagctgggcgtggtggcacgcgcctgtagtcccagctactccggaggctgaggcaggagaattccttgaacccaggaggtggaggttgcagtgagccaagaccacgccactgcattccaacctgggcgagagagcgagactctgtcttaaaaaaaaaaaaaaaaagaagtcttagtttgcttgggtgagtgttaggcattaactatatgttgtttatcttgctttcaccctaattatgacagtttatctgtatggatcaagccagatgtagtctctgagcaaataggctgtgttgtttggttttcctctttctgtctgaggaccaggccatacagggaactggcttcatcttgtctccacgctgtcacttgttgctttgagagtcaacttggcctttcatctgatttgcacttaagaaattaactgtataggtgtaagcgtaactgggcttcctctttgccttctgctggatctatgtttcctttatttttctgagttccctttgcctttctgattttgagtagtctgactgggaaatgcattccattgccttaacttttatttcttttgatgattattcatttcaggaagaggaaaatgatgagacatctaggaggaaagctggtcatcagtttggagttacatggcggtatgtcacacgtaattagaaccttgaattacagtgtcttacagtgcatggaatatgccccatcaccctgtgaagatgttttcttgtgatgttctaaaataattgatttttattgtgcaatataaatttcactatttgtattcatacacatttagaccgtttttcaataaggtc

SEQ ID NO: 24114 - DNA, 1145 bp, Homo sapiens
tgcaagtgggaggctgttgatgtcccttcatacctcacctctggtttcaggcaacatgccaatgatctaataggacatgttaattgagcacttaggaattaaagcagtggtaaaactgccagatttgaaagactagtttgtgtcctttaagggtttttttttttttttttttgcaacactgtaaaatccacatatctttttcctctaccccctctcattttacattttcaaattgttatagcagggtgagccctgaagatttcctttcacctcccttgcttttgtattcaaagatgaagatactggaacctagagatactccctaaatgggtttgcttttaggcagataagaacatgaatttaagaaggcagcatgttaacagatgtgtgagaattgttttctgtgtatccaaatccttgtttcacattgaatgtttttaaaatgaatttgaaattcagtatctattcaccatgacctaagagtatacagaggaaacagttagaaatgaccagttgagggtagggtgtttaattgagaagtcagcacacactggcagctcttaaaccaaatattggctcgtttaacttgaaactgtaagtattttgaaattctttgtaacatataatatgctataatttcaacccttatttcccctgttgttagacatagggactttagactaaacatactttttgccttcatcacagttccaagttcttcgatttgatttgtctaatggaacaaattgatgttaccttgaagtggtatgaggacctgataccttcagtaagatggttcattacttgttatttatcattctagatgaattgggtttctgcagattaatgctttaaaaatgtgtttctcttaatcaggcctactttccccactcccaaacaatgatacatcttctccaagcattggatgtggccaatcggctagaagtgattcctaaaatttggaaaggtcagttttactttttatgtgtccaggtgcatctcacctcaatatcctctactttgataatgaatgtgctaacattactgttagggatgaaaacttccattttgactgaaccaaatgtgttagttgagatgtacttcaaggtcatgtgctcatgttgcatgttggctatcaggagaaa

SEQ ID NO: 24115 - DNA, 1085 bp, Homo sapiens
gcacattaactaaacttggccttgaccacaacccgtccttgattggtgccactgtgttctggttatgtttttatcagcacttcattcacatactaatttttagtgtttgtgaatgggaaccttatgcatattcatgtttccaaaaatgagcaaaaggatcttttgtaggggtagtgacaggtggttttcctgtattttgttttgtatataaatgtgtgttctaaaagtcattagtggggggtgcttgtgcatggctccttgtacaagaaagtagctttatttgaacatctgattgctagtcagctatctccaggaaaagatgatgaaggcttgtctttgaggtgtggctcacacgtgtctctctagcaactatgctgctagtgacagagacgtatgacatttgcatttggttgttagcgcaggcagtttggcacacacttgatacaaccaggctgtgatgattggcgcaggggtacggacctcagctgagtcatgggagctgaatgtatgtgtttctcctttgtcctgcatgtggcaggctgatggggagcacttacatgagactgttgcctcaatctgagcctgcacttcataacagaattctaagacagactgaacccctgctgtactttaagagagggaaacagcaggttctgttctatgcctcttttccagctgtgcacaggatggattccctccttagaaggacagtggtgatcctctacaagaggacaaatacagttggagtatcccttttccaaaatgcttaagaccagaagtgtatggggttttagattttggagcatttttggattaggaatattcaacctgtaccagcaaatcttgacattggcagcatatcagatttacctgtgaaaactgcagtgtagattcgtttggggagtttaagcacctgcggtgattctcatgtacacacagggctgggagctagtagagcccacagatgtgtgtctttgggagcttacagtatagttaagaaaagggcatttagtctctgatttcagagagaagacagctatagtgtctgattgccttgtttttctaatagtattcataatcttttt

SEQ ID NO: 24116 - DNA, 1083 bp, Homo sapiens
cttgtcctcaagcgatccacccgcctcagcctcccaaattgctgggattataggtgttagccactgtgctcagccacaaattgtcagctttagaaagtaaattatctgtactgcaaacctaaacataataattagattaaattatattctaatatcttgtatttaagagcttatacattaatttttctcagaaaaatatccaaatagaatttaaaataccttttcatactgacatacatcgcgattctctggaagattttacttagaaaacctcaatatcttcttgcaagacaaagtaacaagttaatattactgtaaatgatttcttgaatagaaactatgattacaggcatcctgataatttactgggatttcaaaacttctctgggaaattacctcagttataaaaatctaagcagtaccatgccatctataggaggaagatacacatgtcaaatattactgtctgcattcctgaaatcccctttaccaactctccttaaagctctgaagattccaaatgactagaatatatattttaaaaacacatctgatcatgaacacacaggtacaccattatgtaaaaagaagcagttttgtagacatacaaggagatttccaaatcttcgacatcctcagagtacattaaaaggaaaggagagtctcttaatcctgtcaggaagaggggtgtggctgaagggagtccaggtcctcacctgctcaaattcagacttcaattcctgttcttgtaccctaaggacatctcgcaagtgatcagtgtgggcagctgcctgtcggcgaagctgggttctcatttcattttccatggcatctctgacttcttctatctgtgaaaccaaacatagtagttattagttttcaattctccacatatacttttaggaaaacagaaagaccactatcaaccatgacaacagcagcttccatatcctgaacgcctctaatgtgccaggcatgtgtacacttctacttctcatgtgaaacggaaaactaaaccctggaaggtgattcaaacaagatcacacagctgtggcaaaaaccagatttcaaacaaaggtctct

SEQ ID NO: 24117 - DNA, 1081 bp, Homo sapiens
aaggattaggaaactcaaaaaacacccaaaaccaaccatcacaccttctggagaacattaaggtactatttaaccaaaattgagttgactgaaatagtgtaatatatgatcagataatttagtgcctaaaaatagttgaaactatgccaaaactttgccagtgattaaattcttatttttcagatatatctgtatatgctagctagtcttttcaaggctgtcaagtaaatttctgagaaaagcattcatgagtagagtacatataaatatattcgaaattgtcaggttttaaaaacctgctggccaggcacagtggctcatgcctgtaatcccagcactttaggaggccaaggcaggcagattacttgaggccaagagttggacaccagccttaacatagcaaaatcctgtctctactaaaaacacgaaaaactagccgagcatggtggtacatgcctgtaatcccagctactcgggaggctgagccctgagaattgctagaaccctggaggcagaggttgcaatgaaccaagatggcgctgctgcactctagcctgggtgataatagtgagactgtctcaaaaacaaaaaacaaaacagaaaacctattagtggaagttgtaatcaaactttagaagttaatgactagaagatgaagaaactttggagattcttcaagtttagatttggtggtaaggcaagacgattgagaaaggtatatgacttaaaaatttaaggtatataacttaaaaatttaagcacatgtgaggagcctggtgaaatgggtgaattggtttcacctggttcagccttagactagttgtcttgagtttctcctttcttttttatggtgggaagtttatttttgtgaatggtataaactgttaagaagttgattcaatacttcctttttttgaagattaagttacctgaaaagggaactgggacaggtgtcccaactttgcccacaggcctgtcataacttgatattttttgcagcttgggatgacttctgtgacttgatgagccacataagagcaagaactgtcctcaacttttattgcattgcaaaggcttatct

SEQ ID NO: 24118 - DNA, 1131 bp, Homo sapiens
atatatgtgtatatatgtgtgtatatatgtatatatgtgtgtatgtgtatatatgtgtatatgtgtatgtgtgtatatatgtatatatgtgtgtgtgtatatgtgtatatatgtatatatatgtgtgtatatatatatattttcaaaatcattttctttaaattcttctatcctgagtgaagaaaaaagcagccctatcttttttgttcatatagaaatgaacagtgttggtatagttgaacttgagatataattcactttctcagaaatctaggtactttcaggttggactaactctaatcataaacagaagagttgatttcaattcctattctcctcctcccttttcattttatctaagttaaaagattgctgatgagctgaattaaatgcacagggaatttagatcattatatctgtgctcgtaactttcagattcaggcttatttaacgaagtaagagttttttaggtactagtttgccccattcatccctttgtaaattgcaaaagcacgtcataaagcatgtgggtagcatttagagctgtaatactgttaacgtatgttaacatatgcatatattaatatattctgaataacgcctggcccagaataagctgttagtagagggtaactctgtttcccttcctctcgagaattttcttcttaaacagtgtgttacaatgcatattcatttgtatgtgtatgaattttgaagacactgaaatggttatgctttgtacaggtctttgtgtttctattcacttgatttcatgttgttatggctcctctgctatgaaaaatataactagattggatgagagagtggtttaagttgcaaaggcattttagggaagggataatttttttttctttcttttgttctttgtaatatgattagagcttttttttttaacccactacatttttgtaacagtctagaagtcattgactttatgacttagctgtttttttcatttttgacttctttaaaggggaaagtacctttgcctaatgctgcgtagtagaagccagtgtagtagaaaccagaagaaactcatatcttggtaaaagaatatcataatttaacttttttcctgatgtttagagtgaagattgaggctgtcattag

SEQ ID NO: 24119 - DNA, 1106 bp, Homo sapiens
tattagggaattggtacttaggaattaaatactgagttttatatatattgtgaccactgtctgctcagtcattataattttataaaatatatttgagaaacggatgggtttttgacggtaaacagtgaaagccatttccgactgatttgtgtattcatgatacggcatgatacggcctgtttagatcgcacactttcataatgatgttgtatcaaagttatttactcctcttctgcctcagcttctagatttagtatgtcctggatttctccttccaagtcagaacatcctctccggatggacacacccttggatgtgtgcttttttgcttttggttcttgtttggatcctttcttcccaattaagaacaggatgccaaagcttttctttgcttaaaaaatatgaaaagaaaaagtatagtaagacagaagatgttaattatagatggtatttctcttcattagccacctcttggctggtttgcagtgctgtggattttctggacagccatgcaaatgagcttggttacctagcaacagaagctggaactaatgctagctctgatgcaacagtgagtaagaacctgcagttataacaaaaggagtttgacagtgtattgcatttcctcaacctctatatattttataatcttagctttaatttttaatgcatgtgaccagaaaataagctatggaagtttacttatctacctcagtagtttatactggaaaatcagaatggtagaagggagctcagaagtgtccagaaaacaatcgaatgcattgcttattcatgcttcttttccaagagcagcaaataagttacgagcttgaatgtagttagattttgagtgtaagggtgtttgacttttcttacctatgtagtagtgaccatagtaagccttaagaaaatagagatacacatagggcattgttgtaaaactttgtagcaaacccaaagaaaattgtttaaatattagactctttttgtaattttctagttgatgaatatttacttttaatatgtatattaaggaaagaattgaagggattattttgtttgatctgagcaagtactgtcagatggtagcttattaaaattctgac

SEQ ID NO: 24120 - DNA, 1033 bp, Homo sapiens
ctgggattcagtccctgattcatatgtcttcacactccgttctaagccaccatgtgctgttgcatttttgtttggaaacatgaaggaccgaaagaattagtttaaaatcagtctgtaaaccaaacctctaatctaagccttttctattttaaacaattcagataaatgataactcggtttttctctgtaccttacagggattttgtgtatgtgtccatgtaatttcctgcagtaaactgtcattgaggattgtttgcttttaagtaacaaaagacccacaattacagtggcttaagcaaaagtgaaatttttttcttgcacagaaatcggtagtaagacgtccacagcatgtttggtagctctgcattgtgaaactcttagggacttagcaccttgtacctctgttattcccagggtgtctcctgtcttcagagtccaggatagcagccaaagctccagccatacctttgtatcccagaaaggggcagagtgcatatttatgtttcattggtcagaacttaacgtcttacaaagccatacccagctttattccatttgcttatgtaccctgctgaaatttggggattctactatggaaaagaggggaagaatgtactagggggcagtcatcagtctctactatagggaattatctttaatggcttgccccatattttacaatctagaatatacttttaccactagctccttaccctgattactgctaacaaaagttctttctttctttctttttccaggaatctggtctttctgtagacccaagtcagaaggaaccatttgtggagttaaatagaatattagaggcattaaaggtcagagttctgagacctgctctggagtgagtattgagtttgctttcttttgagtactttgagaactctctgtaagaaaactcaatcagaaaacacattagagatttttagatatatttatcttacctgtggtagacttcagagaaatcaaaggagaattattttatttattttggctaagtgaaatatggggggtgtgc

SEQ ID NO: 24121 - DNA, 1388 bp, Homo sapiens
atttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagcgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatat

SEQ ID NO: 24122 - DNA, 1049 bp, Homo sapiens
ccggccaggccgaggccgaggccgaggccgccgccgccgccgcccggccaggccgaggccgccgccgccgccgcccggccaggccgaggccgaggccgccgccgccgccgccgccgccgcacattaaccttttaagttaaagattaagagaaccaacacctctttacagtgaaatgccccaactaaatactaccgtatggcccaccataattgcccccatacttcttacactattcctcatcactcagctaaaaatattaaatacaaattaccatctacccccctcaccaaagcccataaaaataaaaaactatagtaaaccctgagaaccaaagtgaacgaaaatctgttcgcttcattcattgcccccacaatcctaggtctgcccgccgcagtactgatcattctatttccccctctattgatccccacctccaaatacctcatcaacaaccgactaattaccacccaacaatgactaatccaactaacctcaaaacaaatgatagccatacacaacactaaagggcgaacctgatctcttatactagtatccttaatcatttttattgccacaactaatcttctcgggctcctacgccgaggccgccgccgccgccgccgccgcccggccaggccgaggccgaggccgccgccgccgccgccgccgccgcccggccaggccgaggccgaggccgaggccgccgtcgccgccgccgccgcccggccgaggccgaggccgaggccgccgcccggccgaggccgaggccgaggccgccgcccggccaggtcgaggccgccgcccggccaggtcgaggccgccgcccggccaggtcgaggccgccgcccggccaggtcgaggccgtcggtctcttcgagatccactcacctttccaggcgacggggcggagccctgcaccgaggcgaggtaccgctccccgtaggctttgctgcgcctcatcgcaccgccaacctggctcccgagacgcgtgaaaccagcgctcagccccgcagcagtcgccaattccaacaggaaagcgcctgaaagc

SEQ ID NO: 24123 - DNA, 1049 bp, Homo sapiens; identical to SEQ ID NO: 24122

SEQ ID NO: 24124 - DNA, 1045 bp, Homo sapiens
cgtgccctcctcagcttctagaccctcccattcatgccatgtccagatgacatctccctgaacacaatgctccctctcagacacatttggatggaattatgcctggcctgaatgggaaccttgtctgctttctaggtttctcccagacaggggtaatgtttctagagtccatttactaggagcagcatgatgggactggggatgtccctttaaaaattaaaagttaagtttctctttaagtgccaggattgagtggatttgggattcctgtatttaaccttagttcccaaactgagatttttgtcttactcctgtgttcctttgcttctttcctgcagaggctgcctgacccaggagaagattgtggctggctatgctagtcgcttcatcgtgatcgctgatttcaggtacagtttctggtgtctgagctgccaactgaggaggtagattggatccccaagccgcatccccatttttgtgaaagaggaaatggagagctgcagggactgtctgactttctgagactgatggctaggacttagtacagtgtctaggagaccttatgttctgcttgtaggctgaaggtagatgttgctaatcacagcactgttatccgcagccaggatctctagcatcgtttcatgtgttcagtggaacggggaaacagcttgtcaccctgttagcagagcatgctctcatgtgtcatgtcactcactggatcctcacagggagcctcagaggaggcagggtgtgccctgcccacgggcagtgactcagcataccctgcttcttctcgggtcagggtttgccgcaggtgactggtgtcattgatagtctttgaccaggctctcagatgctccttcaaggaatgtagtcaaaagcacttgtgctgagcatgttaatttcaaatatgtgtatgtgtatatttacttgtgaaatatagccacaggacgagcataaatattaaacacctacatacccacaagccagcaatatcagattttaacatttttgtcatatttatttcaaatagctcttttcctat

SEQ ID NO: 24125 - DNA, 1054 bp, Homo sapiens
aggtggcaagaagaaattaagataatcagaatctcttttcattgctctgtgggagaaaaaggctttagatttgtcattcgtccaatgctgtgtatgacagttgcttctagtgaccctgcagtctttgagtctctttttgctttgggaggctgaaacaatgtttctttctgtcctttgtcctgcaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttg

SEQ ID NO: 24126 - DNA, 1044 bp, Homo sapiens
gattctcctgcctcagcctcctgagtagctgggattataggcacatgacatcatgcccggctaatttttgtattttcagtagagatggggtttcaccatgctagtcaggctggtctcgaactcctgaccttgtgatccacctgcttcagcttcccaaagtgctgtgattacaggcatgagccaccacacccagcctatacactatttttgatgtggtttgtatatcttcttgcatgagtggattcagaaacttcttgacagggccaaactgcaggatacaagcaatgtagacatagcagtagcctacctaggaatgaaaaaaatgaatagttttattaaattttattctacaactgtctatctaagctgattaattttaaacagtttctctgatgagaaataaattatatatttattggaagtgtcctcacaactttgtacttcctaaataataggaaaaatagttggacatgataaatgcttgtagtataatggtgtaattggatctgaagtattgcattaaagataggccatagcatcctcccatcagctttgacacttactctctcaggatcatgatttgctattctttataaggatcatttttcttattatcagtcaacatgtttacattggaatagacacactcttctattttagttatagttagttgagacataacctcacttctgaaaccttaaatacatattttataaaacctgtattaaataaacccgtttatctgaggaaagatagccagaatcaaggaagacttcacatagctgtctgagtcttaaattatgaaagaaatttgtcagaatagttgaaaatattttagatataaagaagagactgcacattgatgaaaatgtaaacagtagcagtcattttggaaatgattaataatgaacagcaggctcaatgtgctgttataaaggtactattgtgaagtaaagaacagtgtgctgttactttttctgtttctattggatttttacattttgttttatttccgatggttttgttcattgatgttgggtggat

SEQ ID NO: 24127 - DNA, 1047 bp, Homo sapiens
gtttgccatttggttgtttttatgttttggtcctattgttcaacaagaaaaaggaaaataacatttgcacaaaacaattgtacaagtcattttacatgaaaattcaaattatagttaccaattgacttttacttacagaaaaagaagtttagagtagtataaagttttgataatatgggaatataactgtaagtaaatgtgttggttaagctctatagaagtggttcatcctttgagaatgtcaataaatgctccaggaagaacttttttatttaggaagataaaagataaataaactaaaatactaaaatatgaactaaaaacaaaagtgtgaaacaactaaaaagtggaaaggaatagattagtaagtggagagggaggcaatttgatggggatatttgaaaaaattggaggatacatggattgagagaaagaaaatccaggttggaggaaaactttaaaaacacttgaaaaccacatagaaaacacgcaagaaaaatatgaaagaaaatataaaaccacaactgagaactataactgaaattataatcatttttcacaatataataatatatgtttttacaaacccttggaataaagttttttaaaatttgaatttatttatatagagaatgataatacacaaccttacaacaaaatatataatttaaaaatcctacctatttgatttgaaagacttgtagaaattaacaaaattattacataggtttgatttctcatattttttacttaacattaaactcagttattttctaacagttttgtacatcaaaagtccaggcagactccaccggtttttttacttgggaactcacagggtgatactgaagatatggctaacgttacgtttttatctggaaactaggggaaaagtcacctctaagctcattcaggttgttggaagaattcagtttcttgtggttgtagcactgaggctcacatttcctctggatgtccacttgggattgcacaagctgctagaagacaccctttggttcttgcatgtggcccctttctgtcttcaaa

SEQ ID NO: 24128 - DNA, 1030 bp, Homo sapiens
ttagatcatgcacatttaaagtaattattgggctggtaaaaaagttgggctggtatttattatgtttataactattttctattcatatcatttattctttgcctcccaacaatcactctttttcttatttctattgttttaattgacacttaaaataatcccattacatttcctctcctagcatgtcagttatactttagaacagttttagtgatttatgtgagtttgcaatacacatttttaactaatctcaatctacctttaaataagactttgaataactcaacacaaatatcactttacaagagtgttacagactcaatatttgtattcccctattcccccaaaatgtgtatgttgaaacctaatccctatggtaagagtatttggagatgggtctgtgggaagtgattaggtcatgagggcaaactgttatggatagaattagtgcctttacaaaagaaaccctagagagctaatttgctcttctgccgtgtgaaatcccagtgactggaccgtcctctgtgaacaagcccttgccagacacttaatatgcacatggcttgaccttggacttcccagtctcagaactgaaaactgcatttttgttgattataagccacctagtgtatggtatcctgttataaaagcctgagcaaactaagatacaagtaatcccaattcctaccattatttatgacactactgccatttattgtattcatttatatactatattcattcaatacattgttacagttattccttttaaacaaaatattatcttttaggtcaattaagaataagaaaataaaacattttattttagtttcattcattccttctatgatattcttcctttctttatatagaccagtttctgacctataccctttttcttctccctaggaacttcttcgaacattccttgcaaggcatgtctactgaccataaactttctcagtttttgtttgtctgagaaggtctttatttcttctacactattgcaggataattctattagatatag

SEQ ID NO: 24129 - DNA, 1055 bp, Homo sapiens
attccacctgtgctgcttttttttaagagtggctccccaccccgcattgagtataaaggctttgattttcatcagtgttgtgtcatttattcatttttattgctgagtagttttccatgttaggtaccacaatattcttagccattaacccactgaagcacatttaggttgtttataatttttagtgattatgaataaaactattagaaacattaggtttttgtatgaacataaatattcatctctgtagggtaaatattggagtgaaatggttaggtcatatggtgagtgtatgtttacctttgtaacacagggccaaccttttccagaatgattaattttgttttcccaccagcaacgtatgaagatgtggttgctccataatttgccaacaccaggtattctcattgtttttattttatccattctagtagatgtgtagtggtatctcaatgtggcttcaatttgcatttccttagtgactaatgatgttgagcatcttttcgtgtgcttattgtccatctgtgtatctttgatgaagtgttcaaatcttttgccattttaaaagaattctattgtttgttttcctagtttagttttgtagtttgtggcttgtctttttattctcttttattcaatttttatttcagtgtcttttataaagcaaaggttttaaatgttaatgaagtccagtttttccctctatggaccatactttggtgtcatatttaagaaccccatccctaactaatgtttaggaaatttttcttctagtagcttaatgataatgtttttcacttacatccattttaggtaatttttatataaggtgttaaataaaggcccagctcattgtttttacatgtggttatccagatgtttcagcatcatttgtggaaaacatagtgtttctccattgaattgcctttgcccttttgtcaacaattgattgatcatagttaagcgggtctgtttctcagttttctgttctattccattgatctatgtgtccatccctttgccaaagccacacattgtcttgattactgtagctt

SEQ ID NO: 24130 - DNA, 1050 bp, Homo sapiens
ctactgttgatagataattgaattgtttccagtttgggggctctcatgaatataagtgctatgaacattcctagtaagcatatgcatttctcttgggtacatatacctaggagtagaattcctgagtcatagagcagacagatgtttagctttagaagataatgtcaaatggttttgactttaccagtttacagcacctctgtcagctaggcatgagttccagtttgtcaacactttgtacttttagtctgttacattttaaccatctggcttatgtgcagtggtctcttcatactggtttaaattttcatttttctgtggtatatatatatatataccatggaataaaaggaatgaaataatggcattcacagcaacctggatggagttggggaccattactctaagcgaagtaactcaggaatggaaaaccaaacattgtatgttctcacttataagtgggagctaagcgatgaggatgcaaagacataagaatgatataatggattttgaggactcagggggaaagggtgggaaggagataagggataaaagactacacattgggtacagtgtacactgctcgtgtgatgggtgcaccagaacctcagaaattaccactaaggtacttatccatgtaaccaaacactacctgttccctccaaaatttgaaatataaataaataaaataaattttcatttttctgagtattactaatgttgatcactttttcaagtatttattggatattggttatattctctttaaaagtgactgaatcttttatccatttaaaaaaattcagtgtttttaagttgctttgcggaagttctttatctgtattcttaatgcaagtcctctggtagctgtctgcattgggaacattgtctcccagcactcagcgatggtgagacgggaagtggcagacccccgcgctggctcctccgtcgccgcctctgggtgcctccctgcttccgatgggatggaggtttcaggctcactttgttctttccttgcaccaaatctggaatcagccaaggatccttggt

SEQ ID NO: 24131 - DNA, 1072 bp, Homo sapiens
ttgttgaggatgagaactttctaaaacaatcctttcagatataaaaatccaaatcttccaaggtacacctactttaattatgactcaaagccaataagcctttttaggcttaacattagttagcctttcttggactacctatagaggcagagacatccccaaagagtgtgcaaaggatgtggaactccccaatcaaagactgtccccatgagagcctaggaaagcagagaccctcattgttaacaaggcaaggaaggctgagacggcaatgacccctgtggactgtgaccccgattttaggatgagcttccccaagagcttctggactgctagccacaggctggcgcctgatggaagcctgaccacttgcgtccctatctgacagagaccagagaatatttttgctggttacaaagcaaaactcttaggacatgaaacaagatgaaaggagaatctcttcttaggattttccccctgtgacaaatcacactttcaaaggtcagagacaagaaaacgaagactctttagggaggctgtggatcaatgaccagtgggtacccagaaccaaattcacaagtgttgcaattaaaatatctaattcttacaaatgttttcctccttccaatccaaatttggaaaggaagggacaaggaaaaaccttggcctgtgttggaaataagagttcggagtcgcaaagaaaatgagcactcaaaggatttctcagtgaggcaaatttacttcttttctttttttattatactttaagttttagggtacatgtgcacaatgtgcaggtttgttacatatgtatacatgtgccatgttggtgtgctgcagccattaactcatcatttaatattaggtatatctcctaatgctatccctcccccctccccccaccacacagcaggccccagtgtgtgatgttccctttcccgtgtccatgtgttctcattgttcaattcccacctatgagtgagaacatgcggtgtttggttttttgtccttgtgagagtttgctgagaatgatggtttccagcttcatccatgtccctacaaaggacatgaactc

SEQ ID NO: 24132 - DNA, 1037 bp, Homo sapiens
ttctggagtggaaatcagacaaccctttctctgctttggacccttcgatagctctcatgcccacatgtgccttggctcaccttagactccatgcccgggtgcccttgaccccagttcacctgctgtcactggacctgagtcttggaatattatctctttttctctgattctcctgcccactctgtgcccaacaggtgtaaacatcagggaatgctggggcctgggacaatctgcaggaggcaggctctgcctagagacattaaaattaaagcccacgccagtactccataaactcaccctaggaaacatagctgggaggatcctacccagcctgcattccagagcacctcccatgcacaggcactgttccagggctgggtacggcagcgaggagacccgaatccctgctgcggtcaccctgtagagggagagaccaacaatataccagatgtcttagtcttctctggctgccataacaaaataacacagactgaaggacttaaacaacagaaatgtattttctcccagctctggaaagaaagtctgagaagagggtgccagcagggtcagtttctggtgagggctgtcttcctggtgtgctgacggctgccttcttgctctgtcttcatgtggccttttgctgcatgcacgtggaggcagacatagctgtctctcctacccttttttttttctttttttttttgagatggagtcttgctctgtcacccaggctggagcgcagtggtgtgatctcagctcactgcaagctccgcctcctgggttcaagcgattctcctgcctcagcctcccgagtagctgggattacaggcatgcaccactatgcccggctaattttgtatttttagtagagacagggtttctccatgttggtcaggccggtctcgaactcccgacctcaggtgatccgcccacctcggcctcccaaagtgctgggattacaggcatgagccaccacacccggcctctcttactcttcatataaggctaccaatcttatgggataagggcccaacctt

SEQ ID NO: 24133 - DNA, 1044 bp, Homo sapiens
aagatggggctgaagctagattttcttgcttgcattacaagcttctgaaccaaggacttcaatgtcacctggacttggattcacatcccagctccttcccttcctagctttaagactgtgtaaccttgggcaaatcccttaaccgctttaagccttaactgtttcatctgtaaaatgggactaacagtacctaccttccacaagcgtcaagaattaaatcaggcctggcgcggtggctcacgcctgtaataccaacaatttgggaggccgaggcaggcggatcacaaggtcaggagatcgagaccgtcctggctaacacagtgaaacaccgtctctactaaaaatacaaaaattagctgggcgtggcggcgtgcacctgtagtctcagctgctggggaggctgaggcaggagaatggcgtgaacccgggaagcagagcttgcagtgagccaagatcgtgccactgcattccagcctgggcgacagagcgagactccatctcaaaaaaaaaaaaaaagaattaaatcggacattgtaggtagagcacttaatagttggcattcagcggcagcagttactgttatgttagcatgtggagtgtctgagtgtgtgcactttggctcgaacagccttttgacagtggcacagttggtgcttgtgtaagatagcagggcagagaagtcaaaaccctcggttttctagtcaaactggtgggccacaacagtggtgacctaagtctaatgagtctttcactgaacaaggcagattgaatctccaggcgaggaccaagagtctggggctcagctgcctcaacatttttgggcatagaaggctgtacaatacaaacagcctttgttgtaagagcaaggaaccattcagggaaggcaccatgtggtaaggaatagtggccagaattggattcagaacaaaacaagagaatagtgtttgtctttaagtggagccttggactcaaaataggacctgagctctgtggataatttcttttttttttttttttttggagttgctctgttgcccaggctgg

SEQ ID NO: 24134 - DNA, 1093 bp, Homo sapiens
cacagtcagatggagtgataaataaaggcagaggtaactggctcattccagcttgtactgactcttctctgctttagttccaggacttcttcctgtattacgagcctaatgaccagcaagggcctcacacccacagaggcaacagcttctcaaacttctctatgactttccaactccttgtcctcaactcaaggagtcagttggccttcacttgggttctctcttcctatgctgcaaaagggaaactctccaggcagtcaaggggtaatcatagattcactgccacaattatgctgtgaaacattacattaccatcattctgaaaagttccctgtgccccttcgcagccagtccctttccccaacccctggcctttgacagccataatctgctttctatcactatagttttgtcttttctagaatttcatatgaatgaaatcatatagtatgttgtatctggcttctttccattagtgtaatggttttgagattcatctattttgttgtatcagtagtttgtagcttactatcccattgtatgaatatactgacatttgtttatccatttgatggacatttggattgtttccaggttgggctgctatgaatatttgcatgcaactctttcaggtaaatacctagaaaaggaattgctaggttttatggtgtttcactttttttttttttgagacggagtcttgctctgttgcccaggctggagtgcagtggcagtgtttcaccttttaagaaattgctaacctgcttccaaagtagttttatcattttgtattcccaccagcagtgtataagagttctgattattctgcatccttgccagtactccatattgtcagtttttaaattttatttagagacggagtttcgcttttgttgccgaggctggagtgcaatggtgcgatctcggctcactgcaacctcctcctcctgagttcaagtgattctcctgcctcagcctcccaagtagctgggattacaggtgcccgccaccacgcccagctaattttttgtatttttagtagagatgaggcttcaccatgttggccaggctggtctcgaactcctgacctcag

SEQ ID NO: 24135 - DNA, 1041 bp, Homo sapiens
actttatgatggctgggcccagtggctcatggcctgtaatcccagcactttgggaggctgaggcaggtggatcacttgaggtctggagtttgagaccagcctgtccaatgtgataaaaccctgtctctactgaaaatacaaaaattagccgggcatggtggcacatgcctgtagtcccagctactcaggaggctgaggcaggagaatcgcttgaacctgggagggggaggttgcagtcagccaagattgtgccactgcactccagcctgggcgacacagcaagactccatctcaaaaaaaaaaaaaaaaaaacaactttatgacatgggaaactgcttatgccaagtgaggaaagtgcagttcataattgcatgtcgttttttaggataatcatagtaggggaaagaactagattgcagcatctgaagatataagtgggtgatatttgtgactccttattagttaaggaaacattttaataagaggtttttagctgaggcctgaagttagggaagagaacaggccaggaactatggaacaggtctctctggcctaattagtcaggtatacccactgatgtcactttccttccaggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacat

SEQ ID NO: 24136 - DNA, 1047 bp, Homo sapiens
gagttattactggccacaagccctgtattctcaacagggatgcaaattggttcttcagtaaggataaaaaaaaatcacaagcagttgtttgtggccctcctaaggcccacagcacatatagtgtgtctgtgatattccattttcatggcagggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatatt

SEQ ID NO: 24137 - DNA, 1026 bp, Homo sapiens
aatgtattaacaatataagagtgcattaagttttcggagtctacattgcctttaagaaactatgacttgtagtaagccgggcgcggtggctcacgcctgtaatcccaacactttgggaggccaaggtgggtggatcacaaggtcaggagttcaagaccagcctggccaatatggtgaaagtccgtctctactaaaattacaaaaattagccgggcgtggtggcagatcccttgtagtcccagctactcgggaggctgaggcaggagaatagcttgaacccgggaggtggaggttgcagtgagtcgagatcgtgccactggactccagcctgggtgacagagcgagactccatttcaaaaaaaaaaaaaaaaaaaaaaaatcacttgtagtcttggtgtggtatcaaagaatagccacaattagctgaaaaggctattttaaaaacttttccaactgcgtatctgtgtgaagtcaacttacttcaacaaaaaagtttggatgtagaagcagctgtaagaattcaactgtttattataacaagatactaaagagactgtaaaatgccacccttctccttggattgttttggaagttattcttcataaaaaatgttaacgtgggctgggcatggtggctcatgcctgtaatcccagcactctgggaggctgaggtgggcggatcacttgagctcaggaattcaaggtcagcctgggcaacatggctaaactctgtctctattaagaaaaaaaatgttaacattatgatttaaaagtgcattaaccttaatctagataataaaagctttttggggcaacctccagaactgtgaaaaataaatttgttatttaaaaagaaaaaaaaaaaaacaaaaacctgagtttcttagtttttagtagtgtaaagaggtcctaagaccaaatcatttgaaaactgctaccctgaggaaactgcccttcagaatcatctttcaattttgtgtgcatttaatctaaagaacagaaggtaagaatttgaagacagtcggaa

SEQ ID NO: 24138 - DNA, 1050 bp, Homo sapiens
gtcaaagacttcgtggtgttggggacaagaaggggtgagctggaaatgtaggaggtggttgccagagaggggccctagaattgaggatatagagaggttgcagtcatggttaatgagtcaactcagagcaggcaagggagcaaatggcggaggcggggtaggggtcttactaggctgtcttggtgtcttacttggctgtcttggagtcctgggtttcttaggatggagaccattgaaggagaggatatcaaccaagagacagtgtactggatggatcaacatatggatattgaaatcaataagagctacaccaggaataaatttggagactagtaatgagccataaactaatactaagatcttctgagaagaaggacaggttgtgacctggggattggaagatgactgcaacacagatgggcagacagtggcaaaagctgatgttgtactcagagctggggcattagaaattgggaggggggatagttggatgctgcaatcacctggcccacctgtaggccactggtttgacggctgtgaagagaaagcagccactgcagaggcccgcaggggaagcctatcctcaggctggcaccatgtctcaattggagcagtgcccctcagcctgttttttttttttttttatcacttttgccccttcagacccatttagacattttgtgcctactccttccccttaaaatgaaatactaaggaataagattttgtcagatagggtagagatttggataggcaaacattattgtaatatctaagatttttcccacctagcctctaggaaacagttttcaccccttgagagtgaaatgagaacaccattgagaatacataaattagaacaagtaggtggagataatcctcaggaactaagtgggcgatagagagaattttgctgatgactgagtctagagggccctgaggaaataccagtttttgaggaggagtgggagatgggggctgtggtggggtgggaggtggcatcagagttctatagatcttagagtccaagaaatgtagaattgtgggtgt

SEQ ID NO: 24139 - DNA, 1033 bp, Homo sapiens
tggttcacaactgtagtcccagtactttgggaggccaaggtgggtggatcacttaaggtcaggagttcaagaccagcctggctaatatgatgaaaccccgtctctactaaaaatacaaaaattagccagatgtagtggtgcgtacctgtagtcccactactctggaggctgaggcccaagaatcgcttgagcctgggaggcagaggttgcagtgagccaatatcatgccactgcactccagcctgggcggcagagcaagactccatctcaaaaaaaaaaaaaaaaaacaaaaacaaaccacttttgaccatgagtggagatatttcagtccagtgtatatacctgctaatgagtggggccaaatgcatgagaatttatctttcccttggctacatgccgtaaatcttcagtttcttctctctctgtgttcagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaaggtaagtacaagtgatgcctttcaccagagcatttcagtcattggggaatttttttacataaccatggggtacaataagcccatcatgctcttatgttgcttaaattacccagaagtttcctctggaatgccaaattgtgtatccttttgggagtgccttgcaacccactaacttttgtcttctctgcggcgtggagtctaaaacggtaaaccatcgcctcttggtcttgatgtgcccggtaccttaggtgcccactgtttgcagtcagctctccaagtcacatttgggagacctgggttcctcctggagtgtcagtttgttcttgggaaggggacttagagagacctttgcctagccagagaggctttgtttttatttgctccccatccagggggccctgaggagaagaga

SEQ ID NO: 24140 - DNA, 1011 bp, Homo sapiens
accagcgtcctttctgacatgttggagccctttaggagaaagcttgtaccttgtggaaagagtgaaaaatggctgggcacggtataatcctgacacgcctgtaatcctagcactttgggaggctgaggcaggaggattgcttgaggctaggagttcaagaccaacctgaccaacatagtgagaccccatctctattttttaaaaatgtagaaagagtgaaaaaccaaactgaaactgccatgctgcactgaccacttagacactttacacacggcaaagaataaagctggatgacctaacagattataaggggagcccccaaagcgttagaggaactaaataattagacaaacatgttttttcacttttagtaggaactatagcggtatcttttggagccctcatttacagaaggatggtgacgaatgagggatttgtcatcttgtgtggcaagaagcatgtgtgtggaaagaccccgaggctgggattaagggacttgtgtccagctcccagctccggcattttactagctgtagattcttacccaaaggaattctcttttttttttgagacggagtctcactctgtcacccaggctggagtgcagtggcgcgatctcggctcactgcaagctccacctcctgggttcacgccattctcctgcctcagcctccggagtagctgggactacaggcgcccgccaccacgcccggctaattttttgtatttttagtagagacggcgtttcactgtgttagccagggtggtctcgatctcctgaccttgtgatccgcccgccttggcctcccaaagtgctgggattacaagcgtgagccaccgcgcccagccaaaagaattctctttacttttgtcatcttgtctctcaaattaggtagactagcattttatggtgcactttgaaacttccagagtacttgtatagatatgattatattgttataaaattaagggaaggaaaagtacttgagaagtaaaaggaattattaataa

SEQ ID NO: 24141 - DNA, 1070 bp, Homo sapiens
tactgctttcgctcatcagccccagcctgaaggtcagagtgcttctctgggtggtgtgtctccacagaaacctgacttgagagagcggcttcatggccctcacttgtttcttaaggagtcaggccaggccaacactgctaagaaatattagtgactctgcggcttcactgaggtcgtgctgctccgactccagctctgcacccctgctctcagtggcagtgcaggcatgttcattttgctgtgatcaagtctctttttaagggtcccagagctcttggtgtttgaagaatggtgggtggctacagcccatgacttgttgggctgagcaccgaggccattactggggcctggctttgggctgtttgagaaaactgggcttgtaacattagccacaacagttactgttataatctacagggatctgtgataactcaacacttagagccaccaagagaaatattctcaacgcttcacagcagaacttgacctcctcttggacttctttctctccatctttcactcccgtctggagtctgttcctccaccactgtgataacagtctcccctcacatagccaggcagtgtgtggggcttaggagccagtgatggacgtgaggccctctgccttcatgtctctgcatgttagcagtgtgcaactaccagaacctgagctgcagaaaacccgcgaggtgtgacttgagcgttctgtctttagtggcaaggaaaggtgcgagtgactgttgagccctggcacatcccatctgcctccagtgcagagccagggcaggctggttgtggtgaagttcgtcaggaaaggtctcatagctgcttagtcctgagggaaacactgcctggggttggggaagagctgggaggtaggtagggaaaggcctgtgcagagactggcaggaggtcactgctgtcaggaactaatggagagatggggcagtggggtagttgaggggtgcctggaggaggtgcgcgtggatggggttaatacagtagtcccctagtttccatggatggggcattggggcagttgggggtgcctggaggaggcatgcatggtt

SEQ ID NO: 24142 - DNA, 1030 bp, Homo sapiens
cttggaccttaaatcagactctgaggatggggccggagcattatgctcctccaggtgattctgatgggccctgtctaaccactgtatttttctgaagcccaaggtgcagcgacttgccaagggtcacatagcaagtctgtgacttaagaagccccagtcacaccaaggaagacatggagagggtctgtcgatgctgaggctctggggcagcaggaatgaggggaggggatgtgtgagctgagggtagcaggcagtgggagaagagccagtggaggaggtgcttctggacctggaagacttcaggaattcacggatagctagcaaagaactcaaggatcttcctctcccatttcatagcagggaagactgaagcacagagtcacagaggacttggttggaaaggcatcagtctgctgggtcacttgttagtacccaggatttctggagactggtgggtcagaggctagcccaagagggtggccctggtctctttctctttgacaagccttaggactggtttctctccaggcttacttggactcttcatgaaggccttgcaaatgttgataaccacagcagccactggaccagaatcagactttgttttgaatcctggtcccccagggaggcaagcaacttacccataaccattctggcttcagattccccctctttaaaatggaattcctccgggactgagggagagaatgtacaggcacaccttgctctatcatgctttgctttattgtacttcacaaatacagcattttttactcattgaaggtttgtggcaacccagcatcgagcaagtctatcgatgccattttttaacagcacgtgctcactttgtgtctcggtgtcacattttggtgattcttacaacatttcaaactttttcattattatatctgttatggtgatctgtgatcagtgatctttgatgttcctattgtcattgttttggggtaccatgaaccccacccacaaagacagtgaactaaatcgataaatgttgtgtgtgctcctcctc

SEQ ID NO: 24143 - DNA, 1043 bp, Homo sapiens
ggatactttaccagctttgatgttaattctccttcccttgtctcctgtagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctcttt

SEQ ID NO: 24144 - DNA, 1011 bp, Homo sapiens
tttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactattcatgtacaggtttctgtgtcaggattagttttcgaggagtgtaaatgcttggtcatagggttgttgcatgtttcgttttttaaacaatcaaactttttttttttttttttgagacggagtctcactcttttgcccaggctggagtgcagt

SEQ ID NO: 24145 - DNA, 1042 bp, Homo sapiens
gtttccctgaatcctccacagcacttagtggtgtccacatgtttttacttcagccgttctgacaggtgtgtcgtgatgcctcacggtggtttttcatttgcatttcccagtggtggacacctgtgtttcgcttcagtggaatattcctgtctttcacccattttctgattggattgtttcttctgttgagttttgagagttctttgagattcctttatgggatttttggtttccattggtctgtagcttatctttttcacccctccccctcccccccttttttttttcctgagacagagtctcactttgtcacccatggtggagtgcagtggcacaatcttggctcactgtatacttgacttctggactcaagcagttctccctcttcagctccccatgtagatgggactatcaccacacccagctaattttttttttttttttttttgagatgtagtttcactcttgttgcccaggctggagttcaatggcgtggtctcggctcactgcaacctccgcctcccagttcaagtgattctactgcctcagcctcccgagtagctgggattacaggcatgtgccaccacgcctggctaattttgtattttcagtagagatggggtttctccatgttggtcaggctggtctcaaactcctgacctcagatgatctgcccgcctcagcctaccaaagtgctggaattataggcatgagccaccatgcccagcctatgcccagctaattttttatagagatggggtttcaccatgttgcccacacctggtctcaaactcatgagctcaagtgatctgcctgcctcaacctcccaaagtactacaattacaggtgtgagccaccgtgcccggccatcttttcaccctcttaacagggttttatacagagcaaaagttttcagttttgataaagtccactttactgatatttcctttatggactgttgcttttagtgttgcatttaagaacaactctacctagtcttagatcccaaaggttatctgttttttcctaaaagaagttttat

SEQ ID NO: 24146 - DNA, 1043 bp, Homo sapiens
ggactccgggtatggccacgggggaatcacactcacccgatctttctgaagtgtcccccgaagactccgggcgggctgggctggggagagggactcccgaccgtgcagttgcaggaacgaccgcgggcgagccacgtcgaggcgagtatccaggggaggcacgctgggggaaccgaggcgtcttttggggcggaccagaggggtctgccgtttggcccccaattctgcctctttctaggccccgaggaccactggtccctgccctcaagtctggaaagggcttcaccagccaggaagacccttcaatcaacagaaagggcctgctcctgcttctcacgctttgggcaaagcgcctatccccagaaaatgactcctcgtgccactggaaggctgattaacaagtggcatgagccctactgttcagatgaaaggggctgtggggagccacgctgcagaaccaccgccaccttcagaaccaccagcctccgcccacagccactcctagaagcaacttgtagctctggcctcatgggcggtgcagcgtctttcctgccagctggtcctctgagctgggcaggtggttagaagaggtggtcctcatggaggacaccccacgggcacctggagacagatgctacctcctggctaggggcaaaaggcagaggtgaaggggcttgacgtcctgaggtttggaggtaactttaagccagggtgcagtcctggaggggaggaacacttcaggctgcgtcagcagatctggattataaatcagtccgacagcagcttttgttctgggttaaaacttggcatctgaaaagtggagaccagaaaagtggtggagataattgagaaaagcagcccagtttggtttcagtaacaatcgggtctttgctggtacacataatggccccttctcccttgctggccaaagccacgtttcccagctcttttccactaggaaaaagaaaaaaagctgtggccttggagatgctggagataatgaccatggggtgggcagggaaggcctcctgcttcagctgaca

SEQ ID NO: 24147 - DNA, 1729 bp, Homo sapiens
tatggcagctaaatattccccattttcctatagacacaatcagaggtgcataaaatttcagaatgttaagaaatcctagagactaaacaaagtatcctctagtgcttgaatccttgcttaacatcctgatcaagtggttgttcaggtggagaacctgaaactcaaagagagaaaattatttggatacagtaaatcagagaaatgagaattgcactcaggtttcttagttcaaaacgcagtcttcttttacatcattctgtcattgagtgattttagttttagaaagagggagtggctctagtgaacacagtggaagaggatgagaattgaatgagctgttgaacctaatgaaagtgaataagaatggaatttgcagggggcagccaaatttgaagagaaacaaactcttagtttgatagaaatgaggattttagggaaaaatctgaatatttggtttaatgcaagtttgataaagataagggaaatgataacacaggatgttgggagctatcaagaaaggcatattagaatatggcgttcaaggagttctgaagagtttgctgcctttttgtttgtttaactggaggaactaacaaacttcaaggttttattgaaaaatgttaaaagaatttgagccactggaaagagtctccagaggagataggaatgtggtatcatcttcttccatcccagcttacagagggcttagaatccctcaagaaccagggagctggagattgcttaagtacatagatctgtgatccagggtggatgtctctttttttctgactcttttctcaattctctcatgtacatgtagggtgggacaaatgtaggattggccggcaaaccagcaatgaagcttcatttgggtagttggtaacatgcgtatgcttggggtggatgactgagactaacttactttccagaagcagaggaatagagagctcctactctcaattatgttagcccatcttttgagaaatctgggctttcctaggctgaagatgtagattggagattgccacagatccctgcagaagagggatccagaagtgggagcccataggaaggaagatatttagatagggatgaatgaaatggagctataagtacttaggagggagacttttccagcagtctctctcttgggtatctgagtgtctatgaaggttcttaagcttgctggtttttgtggatctgaataaggcagaatctatataatgacgataattggattttaaaatttttaatgttttaatcttctgtgaagaatattcccaataacaatctaacaacatatacatttgtactttgacttttgtacactcagctttcaaacatttgcagtgtttcagggggctccctgtagtgttctagggtgaaaagaatcaatgggccctctttaagtagcttacatgctgaagatccaagactcccattttccagtgacacagattagtctttgaatcagaaatagataatggagaagagaccgtgccttttctaccttgttttaggttatcaggtttactgcagttcagtaacaaaagttgtgtcagatatcaactggattttcagtttagtctttagggtagataatttataaggacaaattattgtctggctgtgccattataatgcctgtcactatttgttatgggtttaagggtgagtctgcattggatatttcataggttgggagaagtggcagcagaaataggtaact

SEQ ID NO: 24148 - DNA, 1376 bp, Homo sapiens
gactgcatgttttatagaatctatattgtgatttttcatgtgtatattcctgtcatgtttgtttgctaaccaaaacaagagcaaagcaacccaaagcctaatgggtaacaatttcaagggcaagcacgaagatttcagctggatacaaacactgcatgattgatggtaggctgtgtcatatttacctgtagtcaattatgtgttccttttgctttgtagtgtctcctgagcaaccgcctttattcacggtaaacatattttctttaattattaacaaaatgctctgtgatatatacatgatatgttaatcattatgttgtcaaacccattcagcatacggtgaaagacagagatcacatttcaactagattcttaggaggtatggattcactaacttccagtgaaggtaaatttgccgctacaaatttcgttctagaaaatgtagatgaaaatattgaaaatgctcatagttttttgattcccactttttatccaagtgagatggaaggatttgatgtaaatatgctgatgttcttgttaatatctttgtttataaaatgatttttaaggcataaggcggacattttacacggtgagctctagcccaaatgcttttcctttaaagttgtcatcagctaaagatcccagttttgaattcctgtgcatgttagggatttgaggaggtgtattttgacactaaatattttcagtgcttcaaaattgattgcaatactcttctgtcttcttcatctagagaaaagctatacctgctgactttacaattgttttagaacttcaacgcctttatttcagcgttgttacattgagaatcttaatcacatcttctgattaccggattgagtttctgcatgtgtgtgtgtgtgtatctctgattaaaaatgaataaaatgattaatcattcttttgtaactctttggtagatacagtgttttaaaacaatgattctgagctgttttggccttagaatattttcttctactactatttattgcctacaggtaaccaacagcctgaattaacgtttttacttttaagtcactgcaatgcacattaaaaatactttacaagatacttgcactttcataggtaatatgtggaatctgtttccaagtatcaagtcttctatacgatttcacacagtgtacataatagctgcaactcggcttttgtaatcagtggaatatatttcagatctgtccaggttgacacagtttggtcatctttgatttgttttatgactgcaccacatatttgatttgttttatgactgcaccacaattaattaaaatctcttcatgctgatacaaaatgaacataaatatgatgacataccaacatagatttgcttatgtggt

SEQ ID NO: 24149 - DNA, 1069 bp, Homo sapiens
cagtctatcactgatgggcattcgggttggttccaagtctttgctattgtgaatagtgctgcaatagacatacatgtgcatgtgtctttatagtagaatgatttttaatctttggggtatgtattcagtaatgggattgctgggtcaaatggtgtttcttgttctagatccttgaggaatcaccacactgtcttccacagtggttgaaataattgacactcccaccaacaatataaaagcgttcctatttctccacatcctctccagcatctgttgtttcctgagtttttaatgatcaccattctaactggcataagatggtatctcattgtggttttgatttgcatttctctaatgatcagtgatcatgagcctttttttcatgtgtttactggctgaataaatgtcttcttttgagcatatccttcacccactttttgatgaggttgtttgttcttttctcataaatttgtttaagttccttttagattctggatattagccttttgtcagatggagagattgcgaacattttctcctgttctgtaggttgcttgttcactctgatcatagtattggaagttctggccagggcaatcagacaagaggaaaaaataaagggtattcaaataggaagaaaggaagtcaaattgtctctgcagataacatgattgtatatttaggaaaccaaattgtctcagccccaaatctccttcagctgataagcaacatcagcaaagtctcaggatacaaaatcagtgtgcaaaaatcacaagcattcctatacaccgataaaagacaaatagcaaaatcgtgagtgaacgcccattcacaattgctacaaagagaataaaatacctaggaatacaactcacaagggatgagaaagacctcttcagggagaactacaaaccactgctcaaggatataagagaggacacaaacaaatggaagaacattccatgctcatggataggaagaatcaatatcatgaaaatggccatactgcccaaagtaatttataggttcaatgctatagactaccattgactttcttcacagaattaga

SEQ ID NO: 24150 - DNA, 1095 bp, Homo sapiens
atggttattttcagtgaatattggactgatatccaaatgtaaaagcttattaatatctaatgccaggagccattgcattttgtataaatatgtgtaatttattgtactttttgatgaggtttatatattataccttcctgccattagtggatgaagaaaattactgaaggctaaactagaggatacaagaaatgtaggcagattattccaccacatgtgtatgataaataatgaatactatctactaggattcaccaaccatatatccaagctgatcaatttagatcccttccacttaagagacgtgaagtgtacattcatctgaagtgtcattgtaattgtgtaccttctcagttatcaggcaagttagagcatgatgaatgtttgtagtatagtagtgtaaatccttttgataccttgcatgaaagacatggaggatgatgtagcacctgctttgacattgattctcaggtgtatgagttgctcctctgattttagatcacttttgtcctcatcattcagcatattcacattgatagtaacactgtttcattttagttttagacatatgaaaaatcataccatgattgacattgtaagggtttattttgtgaaacctgtatttcttttttttcagtgtatttctggtcatgttccagtccccagacacaaaaatcaaagcctatactaatacaggcaggagcatacagcttgatgctaacacttcatgaatgtatagataactttatcatatttacatatgagtgattatgtatcccttttgcttttcagtgtcttctcagaaacaaccagcctcaaaggtaattaaactctcatttatattttgtattagtaactgtatagtccatgaaacatactttctttattgataatttgcttcaaattactttcaggctacaagtgacaagacagattctgctttgaatatagctacagaaataaaggatggactacagtgtgggacaggtaattttgcaaaacacatttaatgtcatgttcagtccagatagaaaagaacttctcttccctgaataaatcagcggggggctcgtcaaagctgcacattctgattca

SEQ ID NO: 24151 - DNA, 1848 bp, Homo sapiens
gaaaacttgttgtaataacccgtacacactgtaggagaactaaggagacccctgttgtagcaatcattttgccaaagaagacggattgtgaggcaggaaggtgtgaaaagaggaagtcatttgtataattttggggtttctgctgaggaaacctgagtgaactcacttcagatgcatttggaatattttaataaaaaatacttgattttggctgctgcaggaactgctggaagaaggaaaccattctgggattggcataaaaacacactgactcattactctcctttgttactgttagacatcagagatatatgttttgttgattttagttatagaaatgagacaagcttaaatctgaatacattagtttccttgttcaaggagctacctcttggatacaacagctatttcatgaaacttctttagcgaatgacatgatactcccaacaagcctattttagaaagaaaaattatgctgcattgtaattaactcctaaactggtcattttcaatgagtattgctgtgatttctgaatgaaaaactgatcaatatctaatgcttgtagctgttttactttgtataggtatgtcaaaattgataattgatgatatttttattgaggctaagatactatcctttggtgccaagactggatgaagaaaatttcggaaggctaaagtagtggatacaaaaaacttaggcagattattactccatatcggggtgagagataatgagtattatctactagatatctgcaaacatatatccaaggtgatcaatttaggacccttccactgaagggatgtgaagtgtacttcaactgaattgtcatcgtaattgtgtgccttctcagttattgggcaagttaaagaggatgatgaatgtttgtagtataatggtgtaaatccttttgatttgttgcatgaaagacatgtgggtacatgtagcacctgctttgacattgattctcaggtgcatgagttgcccctctgattttagatcactttgtcctcatcactcggcatatccacgttgatagtgacacggttttattttagtttttggcatatgacaaatcataccatgtttgaaattctaagactatatttcatggagcctgtattcccttttctcagcgtatttctgtcacgttctagtccccagacacaaagtagaagccatcaaagcgtacactaatacaggcaggaggacagaggttgatgctaacactgtatgaatgtatggataattttgtcgtttttacatatgagtgattatgaatcccttttacttttcagtgtcttctgagaaaccaccaggcttgaaggtaatgaaactgtcatttatattgtgacctagtaaatgcatagtctatgaaacatactttattaatttattatttcatttcaaattccattcaggcttcaagtgccgagaaagattctgttttgaatatagccagaggaaaaaaggatggagaaaaaactaagagaggtaattttgaaaagagatttaatgtcatgttcagtgcagatagataagaagttctcttccctgaataaatcagcggggggctcgttgaagctgcacattctgattcagcagtcctgagattcttcatttcaaataagttcttgggtgatgctgatgctgctggtctggaacatgatcttcgcagtaagattatacacttccccacattgaaattgggaagaagaaatatggagagcagttcaaggcataaggggctccggggaacaacataattttgctttaattctccagcttgttttcagtaagggtggaaggagaaagagaggaagtatagaatttacacacttcag

SEQ ID NO: 24152 - DNA, 1090 bp, Homo sapiens
atgtgagtgattatgtatcccttttgcttttcagtgtcttctcggaaaaaaccatccttggaggtaatgaaactctcattcatattgtgagctagtaaacgtatagcctatgaaacataccttatttattactttgtttcaaattccattcaggccacaagtgatgagaaggattctttttcgaatataaccagagaaaaaaaggatggagaaatatctaggaaaggtaattttgcgaaacacatttaatgtcatgttcagtccagataagaagttctcttccccgaataaatcagtcgggggctggttgaagctgcacgttctgattcaccaagcttgagattcttcttttctaacaagttcttgggttatgctgatgctgcttgtctgcagcatgatcttcgctgtaagattatacgcatccccacattacaattgggaggaagaaacatggagagcagttgaagacataaggggctctggggcccagcataattttgctttaattctgtagcatcttttcattaagggtgtaaggagaaagagaggaagtacagattttacagacgtcacatcatagtgctaaaaacagacagaaaactgttcattataacccgtagacactgtagaaggagaactgagaagacccctgatgtagcaattattttctgaatgaagacggattgtgaggcaggaaggtgggaaaagaggaagtcatttatataattttgtggttactgctgaggaaacctgagtgaactcacttcagatgcatttggaatatttgcataaacaatatttgactttggcagctccagcaactgctggaagcaggaaacagtgtttgaattggcataaaaacacaataactcattactcctctttgttactactaggcatcagagatacatcttttgttgattttagttatagaaatgagataaacttgaatatgaatatgttggtttccttgttcaaggagctacctcttggataaaatagctgtttaatgaaacttctatagaaaataacatgatactgcctacaagggtattctagaaacaaaaattatgttgcattccaattaagt

SEQ ID NO: 24153 - DNA, 1050 bp, Homo sapiens
agaaggctattttagaaacaaaaattatgctggattctaattaactcctaaaatgctcattttcaatgggtattgcagtgatttctgaatgaaaaactgatcaatatctaatgcttgtagcagtttcactttgtatgtgtatgtcaaatttgataattgatgatatttttattgaggctaatatattatcccttcgtgccacgactggatgaagaaacttttggaaggctaaactagtggatacaagaaacttaggcagattattacaccatatgggggtgagagataatgaatattatctactaggtatcagcaaacagatatccaaggtgatgaatgtaggacacttccactgaagagatgtgaagtgtacgttcaactgaattgtcatggtaattgtgtgccttctcagttattgggcaagttaaagagcatgatgaatgtttgtagtataatggtgtaaatcctttttatttcctgtatgaaagacatgtgggatcatgtagcacctgctttgacattgattctgacgtgtatgagttgctcctctgattttagatcactttgtcctcatcactcggcatatccacattgatattgacacggttttattttagtttttcacatatgacaaatcataccatgtttgaaattctaagactatatttcatggagcctgtattgcttttctcagcgtatttctgtcacgttctaatccccagaccaaaattagaagccatcaaagcatacgctaatacaggcaggaggacagaggctgatgctaacactgcatgaatgtatggataattttgtcatttttacatatgagtgattaggaatcccttttacttttcagtgtcttctgagaaaccaccaggcttgaaggtaatgaaactgtcgtttatattgtgaactagtaaatgtatagtctacgaaacatactttattaatttattatttcatttcaaattccattcaggctacaagtgatgagaaagattctgttttgaatatagccagaggaaaaaaggatggagaaaaaactaggac

SEQ ID NO: 24154 - DNA, 1034 bp, Homo sapiens
gattctcaggtgtatgagttgctcctctgattttagatcactttgtcctcatcactcggcatatccacgttgatattgacacggttttattttagtttttcacatatgacaaatcataccatgtttgaaattctaagactatatttcatggagcctgtattccattttctcagcgtatttctgtcatgttctagtccccagacacaaagtagaagccatcaaagcctacgctaatacaggcaggaggacagaggttgatgctaacactgtatgaatgtatggataattttgtcatttttacacatgagtgattatgaatcccttttacttttcagtgtcttctgagaaaccatcaggcttgaaggtaatgaaactgtcatttatattgtgaactagtaaatgtatagtctatgaaacatactttattaatttattatttcatttgaaattccattcaggctacaagtgccgagaaagattctgttttgaatatagccagaggaaaaaagtatggagaaaaaactaagagaggtaattttgaaaagagatttaatgtcatgttcagtgcagatagataagaagttctcttccctgaataaatcagcggggggctcgttgaagctgcacattctgattcagcagtcctgagattcttcatttcaaataagttcttgggtgatgctgatgctgctggtctggaacatgatcttcgcagtaagattatacacttccccacattgaaattgggaagaagaattatggagagcagttcaaggcataaggggctctggggaacaacataattttgctttaattctccagcttgttttcagtaagggtggaaggagaaagagaggaagtatagaatttacacacttcagctcgtactgccaagaaaagacagaaagcttgttgtaacaacccgtagacactgtgggagaactaaggagacccctggtgtagcaacagttttcctaaggaagacggattgtgaggcaggaaggtgtgaaaagaggaagtcatttatataattt

SEQ ID NO: 24155 - DNA, 1114 bp, Homo sapiens
tctcatttatattttgaactattaactgtatagtatatgaaatatactttatttattgactgttttgtttcaaattctattcaggctatctgtgacaaggaagattctgttccgaatatggccacggaaaaaaaggatgaacaaatatctgggacaggtaattttgcaaacacatttaatatgatgttcggtcagggtagaagagaacttctcttcaccaaataaaacagcggggggttcgtcaagccttcatgttctgcttcagtattcctgagattattcatttgtaataagttctcgggtgaccctgatgctgtggtccttggccatgatggaagtactaagattatagatgtctgtactttgaaattgggaaaaagaaccatctgacagcaattcaacacataacaggctcaggggacagcatcattttgctttaattctacagcatgtttccatcaagagggaaaagagaaagagatgaagtaatagatattagaggcgtcagattgtattgtgataaacagagggaaaagtgatcctaataccacaaaaacactgtagaatgagaactagcaagagcagtgatgtagcaattattttcctcaaggaatagggattgtgagtcaggaaggagggaaaagtagttatttatgtaatttgggatttctgctgaggaaacctcagtgaactcacttcaatacatttggaacatttgcataaaagaagatttgattttggctgctccaggaactactagaagcaggaaactatgctagaattgggataaaccacagtgactcattactcctctttaggagtaatttactattaggcatcagagatacatgttttgttgatttcagttataaaactgagataaacgaatatgaatacattggcttcaaagttcaaggagctaagtcttggataaaatagctattgaatgaaacttctttagagaatagcatgatactccaaagaagactttttagaaacaaaaaatatgttgaattctaattaactcctaaagtggtcctttcaatgaatatttgattgatttctgaatgtaaaacttattaatatctaatgcttgtagcagttttactttgta

SEQ ID NO: 24156 - DNA, 1009 bp, Homo sapiens
atagtctatgaatatatactttatgtattgattattttgtttcaaatcccattcaggctacaagtgtcaagaaagattctgtttcgaatatagccacagaaataaaggatggacaaatacgtgggacaggtattttggaatacacctttaatgtaatgttcgatcaaatagaagagaaattcacttccctaaataaatcagcggggggttcattgaagttttatgtttggattcagcatgcctgagattcttcatttgtaataagtcctcaggtgaccctgatggtgctggtccttgaccatgatctgagtagtaagattgtagacttccctacattgaaattgggaagaagagccataggagagcggttcagcacataacagcctcaggggacagcatcattttgctttaattctacagcaagtttccatcaagaggggaaggagaaagagatgaagtaatagatattataggcgtcagatcatattgttataaacagagggaaaagtgatcctaatacctcaaaaacagcatagaatgagaacgaacaagatcactgaagtagtaattattttccgcaaggaagagggattgtgaggcaggaaggagagaaaagaagaagttatttatgtaattttggggtttctgttgaggaaagctgagtgaactcacttcagataaatttggaatatttgcataaaagaatattaaattttggcttctccaagaactactggaagcaggaaacaatgctagaattgggataaagcacactgactcgttactcctctttgttactgttaggcatcagagatacatgttttgttgattttagttataaaaatgagataaacttgaatatgaatacattggcttcattgttcaaggagctaactcttgggtaaaatagctattggatgaaacttctttagagaatagcatgatactcccaacaagactattatagaaacaaaaagtatgtggaattctaattaactcctaaagtggt

SEQ ID NO: 24157 - DNA, 1049 bp, Homo sapiens
aacaagacaaactagggtaaaaaaaacctttaaaattcatcacaaataagttaaagcagagttttggtgaaatttgtgaaaattacaaaactgcttgtattgaggaagagcaactacataataactctacaggaagaacaaacttaagtaaaaaccttctaatttgacaaatgattcacctgattgtcaggaaagtgatgcatctggcatgtctgtctctgtagtagtccagatatttcctgaacaaaaataacccagtctcaaaaatgcctttctttctcattcatactctgggtccccagaatatgcttgccagtcaccttcagagctttatttaaatacaaataaagtagactgtgaaaacgacaacaaaccagatactgaacatgtttttaactcagacaaggaaaatttttataatgatactgaaagtacaaaagcaagaaacccagaagtagttatggatgaaataaaagaagacaaataggttgtgaggcaaatgacaaaaaaacaaaacaccgctaattggaaattaaacatcggacatatgcctcaatttagtgattcaaaaagccttttaggtatgtggcttacctgctccaaagaaatgaagcatgtgatttaaaaaaaaaaaaaaagatgatggtgtttctgttgttacaaacagtacaaaaccaatacagaatgtgttccagaagccgttatgtgacaactgtagtgcaaataaatatgaaagcataaaacttgaattagaaaatgtgcattattctccaccacatggtgacagaacatcagcagtatgtctagaagtggaattaagtgatatatgcaaagatttaagaatgaggtaagcatattacaagtaaagtagagttcctggctttggagaaagttcaacttccaaaagacttagagggtcacttgctgctactctggtttttctcttcaccaattatttgatccatttgaatttttttacttatgaaaatctcttgtgtaaaatggggtaatctaaatacctaattgtatgtataaatagattgtttttg

SEQ ID NO: 24158 - DNA, 1102 bp, Homo sapiens
tgatcttagctagatcttctggataacttgctgcagcttctctatcagcactggctgctttaccttgcacttttatgttatgaagattcttttcttaaacctcatgaaccaacctctgctagctttaaacttgtcttctgcagcctcctcacctgtgtcagacttcatagaattaaagaatgttagggcttagctctggattcagctttggcttagcgaaatgttgtggctcatttgattttctatccagaccactaaaactgtcttcacatcagcaataataccattgtacttatcatttgtgcattcactggagtagtctgtttaatttcctttaagaacttttttttttttgcattcacagcttagtttactgtttgatgtaagttgcctagctttcagcctatctgagctttcaacatgcttttctcaccctattaatcatttctagctttgtatttaaatactggcatcatgggggctaatgtggcttacaaagtacaattcatctggcagatggaaccatagtttgacactaccagtcttatgtcgggttcaacccagtaataaatccaagcctacccattcttcccggaaggagcttgattatgcattgaatcaagctcccagaaggagcttgattatgcattgaaattccacaacctccgtggttagtgcccaaggaactgttttcttaagaactctgctctgtgagtcgacaggattttgtatttttgaatgtatttagaccatagaaaacaaagaagtaagcatacaatgggcccacattcagaagctatctcctcaggatcagaggctgcatccagagtgtgcataggtgtttgtcacagatcctctaccaagcttaatggagagagagtgggagataaatgtccatactaatcttcatcatgtagctagaaagaactgaaacactcctccagccttctaactttctagctacatctggattgtctggctcctaccttaaccaatttctggttactgacaaggcgtggcacatcctaagttccagggagccaccaaaaacagtcaatactagagcacacaaggacttgagaggtacctgaagatctctggc

SEQ ID NO: 24159 - DNA, 1026 bp, Homo sapiens
gtggcgctatcttggctcactgcaacatctgcttcccaggttcaagtgattatcctgcctcagcctcccaagttgctgggattacaggcgtgtgccaccacgcctggctaatttactaaactaataaattactaaattagtaagttactagtaaattagtaattactaaaatataatttttagtagagatgggatttcatcatgttggccaggctggtcatgaactcctgacctcaatggatcctcctgcctcagcttcctgagtagctgggaccacaggtgcacaccaccacgcccaggtaattaatttttattttttgtagagtcgggggtctccctatgtttcccaggctggcctcgaactcctgacctcaagtgatcctcccacctcagcctccccgagtgctgggattaaagacgtgagccacggcacctggcctgaattttcctcaaattcaaaaaatcctgatgaaggtttggctaaaatctttggtgagttaccccactccctgtggaacctcaggctggatttgaagagttgcgtgcatggtcctcattgtctcccaggtaacctgttcccgctgctgtgaagggaaggcaggtgctcttccttgaggctagaatctgtctacgtgtcacagtctcaggaaattaagcaaaacagatgataaacacctcaaaaggaccctactgagcatcagtggagcagagcagggccatgtgggactgcggcgtcagatgccacctcacactagctgtgacacacctgcctcgccagtttctgctctgaggccccaaagccgagctgaacctcctccaggggttctcagccctaactgagcatgaaaacccctggggcaatcctctttttaacaattgagacattccacacacaccccacatcagattttggggtgtggggatagaccttcacatttgtagttttctaaccctccaggggacactaggctgagactcattggtctccactctgaaccttccactgaacatgtgagaaaaactaag

SEQ ID NO: 24160 - DNA, 1085 bp, Homo sapiens
ttacttctttgtaagaaacattttagactgaaataaaaacctgttataatcatgcggtctggttgcagcgtgaaatatgttcacagtctaagattcaggtgaaaaggcaggatgccaaatcttgtgtacttgctgatcttatctgtgtagaatatccaagtcagaactgattttagttaaggtatctgtggggggtggggtttccctctctatattttccaagcctgcagtaagagaactatggcaatcatctttctttttaacatatccagcttactgccctaggttggccacagtcagatttcttgaaagcccctagggctgggcgcaggtgtctggttgtccctccgagactcagggctcactctcgcttcgggaacactaatgcaactcttctggtggtgagaacccagctgagagttcctttattttgttgatttcagggtgtaggtatttaaatatttgaaagtattttgatttttaaatgagatgtgtgggaacttttttgattcatcacccttggaatggttacagagttttgtttttataatacaaaactttcttgaggtgaatctgtgactgagaaaatagacatctatttgaaatatcgtgtctaaagtactaaaatattgctggttgctaaccacttaaattgagtatttttcttcataaacattaagttttattgaaagagttgctgtgatttccagacactcttctttactgcttgttcaaataaggggagggggcctccagatgaaaaggttaaactagagtcaggcctgcttgaaagttttgagtcaggaccttcagtgggagatttgccagagtcccacacagtagggcacaggctactgcttccttgggtctctgggaggaggtttctcctctctataatggaaagttggatttctagctttttttctggatacttcatggggtactgtaattgtgttgactaattgatgctctttcctggagtctcactcattaattgggcccatttctatggaaggcacaaatattgtaatgtaagaatcagatatatgctggtgatgctgtgtgaagcagcagagctgctgtga

SEQ ID NO: 24161 - DNA, 1051 bp, Homo sapiens
gaatttccttgtttttgatgaccttgacagtgtttagagacagaatcaatttttattttatcttatttatttattttttttgagacaaggtcttgctatgttgcctacactggtctcaaactcttggactcaagcaattagcctgcctcagcctcccaaagtgctgggatttcaggcgtgagccaccatgcctggcctgtcttatttatttagtcatttatatcaatatggactcaatggtttttttgttgttgttgttatttgggttataattgtcaaagttgagtcaaatatagagacaattctctgttttatttgggaagcaagaattgcagttctgggcatatacacagactggatggtcttccatatgtctgaagaacaaagaaggttggaggttttataaaaagcagaaatgttacccattgttttgagagacagttcattggtactagtaatgtttcgaggagctggcaagctctgattggtgagtgtaaaactattcttagactcacagcagcttgtttcagtagctattagataaaactggtttcaggtcacaataggcagtttcagcagctggacttgcggagaattaccttcctgtggcagtgttacgtgcccagggtgctctgtccctgcttggcttcttgattctgttttagttggatatgacaggaataacccaatccatatgatcaacttttatgtaatccagtactagggtattcattgtgttgctcagattgttccagctttggccactgggggctctttcagttagctcgtgttcctctgacatacctccattattgtgggttgtttgatttttgagtacttccttattggcactgcaagatactccaggctcatcttgtgtatctcctatcccagccctagaatcacccatttctccacagaaccctcatcccttttattggagtgtagtcttagaaatcaagatatgggtgccaagtggctaaagttattgtaatctcaatttatgtgtactcagctgagcaaaagcaaagcatccaaatggcagcggcag

SEQ ID NO: 24162 - DNA, 1047 bp, Homo sapiens
tggtggagatgcagtaaaaagatcttgaataaatgagttctgctagttcctctctgagtcctgtagtggctctaggtcaaaagcagtaaaacctaaccagaggaaaaaaccagaggggaaaatattttggacacacgagaagctatgtagacaggaagcaagtgggagctccttggagaggggagttgcttgagactgaagttcagggaaaggaccaggagactgggttggtactggttcctgcgggctggagggggtggagtagggagtgttgtgaaagtttcaagcacagaggactgaatggaagcctcacaatgcaacctaaggactttggattcttgcttttgagtacatgcactgtgtgtgtgtgtgtgtgtgtgtgtgtgtgtgtgtgtgtgtgtgtgtgtaaatggtgtagtttgttggctgtcagccttactaggaggctggtttggagcctgttgccttagctctgtggggtgatgatgggaatagtgaaaaagagggtgacaaaagcagagagtctcaaagaggggacagaactcagtgactgaccagtttggttgatggttggaaagaggtgtcagatacatctgagctcccaagaatggtggtacctggaagggagagaaatcaggaggagccagttctgaagggaatgtggtctcgggtctcagtggataccaggagttcaggggcgggtgactgggtaacttggaaatacaggactgggccttaggagtgtcattagggccaggccaagaggggttttggcatcatctcctggatggccttagtggataaaactgacaaggctgcagagtggagggatatgccaacacccagccctggcttgaacctgtccctgtcccttgatgttgggaagcagagattccctgtcatgtcagatgactcagaggggccctaggatgctgaggcaccaagtgagggctgtcatttacacaccgtctgtcgataacattggtaccaagcagtatagggtcttttatcctggagattctgaacctctgtgatggacccctgagg

SEQ ID NO: 24163 - DNA, 1162 bp, Homo sapiens
tgctggtcaattgtgcctaaatttcaaagggaggagggtataaatgagacatgtccaacctcctcttcccatcatagccttaactagatattcgggtttactttgaaatgctcctctccaagaggaggggtccagttcagttgcttgaggggcttagaattacatttttggcttatagtctccaataaatgctgttgagaaaatgggatatccacgtacagaagaatgaaattagacccttatttcttaccatatacaaaaattaactcaaaatcaattaaatacttaaatatgagaactgacactatgaaactgctgaagaaaacataggtgaggcgcttcaggacattggtacgggcaaggctttttgaataagatctcaaaagcacaggcaacaaaagcaaaaatagaaaaatggcattacattaagctaaaaagcttctgcacagcaaaggaaacaacaaagtgaaaagacaaactgcaggattgaagaaaatatttgcaaactatacattagacaaggggttaacatcagaaacatacaaggaactcaaacaactcaattgcaggaaacaatccaatttaaaaatgggcaaaagacctgaatagacatttcccaaaagaagacatgcaaatggccaacaggtataggaagaaatgctcaacatcactaatcatcagggaaatgcaaattaaggaaacagctgtaaagtgaggaagaagcttggggcctggagtttataatctggggttggagtgtcctggttctactgctatctgctttatgaccttgagctggttgcttttccctctctgacactgggtttcacatgtggctctgagcactcagtgaaattatcactgggaagtgcttgatggaagctcttttccaccctactcttagcaggtcagatatggggaggaaagagagggagttaggtttctctgcttcactgttgatatggacttggtgccctgtgtcccagccgctctagccgtggctgaaaggggccaaggtagagctcaggctgtggcttcagagggtgcaagcctcaaccttggcagcttccacatggttttgagcctgccagtgtacagaagtcaagaattggggtttgggaaccactgcctagatttcagaggctgtatggaaactcctggg

SEQ ID NO: 24164 - DNA, 1005 bp, Homo sapiens
aatgaaggctaagacagagttataaactgccttcctgaacattgaaaatgcaccccagtatacacacagggactcttagctacagcaaaggtctgtgattctggtatttaaggaaatatctgtccaaccattatctgactactaacctaatgaagcagtcacttcagtggccacacatgacaaagagtattactttacagaattagatcagaaaaggcactgaagaaacagccacacaaaagagcagcaacaacaaagcttggggaagggagagaatctaattccagagatctcacattatattatttaaaatgtgtagttttcaacaagaagttatgagatgttgcaaaaaagaaagtatggctcatacacagatggaaaaaacccatacagtcagtagaaaccatccctaggaggcacaaatgtttaacttagtagacaaagatttttaaatcagctattttaagtatgttcaaataactgaaggagagtatgtctaaagaactgaggaaagtatgagaacagtgtctcaccaaatagagacttgaagagatagaaactataaagatatctaaatacaaattctggagttcaaaattataataactgaaatgaaaaattcattaagagaggctcaactgtaggtttgagaaggcagaagaaagaatcagcaaacttgaagacaggtcaattgagattatccagtctgaggaacagaaaggaaaaaagaatgaagaaaaatgaacagagcctcagagacctgtgggacacaatcaagtgcaccaatatacatataataggagttccagaagaagagtaaattgagaaggggggagataaaaatgtttgaataaatcatgaccaaaaacatcccatgtttgatggaaaacatgaatctacatatccaggaagcccaatgaactccacataggataaactcaaagagatccacacttgatacatcatactcaaatcattgaaagccaaagacagaatctttaaaat

SEQ ID NO: 24165 - DNA, 1032 bp, Homo sapiens
aagacacttagtgctttagacagtgtctcagtgagaagtggcagggattgctttctagggtccgttaggggaaggatacttgttgaaacccctctcactttgatctagaatccaaaaggctaaatctaaacctctagagtaaaggaaccagaagcaggtgttcatagggactacaggttcattaagtttctgaaagtaaatgaaaatattttagagtgctagtgctccttggaaccttgcagaagtagttacaaatcttgtctggagaaagcaccatcctagacctcaaataatttctacaagcaattcttaaaatatagtgttcagcataaaatcatgaattctcagaaacatgaggagataagaaatatgaacagaaacaataaacatagaaatagatccaaaggggctgtatatattagagttaagagacagacactaaaataactgttattgactatatgtcttagttaataggggctgctatagcagaatattgtagactgggtgacttaaaaaatagaaatttattgctcacagttctggaacctgagaagtgcaagataaagatgctaggatatctgttgtctgatgggggccagcttcctggtttgcagatggacgtcgtcttgttgtgttctcacatggcagagagcagagcagaggaagcaagctcttgtgtctcttcttttaaaggcactaatcccattcatgaagactctaccctcatgacttaatcacctctgaaaggccccacccctaataccatcacattgggatataagatttcaacacataaattttggggtttgtgtcagaggacagacctacttaaagaaactttagggggacacaaacattcagtcataacactaggtaaagaagaataaggacattattgaacattttcagagaactagaaaccatgaaaagaaccaaatagatattctagaattaaaagaaaaatttcaagaagcaaatttacaaaatgaagccagagcaataaaaataatggaaaaaaaaatcagagga

SEQ ID NO: 24166 - DNA, 1031 bp, Homo sapiens
ctaattgtcacctctctgctgcttatcattgtgttctttttgcagcatataaagagttatcacaaaaaacaattataattttccttgaaagaggattaaaaaataaaaaagaattagtaatactccaaggaagtaatacttcatctcactcttttctgtttcacattggggttggtgactgacgacagcctccctgcccccagctgcttgcactttagagttagttacatgttctgggacaggaagattgcatgttgctgggaagaaatgttcagacctagccacttggtgggttttcggtgtaagcgttttaattcccatgagatgaacagtgagaggacttgaggtgtcaccatccctgagggccgggggaggagaacccatgaggcaggtctgcagccagttcatttgcagcctgtctcccttgtcatcccacctcagtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccaggtgaggccacatggaaggactgactgtccatcatacccatgtcatgtgccccttcctttctgagatatagcgggcagagcactggcatcagatagactggactgcaaacacagcctctccccctgcagctctgtggccttggcttgcctaagcctcagtttgctcattgggatcatggattcctgtgcaaggatttcataagacagtgtatttgaacccagatgtgtgccccacactcagaacctcctcttttctcttctttactctttttttttgagacagagtcttgctctgtcgctcaggctggagtgcagtggtgcgatctcagctcaatgcagcctcttctcccaggttcaagtaattctcctgcctcagcctctgaagtagctgagattacaggtgtgcgccaccaggcctggctaatttttgtatttttagtaga

SEQ ID NO: 24167 - DNA, 1269 bp, Homo sapiens
ccccttgactccagccttcacacttgagtttgacaaacccgtcaaactattggcactatcaaattcagacagggttctcttgtaaggtaaggtggggggtaacagctagcaggactttctgagcaggactgcccagaaaactggtagactggtgggcaagccacgggtcaggcagctaaacgggaagctgggaagcagccatgacatgcagtgccctgttggccacctgctggccgtgggtgtgacttagggccagtgctttctcagcaggcatctgctgttgtcgtcgtgtatatattgatatctgtacatttccaaacttgagtgaagcaacgcgtctgcaggttgcatcggtctgctctgctgcttctctagcagtcgacaccatttgctcttatgagcaaagtgtcaaatgagtgttttatcatgagagctgtcagtgtgctctggcgacctcaccctaatgatgttctgattctgaggcagcaggcgtgtttgcagaatgaaacccggaactaaaagtgtctactgttgatcgatgccttgtttcaagcactgctgggcagccccctacctcacataccaaaagaaaggataagaaacctggtttcccgtctccttcgatgtagtcaccaatgctgttaaagtctcgtttccaacagtcacttctactaaatgttctgtatcatttgtcctctcaccaaattatttaaagtgttcaattctcttatcctttctgtatgtttctgccgtttgaccttctcacaatactgcacaaaagcgacgcgtgagctcctgcctcttgataagtgcattttgtaaaaatggaatcgttttgtcccgttttgtctttccaagttcatctcaacctctctgttaaagctcgccatccctctgcccaggctcagggaagcaatggagactcaaagaccggtgctctggggcgcctttttaaaattttaattccctggtctgctccccaggagccttggtgccattcaggcctgatgtccagtgtgaccctggtgctgagggacggcagccacgcctgtgcccattagctgcacggtggtgggaggggacattctggtgagctgcagacctcagccagtgaagaaaggagaacaaagtggacagggatccctgtggtagtggcagcaaggagcaggatcagggccagtcaggagctggcaccccaagttaggcacacagtccatgcggaaacctctactcagttctcgggctctcgaacaagttcaacggaaacaa

SEQ ID NO: 24168 - DNA, 1017 bp, Homo sapiens
ttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatgaaagtgtcttatttttaggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaa

SEQ ID NO: 24169 - DNA, 1027 bp, Homo sapiens
gcctgaggttgcagtctgcggttcccaagccccaagacccgcctcagaactaactgcatttgcttttgactcctggcctttctctagggttgggaagaacatggaaagtgacctccctgccaaataactcagaagaggagtgtcggtagccaaatgtttcttcagaatacgtgtaaaagaaatgtttttcttccatctaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtggtaagtgtgtttatctgagatagaattgaacgctgagtgtttctgattagattttttgttataaatgtgttgtgggtcagaatctggaaatattggaaactatttctcctttttactgaagcctcaaaaaatctcacaggaaagaaagttgtagtcttggttctacaggtcccaagcagatgccagagtaaactgttaccctaggacattgaaaagcaggggacaagattcactccatatctttttaagtacttgaatcggtacccaaatgtcagctgactgtgaataggaatatgaaactggaaattgcatttcacaggcaaatccacagtgagaattgtaaaggtattgatgggaacctgagaaactgaagttctccaattccataatgcaagggtctcatttacctgtagggtgttgaagtgggtaagatattgaagtttatagggtgttttgcaccttaactggacttaaactatgttagtgccttctctacactggcgttctaaatactgaggccaccgtggtgaatcagcctggcaa

SEQ ID NO: 24170 - DNA, 1055 bp, Homo sapiens
acaccaccacacttggctaattttcatacttttagtagagacagggttttgccatttggccaggctggtctcaaactcctgacctcaggtgatcctcccgcctcagcctcccaaagtgctgggattacaggcgtgagccaccgcgcccagccaataccacccttttacaggcatagttcagatatgctagttccattccagatactgcagtaaagcaaatatcacaataaactgagtcacacagatgtgttggttcccagtgcatattaaaatcatatttacactgtactgtagtcttttaagtgtacaatagcactatggctctaaaaaacaatgtacagactaatttaaaatgctttattgcttaaaaatgctgacacagagacatgaagtgggcatatgctgctggaaaaatggcacaggcagacttgctggacacagttgccacaaaccttcaatacgtaaaaatttaaaaactacagtttctgtgaagcgcagtacagtgcagtgtggtaaaatgacatatgcctgtattttcctttgtaacttctgactagtacagcagagcttttgtatgtgctagttagccaataaatgctgtccactgttaatataaaattctaaaatctggcctagaattaatactaatgtaagtcacgtattcattaccaagaaattcatgaaaaacaaatggtgtgttttaaaatttcaataaataagactttcaaaggaatagtttcattcataacaagcattctgccctgaatgcagtaattctggaggccactgtcttagtctgttctcaatgctgctataaagaaatatctgagactgggtaatttataaaggaaaaaggtttaattgactcacagttctgcattgctaggtaggcctcaggaaacttataatcatggcagaaggcaaaggagaagcaggcaccttcctcacagggtggcgggatggagtgagtacaagtgggggaaatgccaaatgcttataaaaccatcagatcttgtgagactcactgactatcacgagaacagcatgggggaaat

SEQ ID NO: 24171 - DNA, 1053 bp, Homo sapiens
cacgtggggattctggggattgctgttcaagatgagattttggggacacagccaaacaatatcaggcacagaaggggaccaaatcagcctggagtttagcacatttcatgtgagtctgtatcatagtttgaattaaatagaaagggattcagtgtatttttgagaacctatgttgtgtgaggaactagaaagagaaatgactacatgtaatgatgaccatcacagaggagctacagaagccagcataaggtggtggtttgtggagatggggaatagttgactcctggtgctgggaattgcaagtgcaatggcatagaggtgtgaacagcacactaggtctgggagcatagggtgacaccgagtcactggggaagagatgtgactagagaaattggccttcatgccattcaggaaaaaaattggactttatctcatagactgcatgtgtgggttgggggcaaaaggaggtggggagctttgaggctttaaagtaaggaaataatgtcaaactcacactatcttttccatggcagtggaggaggcaaaagttggagtagtgagtgggcaaggctggatacacttgcagaggtctgcgtaggagtagaggaggcccagatagtatggtggtgataggaatagagaggagagatggattcgagagcttcctgagataacaaggtatgaggggggatcaggaagagggagtgggtgggaggctcctttgggatgacctgtaagattttggcttagatgactgaggaagcagcagatgcagatgaagcagcccttgctggcctgttgagttcagggagcttcctgaagagtgaaaagaaggtcagtagacactgaggttgatgactctagacctagaggcaagagtctgggccatgatgagcctctgactggcgttaatatggagctgggaggtgaaaaccacagtgccttggagtgctctcggaaggcacatctgtctttcagaggaaagactctcactgaggccagaagcttgaaaagcgcccatttgggataagcgggagaataggggcagcagag

SEQ ID NO: 24172 - DNA, 1081 bp, Homo sapiens
actcttcccacagccagccccacctcaattaaaggcagctccatcttccatttgttcaaggcagaaatctctcagtcatccttgagtatttttttctcatactccaatccaataatgtcaggagctctaccttcagagtatcgtgtgtgccacatcttagcacctccactgccaccagcccctctgctcatctcttccttgcagtagccttctaactggtctctgctgccagtcttgtctctggagtctgttctcagatccgccaccagggaggctctgtcaaggcatttaagtcaaatacttttctcagaactccacagtggcttctcacgtcaccaggaataaaagccaaagattgtaaaacggccacaggcttcgtaagacatggagcctgtgtgacttgatgttgggcccaaccctgtttcttttctggcttcatttcttgctccttttctttcagacactggtcttttcaccattcctcaggcctgccaggcaccatcactatccttgggtctttacccaaatgttactttatgaccctcatatgtacaattgcatctcaagtttgtattctccacatttctctgctgctttctctctttccataataccatctgacataggtgtatcattgtcagccttccttcctagatggaaggcagggatttttgtctgttttgtttactggtatatctccagaatttagaatgtctgccgcatagaaagtcgtcagtaaacatttacagaattcattttattatgaaagaaattttaattttgctcttaggttcatctctaacaagtatttagtgaaacgacagagcagagactatgatgtggaatggggctatgcttttgatgtgcatctcaatgctttttatccactcctggtcattttgcattttatccagctttttttcatcaaccgtaagtagcagttaattagagtattatccaagtcttcattgcatgcattggtaaagggactcatggtctgcgtctcttctggcagatgttatcctgacagacacatttattggatatttagttggaaataccttatggttggttgcagttg

SEQ ID NO: 24173 - DNA, 1031 bp, Homo sapiens
tccgagatatacatgtagttcatgaacttaatctttctgctatcagtataagtcagtatagtaggctacagttgttttgtgtgtaattaaataaatatgacctttttaggttatagaagcaatgcgtgtgcattgagaatagtttaaaaagtacaaacaagcaaaaaaaattctactttttaacagaaaggtgttatgatttagtgaaaatgcacttgcctaggaattaggagaatggggttccagaccacaaactttattgatagctggatgcacttggataagttattgaactttctggaattcatgatcctcattcataaagtaaggatgtgggcagtcagttctaattataggagttggaatttcttcagtcccttctagctctttaattttctgtgattctatggcaaagcattctttatctgccttcattgttgaagaagacactttaaatgatagtaattttgtggaatcaatctaggactgactcatttgatgaaagtgggatgtggctaatgtgtataattactacctgtggttgaataaaacatttataaattaattcgtgcccttattatattaaaataaccaataattttactgttaagtttacaattaatttgctgcttagttttttaatactagagaaggggaaacctgttcatttccaagacatagttgactgatgggtctacttcctacttcccacagcctctaaagagagcaatcactacacttatggctgggattttgcgcttagtagttcaatggcccccaggcagactacaggtaagtgtttcttttcaagaatttgtcttttctaccccttatgaattttttttttaatcattacaaggcaagctaagttcttttttttatttttttgagacgaagtctctctctgtcacccaggctggagtgcagtggcacaatctgggctcactgtagtctctgcctccctgattcaagcaattctcctgcctcagcctcctgagtagctgggactacaggtgtctgccactatgcct

SEQ ID NO: 24174 - DNA, 1039 bp, Homo sapiens
agtatttatagaatatatcacatatgcacactcatgtatttggtacagatgatgcacataacagcttacaacacataattgtgtggacatttctttttggtttttggctcaagaatatattatggccatcattcaatgtgaagacctgcaaagatagtaaacctcattcattttaatggtagtattgtatcctataggatacatcagaatttgtgtatttgcgccaggcgtggtggttcacacctgtaatcctagcactttgggaggccaaggcgggcggatcacaaggtcaggagttcgagaccagcctggccaacatggtgagacccccatctctaccaaaaatagaaaaattagctgggcacggtggtgtgcgcctgtaatcccagctactcgtgaggctgaagcaagagaatcgcttgaaccttgggggcagaggttgcagtgagccaagatcgtgccattgcactccagcctgggcgatagagcaagactccatctcaaaaaaaaaaaaaaagaatttgtgtatttgtatcattttacttagttttattattaatcattttatttagaatggatgcatcataatgtagttatcatggtgaggaacacgggttgcctttaaacttttcagtgttacacatagtgttagaatacacatccttattcggtatattttgtatacttagaggagtgtttctgtgggatagtttcttagaaccttttgattcttagataattaattcaagtattagctctgtggagctgtttctgatcgctcataggcagagttcattagtcatttgcctgtattctcataatactttgtagattctttttataatacttatgttttattttcatttttaatttacatgtttgttttcccacttgatagtcagctcttcacctgagaatagggagggaagaggatgcagcccagtgcccagctcatagcagtgcttacagattctcctgacatttaaattatttagtgttgtctggttgctcctgctttgttctacaggttaaactccat

SEQ ID NO: 24175 - DNA, 1066 bp, Homo sapiens
caggtccctcccctaacagtgggaatcacaatccaacatgagatttgggtggggacacagagccaaaccatatcaatgagttaggtgtttattctaatctttgcagtctgggcttgtttgtacctgtccttgttaagaaggcttttcagattcaaagggaattgagtgctgtgatctaagtctttggtcactgcagtcttatctgtactagaaggtatcccaagccctctatctgtacatggaatgggtggatggatggatagtatgagtctcttgaagactcatagaggtaccgccttcatggacttgggtgagatctggaagaattccctggattaccaggcagaatctctcattatcttccctcattttccctaaaaggagtctctttctctgtgctgggctgtctagagttggagaatgggtgatgtaagcactactatggccaccataggtaggactgcactgggtcacacccaaattcagcacagtactgggtctcatccaaggcccttggcaactactgcctggctactgctgatgcttattcaagacccaaaggctctttcctcagcaggtggtgaattttgccaagactaggtccttctctttagggcagcatgttttcttctagcctagggtgagtctagaaatgccatccagaagctagggcctaaattcaggggcttcaggaatctgctaagtgccttattttactgtggctgtgctagtacccaagttgcaggacaaagtcctctttacccttccctctcttttttgcaagtggatggactctctcccagagctgcactgcctggaatttggggaggggtgatgcaagcactcccttggccagtacaactggtgtctcactgggtcacatgtaccccaagttcacaggctctgagcccattgcagtaccaggacttgcccagggactgcagtccttgtggctaagactgcctttcaaatatatttaggaccccagtccacttaagtcagcaggcagcaaagctggccagaactcagtttcctattgctagggcagacaattcctctctggcca

SEQ ID NO: 24176 - DNA, 1058 bp, Homo sapiens
gccataaaaaatgatgagttcatgtcctttgtagggacatggatgaagctggaaaccatcattctcagcaaactatcgcaaggacaaaaaaccaaacactgcatgttctcgctcataggtgggaattgaacaatgagaacacctggacacaggaaggggaacatcacacaccggggactgttgtggggtggggggagtggggggggagggatagcattaggagatatacctaatgctaaatgacgagttaatgggtgcagcacaccaacatggcacatgtatacatatgtaactaacctgcacattgtgcacatgtaccctaaaacttaaagtatagtaataataaaataaaaaaatgaaaataaaaataaaatttaaaaaaagaagtaaaaacctcacagcagcttatgttaatttttcaaacaaaaaatcatttattcacaagttacacaaaatattttttttactgtttacctgacatctaaagtaaaagcagaataaaataaacttctcaccaatagttaaaaaaaaaaagaatattctgccgaactaaacttcatatatgaaggagaaatgaaatctttttcagataagcaaatgctaaagaaatttgttacttctagaccagccttacacgaggtccttaagggagttctaaacatggaaacaaaggaatgatacctgccagcacaaaaacacagttaagcccagaaacatacgtagcctagagatcctctaaagcaactacataattgaggctacaaagcaatcagctaagagcatcatgacaagatcaaacctcacatatcaatattaaccttttgttaattgtctaaaatgccccacttaaaaggcacagagtggcaagttggataagtaaacaaaacccaacagtctactgtcttcaagagactcatctcacatgtaacaacacccataggctcaaaataaaggaatggaaaaaggtctatcacacaaatggaaaactaaaaagagcaggagtctttatatattctgttatatcagatagaacagactttaaaccaacaacagtaaga

SEQ ID NO: 24177 - DNA, 1052 bp, Homo sapiens
aagaatgaaactggacccctacatttcaccatatacaaaaatgaactcaagatgaactaagaacttaaatgtaagacctcaaactatagaactcctataagaaaacctgggaaatacccttcttgatgatggctttgggaaagaatttatggttaagtcctcaaaagcaattacaacaaaaacaaaactcggcaaatgggacctaattaaactaaagagcttctgcacagcgaaagaaactattaacagagtaaacagacaacagaatgggagaaagtattcacaaactgtgcatctggcaaaggtctaatatccaggatctataaggaagttaagcaaaccaacaaataaaacacaaataaccccattaaaaagtgggcaaaggacatgaacagacacttctcaaaagaagatttacaagcaactaacaaacatatgaaaaaatgctcatcatcactaatcatcagagaaatgcaaatcaaaaccacagtaagataccatctcacactatggctatttaaaacttttaaaaataaatgctggcaaggctgtggagaaaagggaatgcttatacactgttggtgggaatgtaaattagctcagtcactagggaaagcagtttggagatttcacaaagaaccaaaaatagaactaccattcaacccagcagtcccattactggatatacacccaaaggaaaataaatcattctgccaaaaagacacatgcacccatatgttcatcacagcacttttcacaatagcaaaaacatggaatcaatctaggtgcccattaatggtggactggataagtaaaatgtggtgcatcatcaaaaagcttatccaccacgatcaagtcggcttcatacctgggatgcaaggctggttcaacatacgcaaatcaataaacataatccatcatataaacagaaccaacaacaaaagccacatgattatctcaatagatgcaggaaagaccttcgacaaaattcaacagcctttcatgctaaaaactctcaataaactaggtattgatggaacgtatctcaatat

SEQ ID NO: 24178 - DNA, 1040 bp, Homo sapiens
ggggaatcttatcttccaggacctgctctgatttgaaatagaaactggttaattttaaaacctgaaaatttcctaaagaaaaatttgctttgatattttaaaaagtttagagttatttccaattcactactcatttccctgtttcaagatagtattctcacaggctcagtacatagtttgttggcacactctctttcttaagcataaactcctaatctcacttcaatccaatttcatattgacatgagtcatgcgtatcttacatatgtaactaaatatacactcccatcccacctctaagcttggtaacaccacaattttgttccctttctttttaaaaaaaaaaatactgatcttttcattctagttattcaccctacccctggcttcaaggatcagttttggtctttcattcatttatttagaaatgggatcttgctctgtcacccaggctggagtgcagtggcataatcatagctcactatggcctcaaactcctgggctcaagcgatcctcccacctcagcctcctgagtagctggggcgacatatgcgtgccaccatgcctgggtgtttccattcttataccagggtctccgtagggaaaacaaaataaaacaaaataccaacaggagcatgagaacgtgacttagaagaggtttcctctgctccatttcttcctcaatcaactctattcttggtttcattcaaatggtagcttataagttttacaagacataagaaggccagcactaaccttgtttgcaaccttacagagaaaatctcccctctctgtttgcaaaggtcttctgtactcagcagcaaactgcacttcaagcttttacaaagcgacggcctttgtcctgtaacataggcttaacaattggagaatccattagtcagtagatcactgcgcacctggcttcaacagagtagacatcagcgtggctctactgctgtggaggaaacttttaaacaccagcatgaagactcacctggcttttcttaccttcgtcctgtaccaatgatcattagaggagc

SEQ ID NO: 24179 - DNA, 1786 bp, Homo sapiens
taataaaaactataccagtgcttcacaatgtattttaatccttttctagtgaagatgatatcctgaaagaactggaagaattgtctttggaagctcaaggcatcaaagctgacagagaaactgttgcagtgaaggtgaaagacagacctttgttacctattcgtatttcgtattctattctttcttcttaatgttggtttggggagctacatttggaaacttttgagcagtgtacaatatgttatttaaaagcttctatgaaatctgatgtcaaagggaaaaataggaatgtaaaggtattttgtggtatgttgattgttcataaaattggtacatttggagttgtgatgtaatcactcgttccatcttcagttttctctgttgtttctttttcatccttcgaatttggataagcctcagagtaatgggaaaatcatagatattttttcttctttcaacttgtcccttaggctttgtaaagttagtaaatgggtggtgactagtgcctgtttcaagagcccctggattctgcaatttacaatgatgcgagatgtgtctgaggccaaggccaacctctcttgcttgtttgaattttatattcctgtgaaaaagactttgaaaaagattttgaaatcattttgagatttttaaaaaatgtttacttaatgaagcacatgactctggtctcaattataattctgttaattttttctaacaatggaaattttttagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaaggttggttaatactttagaggaaagagcaaaaggcttttgattcacagtataagttgtaatcattgtgccccaaggtcgttttgttatttgtccatgggtataaagacacttgattgtaaggagccatctaaaaaattacgtctaagtatttgacttgatttgcattgttaattctttacatatatagtataaatatctttcagattatttatgtacagactggaatttttatagaattgcattatgaaaactattttttttgctgttgataaaggctatagaagttacttaatgaaaaatttattcttcctttctgataactcagtgtcagataatatttgaattctttcctgtctttaaaaacctagttcaatttatgaa

SEQ ID NO: 24180 - DNA, 1438 bp, Homo sapiens
tttttttaagaagatataatgctgtcacacacttaatagactacaatatagtataagcatctcttttagaagcactactaggaaaccccaaaaattgtgtggcttgctttattgtagtattagctttactgcagttgtctgaaaccaaacctgcagtatctctgagttacgcatgtataagaaaatgcaccccatgctaagtgtttaatttgttttgacaaatttacaaccactgtcattcagaacatagaccatctccatatttccagaaaagttctctcatgttactttgcagtcattctgctgccctccctaaactcaagctagtattgatctttctgtgtcatatggactagttttgcctgttttatgatttcatataaatggaatcatatagtatgtaattttttaagtttggcattttttgttactcatgttattatgctttgttcatgttgtcattacatgtataaagggtttttcctttttatttttgaatagtagtccattatctgaataatactgcactttatccatttatctgttgagaattctagttcctgcatatctttgcgaatactcgccctacctccagcattctagtaggtgtgtagttgagtgcaaaattattgtggtctagtttgtttccacagtgactaatggctttatgcatcttttcatgtacttatgcttagagagatgaccatatctgtttctttgaaaaatatgttcaaaatcctttgttctttattagattgttttattgttgagttttaagagttctttatacttctggttctatgtatataattcctttttcacttgtatgtactgctgatgtattcttatggtctgggacttggtttttcattttctttgttttgttttgcgtgtgtgtgtgtgtgtgtgtgtgtgtgtgtgtgtgttggagactgtctcttgctgtgtgtgtgtgtgtttttttttttggagaccatctcttgctgttgcccaggctggagtgcagtgtggcgcactcttggttaactacaacgtccgcctcccaggctcaagcgattcttgtgcctaagccacaggtagctgggattacaggcatgcaccaccacacccggttagggttgtttttttctggggggcgggggggcggtgtgtgtgtgtgttttagtaaagatggccaggctggtctcaaactcctggcctcaagtgatccaccgctttggccacccaaagtgctgggattacaggcgtgagccaccacgcccagcctccttttcttaatagtgtgttttgaagagaagaaatttctgattttggtgaaatccaactaatttttatattttatttatttttgggacagggccttgctctgtcacccaggctggagtacagtggcattatctcagctcactgcagctctacctcctgggtttaagtgatt

SEQ ID NO: 24181 - DNA, 1032 bp, Homo sapiens
acactgggttctttggaagctctactggaatttctgaaaacatcagaagtgcccgtaagtaactacaactcgctccacaagtgaatggtggttggtcgtggtttttggtgccatcgccattacctgatacatacagataaacatggaaactcccattttttcagtatgcaggaattaacattggcccagtgcataaaaaagatgttatgaaggcttcagtgatgttggaacatgaccctcagtaagtaatttctcttgctatgaaggctttcatgttacgtagctatcttaaaactgtcctatcttaaaaaactgtcctctgtgacatactctgtttttcactgaatggtctttgatgtgttttaaccttttaggtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagtaagttactgtttttatttactttgagtctttgttaatgaacatgattgagaattactgaattccagaaagggctgtaaacagcaaaatcatggcatttactcatctaccagaggctgcatcctgaaatggtgtgttacaaaccagaaacccaacatactggggacattccagcagtatgcaaacaagtcttgtctgtgacttcagtttaataatcttggcagacttgggtcttgttaatgggttcgtagttattaaatgtagggactttatgttgctcatctgggattatatagattggaagtaacaaaacttgagtgaggaaaaccgggaaataagagattctgtgggagagaagtccattcctctaccaaactttcactcaagcactcacagtacctacattgctgcagtggtagaggaggcatcagcagagaaccaggccagcctccctcctcctttccctttgagacagggtctcgttctgtcaccc

SEQ ID NO: 24182 - DNA, 1055 bp, Homo sapiens
ctgtttaataatgcaaatgatgaaaatcgttaaagataacacatataacctgatgtgtgccatgtttaagttgaattcaccctatttttttgaacaatctttcttaactcttggtaatctttatagctcactcaacactgcaacttattagattaaaaactgaaagttaattttttcagaataaaataataaggcatgcgtatactttttaatttaaccatctttatatgttcattttttcagagtcttgcttttgaatcttaagaacccaaagggctaagtcttctttcttaatttttaaaacaagcatgtgttttgttctttacatgaatcgtcggttctcccagtgtgatcacgacactgtcccatgctgattccatgcacggtgcaactctttcccaagagaggtcagatttcgaggtgttgaaaatagcccagtgactcagtattcttggctgctttatgccaacggtttaattggctgcatcatagcaagcatctaattgagtttcacatttaaatagtggatagggtacttggtgcattatttgcttacagaagtgtctgattagcatgttcctgatcctcgttctatttgtagcaaagatgggaggtcagggactgtcacatttcatattccccacagcatctcatctcgatggggccttgttcagaatagatgctcagtaaataggtgtgggaaatgagctgaattgttggtggtcactatccaaaggtgagaaatttctgaatgctaatggggtacttaactatgagtaattctattttaaatctcaaggtgatgatgattaatagtatctcagggcactaaataaacatgtattaaatatgagcgtatgtttaaagggggagtttttaatgcagtctttaaggcacaactgcttctcacttgaattctttaactgagattaaggagtccttggcattttaagcaaagtcatttcttaggtaaagttcccccagagaccacttgaacttttgcaagtcttaaaacaatgggtggttccatttgatggttcagaatagaaaggaga

SEQ ID NO: 24183 - DNA, 1058 bp, Homo sapiens
tatggcatggatttttaatgacatacctttttctttatttttaaaggctacagagtattattcagaagtacaaataggacgttatttaacccatccctattaataaataatctattgagttgactgttacagtttttgtattaacttccttatctgtatatctttatgtacatttcaagattttctaggtcagggattattaggcctgggtaaaggcacacctgtttgaaatattgatagatgctgccaaattgggggctaaaaaaagctatgcctgttaacctccccatctacagtgtgtaaggccgccttgtctccatatcttaactaacacaagatattttccagcttttaaatcttttttgtgcattttcacatgtttgaggtagtaccatttatagttttctattctgattgttttgacgtgaacataagcatttttccatgacataaacaatttaaattaaattttattggctacataatagttatacttgttttgggagtgtatcgatggtacatgaagacgcaaagggaaatatttgaaatagaggttgtctatgaaaattaagtggctatgatcgaccttgcagtaaacctgaaagattttctggaaatggtgttgggagacacacccctccagtgatatgtttccaagaaaaccctgaggagatgaccttccaggcctttctcaatccagtcagatggtaggctgccccaagcatttctaagaagctttgttgcttttagaatccatcagatttacagtcagacaggttctaaattcagttctctgaatgtacagtagttacgtaaacacttcgtacattgcatgagacagctgaaaagtaaatttgctgtattcttttaattttttcgacttttattttagattcaggggatacatgtgcaggtttgttacctgggtatattgcatgatactgaggtgtggggtatgaatgatcctatcacccaggtactgatgtagtacccaatagttaggttttcagtccttatcccctggctccctgctccctccagtagtcttcagtacctgt

SEQ ID NO: 24184 - DNA, 1032 bp, Homo sapiens
tgaattattctgggctgtatatcatttcagagagttctaggaaacaacactgaaactgatttaagaaggcttttcagctggaagacatggccactcaacgcctgcgcctggggacagtggtggtaggggagggtgaggttgggatgacctgtggtaggaccaaccatggaataacagggtcaggagttaacgattcaaggggtgcctccgagttcccattgtgcaggtcaggggtggctctaccgagtgaatgcccttcttctttcttccgtacgcacggaactgttttgcatcttggttccaatgcctccctgggttctatggcattgcagctttgccccgtcgtgaaggcaagtccccgggccacatgtataatgttgggggaaagaggtatacagggtttgggaggaatggggttttcctccattttcccagatagggaaatgtgtggtcagaaatatgaaagaactttgaaaagaacatgagatgaggtctgtgaattgtgaaacatggtgctcctcttagttctggggcagatttttcaggatcaagaactaaaaccaagaatacctttgaacactttagtgtggctcatctggtggccacactcacattgctatttccagtaaattacatcgcttacagacactagagccatacagcagcgggaccccatccttccagagttattaatgttctaggacaaatctagtatcccaaggagattttctttcagctaaagcagaagcctgaattcacttgagttcgggcagaatagataattcatccagattacttgaggccccaaatggatctgacagtctaaaagttagattgtaaaaggccgtattgatcctaatatcttattctctttcttatacctaactagggattgccatttttatttattttgtttttttgagatgaatttttgctcttgtcacccaggctggaatgcaatggtgcgatcttggctcactgcaacctctgccttctgggttccagctattctcctgggattacaggcatgcg

SEQ ID NO: 24185 - DNA, 1106 bp, Homo sapiens
tatagtattctagaagagattcctgtatcatacttgggaggtaatgtgaatggaaagttcttatagacacaaatcttataggaaagatctggatgaagccttgagtgtttgcctttctgggatccaaggaaactcatgaaacagggaggatttaaaggaggaggaaagggaagtgaaaagagaattcccaaagcctggaattgacccacacagtttggcatgaaatggtcacttccgcatctagagcacacattatttttctgaagcaccctgttgaatgagaggaatacatacgtgccatcataggttgaaaaagtgatcttttcagcataaattggtgggtgtttgagagcattacttgcacagttcaacaatacagagctggaaatgcataaagaggacattccctgctagtcaacgaatacatagatctgtagctggaaattagttttaactttcaagtagtcaagaaacttttatgtccaataagactctctctacgtaattttaggctgtacactggttaaaataattctatttggggaaaatcttgtggttgtttgtcccaaatcgccctgacatgttctctgccttgagtccccaaatccctgccgtggggcgcagcctgtcatgcatgggccaggaggacagccagcacacggggcagatgccgcaggtcatccagctacgttttctgtgcattcatctcaggaatacgggtttccctgcacacttaaatctacgtgtaacccaagtttatagacctgctgggaagtggaaggcagttggttgcctttctcaaaggctgctccatgagcaagatgcctttcatctagaccattccgctggaagcatctgtcagaccagagtagtgcatcagtctaaagtcagctctctcttctctggtttagggtggtagttgtgtgctttggttctgtttagctgagtgggtgaatgaaagtaattaagataccctaaatagggtctttagctaaacggtcacctccctgcctaattgtgacaccaataaatccaagaaaggggaggacagtggcagcaggtcacagtgggaggatcatggcttggagcaaagacaagggctgtga

SEQ ID NO: 24186 - DNA, 1015 bp, Homo sapiens
acattcgaggagacgaccagtttttttccctactgacctatgatccccacatcccagcttctctgcctactggttggtcttcctgacattagttttgttcttgtgtatttgatccatgcacacatttttaccacaccggatatcctgaagttgggctggttggggttttgggagaggcatgtctagggttggttcactctgtggattaggatctagttttatcaaggtggtgggagaaaggcctcaccaggcagcaatcaccaatggatcccaaattcccagctgggcctgcatccaacacaaccaaccagggttttcagacaactcagattttaaaaagaaaagcagcaacctgtcagtttggtgacctagcagatacatctcaatgctttttactttttaattgactttttaaaaatggtgaattaatgccattttccgtatgaatgcatcattgtgtagatttgtgtagatgccttggagacgtcccctgagattgagagcgtggggtgggcatgttcgggggcggggagggatatgtagagcaactagaaggattgaggttttccttgcgtgcacaccctcctcctggcagcgtgcagtggtgagttcctggttcattgggagtgaaatgggcaccctcctgcttctgtgtgcatactgtatgaggtatgtagctttgccagatcttagtgtgacacaccaggatgacagctagcaaggtcacgtctctgagggttgttaggccccagccctggtataatgcctctgcaaggcatgttggtcccctacagtgggccggctgtgtccagggagcaggctgggctcagaggtagtgcgagctctcagctggcctcagggcccagccaaggcccctcatcatctctgactatagggacaggtgggtgcagggaaggggtggcaaacttagtaacgttgatctccttgatagtttctacccctgaatgcacctccacacaaaattgtgcaggccttcccagggaccctagcctac

SEQ ID NO: 24187 - DNA, 1038 bp, Homo sapiens
tggagcccctgcctgcgggtgcctcttggctgtaaggcactcttcctaccaatatggccttttctgtctctgtttaggagcccctctctgaaaccttaggtctgtgtgaccccagagtccatttctgtttcacccctggtgacctccttactgtgcagagaatgtgttcgttgaaattcaaagtagataagaaaggctgaagctcagtgtcacctcccttagcaggggctcagtggccacagtgtgaacagaaggggtaggacagttaggtggggcaggtgtgcaatgaatggaactcacctagagctttctgtgccccaggcatcatgctgggtcctttattgcacacatacctgtgacctgcttcctgtttgcaccttgcacaattgctgcctggtgggtgttagctgcattgtgttaggaatgaggggaacgggctcatgaggtttaaggggcctactcaagatcatagagcaagtaggttggaatggagatttaaatcagactgactctgaagtcggaaaccccctattctgagcagcagtggctggagaaaggcctcctgagtcagtgccaggaggcagagcccagggtctgctctgtccccaagcctgtgtctgtgggcaggccacttagccttgctggggggtggtgctgcctgatttatgagtggaggataactatagccagcccattccacccacagaactgatggagacaaaatgagattatgttttttcagaacttggcagctgccaggggttggtgagggacccattgggccttcctgaagagccctggctgccagtgctgtctgagtggattttccctctagtcagtagctcctgcacatgcagaagtttttgttttaattttagtcaccaggatataactgtcccttcaaatgtactttgtaagcactattaccttggagccaccacgatcatggggaggtttgtgggagtgaatgtcaggtagtggcacaggaattcagatgggggtttggccctggctttgtccttcctttcctccctccct

SEQ ID NO: 24188 - DNA, 1021 bp, Homo sapiens
atgagggtaactgcccccatgattcaattacctcccacctggtccctcccaggacacatggggattatgggaactaaattcaagatgagatttcagtggggacacagccaaaccatatcatagctgggcgagccatcgtgaaatgggtgaagatgcaatttgcctaatccttgccatcaaagtagagaacctgtttttgagtgtctgctgcaggccagactttgcaaacttaagttcatttaagtttcaccgctgtcctctgagataggtgtctgtcactcatgttcaaaacctccagtgccttcccgtctcacataaagcaaaagccacaatgcccctctgcccctggctccacctccccctcaccaaagcaatcaccgggctggcctctgggctgttcctcgctttccttgctgtctgggggaggcaccctcactgctcactcccacactcccttcaggtcacagctcacatagcatctcatcaaggaggtcttccaagactccctaaaacatcagaacaagactccccgaaccccgtcccacccaggattcaccttttcctgcactgcagtgataaccaaagaacaggctctgtgtttacttatttgcttgcctgcagttttccccaactcccctgacacatgcatcccccgcctcatgtaagcaccatgagagtagcggctttgctcacagtgggttcccccttgcccaggcactcagggagtatctgttgaatcactgtatatcacatgcagttggcacatttgtgctttggcatatacattctcctgcctcatcacagagcccaagaggagaggcaaatagaaggagatagtacacacggtgcatggatcagagacctgcacattgttagttttcctaaaattgatccccaaattcaattcattctcaatcaaaatcgcatcaagctatcactttttttttttgaggcacagggtttcactctgttgtttaggctggtgctcactgtaaccttgaactccgggctcaagcagtgt

SEQ ID NO: 24189 - DNA, 1034 bp, Homo sapiens
gggtgtgtgtgtgtgcacgtgcatgcgcgtgcatttgtggtcatccaggaagcagtgtggggtagcaggaagtgcgcagggttagaatcagacaggcctggctttgattcttgccaatgtttactgtctgtccttgggcaagtcactaaatctctcttagcctcagtttcttcttctgtcaagtggggtgataatagtagctacttattgcagaaattaaatgtagctgcgtctgatcccctggcacagtgcagtatgcagtgctgatagggaaagctaaaatttgcagagcgctcacagcctgcctggagcattttacatgcagtaattctccaagccttacaacacctcctcacaaaataggttattcttagccccattttacagttgagaaacctgaggctcagggattgcacagccagttggcagcaggcagggattcaaatgcacacatctgtttctaaagtctgggctcctaacagcgtctgtgacattcagtaaatggaagccgctccttttgagtcaccaccttcccaaggggtagagaaaataagttctgataggaattcttgctttccaaagaaagcaattatctaactttgccgtattgcaaaatccagcttactccatttcttgacagaaatgagcacctgttggctaagaagaaactgcttcatattcacctcttcctttaatccagtgttaaatgagtccatgacctcctctctccagtcagctgtgaggttgtttccatagtcccatacctttggttgagagacggagagtagaaggggagtttatggctctgctgcctttgttcatgagaatcaaaagtgtcaggtcagattcgctgattcttggggctcttaatggagtggatgctggttctgaaacatcagctaaacaattttatgattctttgaccctaattcttagtctcaatgtcaataaagtggttcagatgagagggaagagttcaaacataagcaaacaagaagcctacgcatgccattttgcagaagcagatatttcag

SEQ ID NO: 24190 - DNA, 1024 bp, Homo sapiens
caatgtagcaggcaccattaagagtcactcacatgcgttaatatgtgtaggcgcatagaaccgtgcctggcccagagcgaggctgttttatatttgctctccttatccttatggatcctatgaagtacatagttacccagttcacagatgatgaaactgaggcacagagagattgaataatttacccaaggttccacagccagacagtgaagagctgggatttgaactcaggcactttggctccagagcttggtgcttaaccactcctcagaatcctatacgggacacagtaaagctgaatgttctcagagtgtggggctcagaaagggagaatgaggagctgagaggtggtggtcgctcctcgaggaagaggcggctcttgaggtggaggtcgggacacagggtagtcagggggcaggaggctgtgggccccagcagcaacgcccctcttggtgtcaggccaagcacaggctggcctgctggggtcccctcccatgccccttgtgtgactggggattggagagccattgtaagggggatgagagcagccagaattccttcccacttctcaggctgtggggcttcaagtctctctctgtttccttcacactgccaacatctcagatgtaacagaagctcatgtgatagattttcgtacagcaatttctgatgaaatagcctagaactttctttaccaaattggcagagaaaaaagagaataaaatagctgaaagtgaaagtgattttaagatgagaactggcaggcgcggtggctcacgcctgtaatctctgcactttgggagactgagctgggtggatcacttgaggtcaggagtccaagactagcctaggtaactcagcaacacccgtctctacaaaaaatccaaaaattggtcaggtgtggtggcgcatgcctgtagtcttagctacttgagaggctgaggtgggagaatcgcttgagcctgggaggaggaggttgcagtgagccaagatcacgccactgcacctcagccagggtgacaga

SEQ ID NO: 24191 - DNA, 1044 bp, Homo sapiens
gcagtgagccaagatcgcaccactgtgttccagcctgggcaaagaaggagaccctgtctcaaaaaaaaaaaatttttttgcaaagccccagctctctcttgtggctcctgccttttctccaacattgctcttctctatgcaaaacacagctgaaacaaaggaaacagaaaggaaaggatcaaatatgccctgggtaaggtaggcagtgcccctgccaagaagtgggcaggattatcacggtgctctcctaggaacccagccacctggctattcagaacacattgggtcaagcacattgtgaagagagaaaaataagagtctgaaaatagtgcttaattagtgggagatgattcctcatgaatgtgcagaaagttattttcccctcaacattccaaagccatagcctgaatgttttggatgtttatcacgattgggacttaacaactttattcttcctggagcgaaacctcatcactgatagtttcatatcttctcagacacctgtcagacttgtttttcatttgtttcgagaagtgccgagaaagctatttgtcacttccttgtggactattagtatgttttcctccagccattgcaactaatttatcataagcaggtcgtctctgatgagaatacttaattgttctgatgactgagctggtaattcagtggaacagagccagacatctttctccagctctttgtattcttttgctgttaactaatgctattaccatttctgcatcttccttgctccttcctgagccctttgaaaaaagttctctaccacctgagatcttcctgccctcatagtcatctttttctcctcatcatggctgatttgggagctcacctttgtcatcagacagacttggaagccaaccttgggtgcttccaaatgaggcagacatgattcattctgagtcccagggactctcctggttttggaatcccaagaataccagcccaagacaaaactttctcagggtctttgaagttacagtgtaatgaaagtttcaggacgtgataacctgtggactgttt

SEQ ID NO: 24192 - DNA, 1033 bp, Homo sapiens
aacaagggattgccagctgctgttatttctagtaccgtttacttctggatgttttaagtatttaagtgaagtgagcttgcttgatgggttcatagcgctaactactgccattcatcatactcaagaagcgacctgcctgcacacttcaggcccctgctctttaagcatagatgaagtcaatagcattgaatgatctgttccaaaaacatgtcctgtcttaagacatgacatttaatcaaatttagtattttgattgaggacttcagaaagtggattatgcatcttcttgtcctaagtgttatgctaattgctgggcattgcacactggtgggaaaaaaggattgttactgcctagtttaagggttggtttaggctggttttaggaggacataccatctacagtaagtcttcactgagctttaagcacactggcctactgtatgctgtaaaaacttggttttgttacataagacattgcttaaagtcagtttccaggagcctatcatcgacattgaggatttctcacatgtacctaatttagttttgtgctcctttaatttgttcacttatgtttgaatcgtaggggcttcaagaagcgtgcacctcgggcactcaaagagattcggaaatttgccatgaaggagatgggaactccagatgtgcgcattgacaccaggctcaacaaagctgtctgggccaaaggaataaggtgctaaagttatctgtattcgaaggtgaacttttgcaatgacaccagcttcacttaaccctgcaagagcccatatcagttcagtaatttggttaatgcatgtggaagtataaaaaaaaaaaatactgtgaccgtgacttagggtgtgtagtatctgcagggaagccccttaatttagtggcttatgaactgagacccaagggaaggagccagcagtgtagggtgggaaagagcattgcagagagaggaagcttggcaggatctgggagcggggtggtgaacgcaggtaaagtggaataaatcactgtgagcccagtggaggag

SEQ ID NO: 24193 - DNA, 1014 bp, Homo sapiens
catttttagtagagaggggttttaccatgttggccagggtgatctcgaactcctgacctcagatgatgcacccacctcagcctcccaaagtgctggggttacaggggcaagccaccatgccgtttcttcatattttaatgtaacagaaaaatcacgtaacaaagtttctggtgatagacaaaagactaacacatttggaccatttggacccagatatctgcttaggattaaccggttgggtatcaatggtggctaccttaacatgtcttcaaacaagcatccctcctgtggtaacagcatttaatgttcacctgggggttatgtttcattttccagggaactgtaagttctaggttggtcagagtagagcaaaggacagcattagaagcaggcatatgagatatgtgaatacagctagtggctgcttggttgaaaggaggcattgacttcagcaacacaattatgtttttattaggaatgtgccataccgaatccgtgtgcggctgtccagaaaacgtaatgaggatgaagattcaccaaataagctatatactttggttacctatgtacctgttaccactttcaaaagtaagttctccatcccataaagccatttaaattcattagaaaaatgtccttacctcttaaaatgtgaattcatctgttaagctaggggtgacacacgtcattgtaccctttttaaattgttggtgtgggaagatgctaaagaatgcaaaactgatccatatctgggatgtaaaaaggttgtggaaaatagaatgcccagacccgtctacaaaaggtttttagagttgaaatatgaaatgtgatgtgggtatggaaattgactgttacttcctttacagatctacagacagtcaatgtggatgagaactaatcgctgatcgtcagatcaaataaagttataaaattgccttcatgtttttgttctttttagttgcaacataatgtacttgtataccctatcctaattatgggatcatttgaagagct

SEQ ID NO: 24194 - DNA, 1942 bp, Homo sapiens
gttgttgtcttctaaaataattaattgatttttggtgagataaccagattcatattttaagccttttgtaatggccccgtggtacctggagtcaaggttcagaagtaaaaagttccttaaggtatcaataacaaaaatttgtattaatagttcagtcctaaagcagtgttgctgagattatgtttcaccagcatttacaagctgtatgttaaatgctgccataaagaggtctctgaagccgtagggcacacccaaggcagggctgagaagtacctagtagtgttgcaccacccaaaaaccatggatgggcagcagcaacatctccagcttacccattcactgccacagtctacagcttaagacacttaactacaaggtaaaagaaaaggaccaagtaaatacaaaaagtttcttattaaaaaacttggaagccaacattgaaagcatggtttgtacacaacaacatttttggaaggacatataaagtgaatacaaccaaatatattaaaatggtttcaattaccagcattgaaacagtgcaaaaaaaagccaaatacaattgcacagatagtggactcccttagatcttgaaagtgaacttgattcctgacctctcccattgtcactccaagtgaaaaatgaaagcatggggcttttcttgcttcttggttagtatgagacattgtgttcatctgagagcaaaatcaacactagcatcacagcagaagtgcccatttcagcaaatccggtaaaaattgtaagttggcatcaagggaaccaatggataccttagggcactgacaattctcaatacatagaaatgcttgagggttgtgtcggttcccctggccacagtttgtcaggttgtttagccagatgccccattggtaaggtagactgaaatctcggtttagggctgaccccaagaaacagtctggttcgtgctttggtatggtggactccagtgtgcatagcagctgctgtcttgctacaagttactcagcttaagttcagattgtgattggtggctcatttcaaaagttttgagattgtactgattgatcttggcattttcaagtttggatttcatgtccagtggcttttcaaaaaagttgactaatgactgttcagtcagaagtgaagctaaaatatgttcaagggagacagtccagtccctttctgccgcctctggaaatgcctgggagtcctggggcgtcttcccagtgtctgcaaaaaccgagtcctcaggagaaggagctgaagcccgcagctcctccccacactcctgggagcagcttccagagctgctgcctcgctgccccacctccccgatctgcagcagcagtgtggtgactgtggcgatggcttgatacaaatcattttcttctggatcttcatggaacatactgtacagagttttacagaactggataaattctctctgaaattgaaataagtcttaggtagcagcagaaccagggtggaagtgtcatttttttttttaaacatacctgtgagctttgagaaaacgacacagtatttttgaagacacagaatataagaaaaggtagtctctgcctttccactctaaactattaacagtggtgattcctgggaatttcagcacagacttggaaatgggtagaccttcctagaggatgtgcacaccctttaacaaagcaattcaagaaaccacagcaggctgggcacagtggctcccgcctgtaatcccagcactgtgggaggccgaggcaggcggatcacctgaggttgggagtcagaccagcccaatcaacatggagaaaccccatctctactaaaaatacaaaattagccaggcatggtgacccatgcctgcaatcccagctacttgggaggctgaggcaggagaatcgcttaaacccaggaggcaaaggttgtggtagtcaagatcacaccattg

SEQ ID NO: 24195 - DNA, 1104 bp, Homo sapiens
taacaattatcggggatgacagggaaggttccccatattttaaaaagtttggaacttattcgtaaaccatttcactgaaaataaatcaaaggcaaaattcagctgtgattcaacaagcttccacaagatggcagcaaagctttggaaagctacccttactttttccaactttgcccaaaacgaattttgtgcagtggcacatgtaagaatccactcaaactgaacaggaggaaaattgcaaaccgtgaatggtacctggggcagtcaggatggaaatggatttcccagaatagtgctgggatgccaaagaacttggcgtaccacaaagtagaaatgtgtatacaagtcaccaacaaaatgtgatgggagccatagaaaggcagcaattaatccagggggtgggcaagtgtccagaaaggaggcaggtaaagtattaacagtgacaaggagctgaggggccaaacaactctcagagcagagcctcccaacctctgccgtcacagcatatgaagagaacgtcacctggacatggaactcactgaaaatactcattccacgatctattgatgatcagaaggataggatattatgcattatgggaaatagtaactactaagaatgcatacagtctttaaaaatcctttcaatctttttacatgagatatttgggctgtttaaacatgaccttatttttcattcctatatatatgtagcctgtaattcaagcgtctaaatggattgacagacaatttctattaaagtgttcattgtgtctcacttcaagtactacccaagttaaaataagataaaggatttacatttggtcatctgaaaccctcatctcagacttctgtttgaaggtagtaggtaacttcattgctccaacagataccaccagcaggaaggtctctcctttatagccttagggaccttcattacacactgtacatggtttctattttctatatcattgtcattgccactgccatcttcctcactttctaaatgggatgcctgtggaggcgacaagccagttccaccataagtgtcttctctgtagtagaattcacatatggctttgaacacaatctggccttcagatgc

SEQ ID NO: 24196 - DNA, 1046 bp, Homo sapiens
ttttatagagtcatgtgtcaatgagaggaatacgttctgagaaatgcatcattaggtgattttgtcattgtgcaaacatcatacagtggacttacacgaacctagatgctgtagcctactacacacctcgcctataaagtctgttgttcctaggctacaaacctgtacagcatgttactgtcctgaatactgtaggcagctggaacacaatggtagctgtgtatctaaactatctaaatgtagaaaaggtgctataaaaatatggtataaaagaaaaaaaaatggtatacctgtatagaccacttactatgaatggaggttgcagggctgtggaagctgttctgggcaaatcagtgagtagcgagtgaatatgaaggcctaggacattactgcacactgccatagactttataaacacttaactgtactgagttcattttaaaaatattcttcttcatcttcaataataaattaacctcagcttactgtaactttttactttataaactttttgactcttttgtaataacacttgccttaaaacacaaacacattgtacagctgtgaaaaatatttcctttatattcttattctataaacatttttctatcaaaaaaatctttttaacttttctgttaaaaaccaagacacctaagccaaaagaacaaagccagaggcatcacgctacgtgacttcaaactatactacaaggctacagtaaccaaaacagcatggtactggtaccaaaacagagatatagatcaatggaacagaacagagccctcagaaacaacgccgcatatccacaactacatgatctttgacaaacctgagaaaaacaagcaatggggaaaggattccctatttaataaatggtgttgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaa

SEQ ID NO: 24197 - DNA, 1047 bp, Homo sapiens
tttgagacggagtctcgctcggtcacccaggctggagtgcagtggcgcgatctcagctcactgcaacctccgcctccaaggttcaaaccagtctcatgcctcagcctcccgagtagctgggattacaggtgcccgccaccacacccagctaactttttgtatttttagtagagatggggtttcaccgtgtcagccaggctggtctcgaactcttgaccttgggtgatccactcgccttggcctcccaaagtgctgggattataggcatgagccactgcgactggcccaaaatcatattatttaaaaatcaaaaaggactagccagatctgtaggatacagaaggaactaataaccctggctacctgtggggagggccccagaggtggaagtgagactttttattgcatatttttaatactttctcaattctgaaccacatgaatacattaacaattttttttaagttttttttttaaggtgagttgaagtcttgggaatagactgaaaactaacaaaaccggccccatcgctgaggaccaggtgagcctcttcagaatgcatcatttccacccatactaaatgactacatcatctctttggacatcccaattcacaaaagtctgaagtagttcccagtaactgcagggttcttgaccatttcaatgtcctctgtccacaggatgggacaaaaacaagggcagatgctgtagtctgcaagctcatatcctcaaagagaccaaaatgccatttataattttactgtcatattcactgcagccatgttatttaaatagtcattacagaatcatgaaaataaccacaagaacttttaagtgtgaaataaaggtctcataaatttctgttccttaaaacccaaggtacaccatgaatttctatgtatattcatgtagactgtcacatcaacatcccataaaatgcagaagaaaatggttgtaatgcatatgccaaggacaaatattagtttacatagaatgccacaggaaaacaaaccactataaaaataggcaaaggatatgaacaggtga

SEQ ID NO: 24198 - DNA, 1051 bp, Homo sapiens
tagagacgggatttcaccatgttggtcaggctggtctcaaactctggacctcaagtgatccacccgcactggcctcccacagtgctgggattacagacataagccaccgtgcccggccagaactgtaatttgaaaaaattaaaaaagctttagcagtattgactaaagttgaatatatacgtcacccatgacccaacagttccacctcaaggaacccattctacagaatcagcagcactggggtccaggaaatgcacaggtgctcagtgtcaagcagcaacgaccggaagcaacacaaatgtcactcaagagatgaataattaaatatatcagagttcggccctacaaggaaactgcaatcactaaaaaagtatgagaaaagatctatagattctcatctagaacaaagttcatcatacatggtcaactgaaacaaacaaacctgcaggtattatatataccataatctcacttctatgtgggaaagaaaagtaagtgtgtgtgtatgtattgtaggcatgtgtgtatttatagatagatacaagagggaaaattctggaaagatacgcacattgttaaccgtaattatctgtacagggagggtaatacgggcacaataggccctttttttttttaatttttatttatttattttgagacggagtttcactgtgttgccagggctggagtgcagtggctatgatcttggctcattgcaacctccatctcccaagttcaaacaattctcccgcctcagccacccgcgtagctgggattacaggagtgcgtcaccacgcccagctaatttttgtatttttagtagagacaggttttcacgatgttggccaagctggtcttgaactgctgacctcaagtgattcggcctcccaaagtgctgggattacaggcgtgagccactgcacccagctactttcctttcttgcttagaagctttgtttttcttttttcaatggtaagagaaaaaaatggttttttctttttttaatggtaaggtataattttatttagctttgtgtctttcaattaaact

SEQ ID NO: 24199 - DNA, 1029 bp, Homo sapiens
acgctccacaccgtcaggttggtctgcgggtccacgtactcgatgtttaccacggccgagaaccactcgagagcccggccccgggccccgggcacgcacagggccagggcgagcaacgccagagccaacacgccgcgagccccgacgctggcttcgcgccgccgccacgccatggcagcaccgctgagctgactagggggagtcagggtcacgcgcgagtgcggtgcagtcgaagagcagagagaagcggacacccaccgccgccctggaagactgaggcggggtcggggccgctgcgcacgcgcacctggcggagtggacgaagggcgtgatcggccctggctccgcccccgtccgaccggccgcgttgtgcgcaggcgtaagctccgcggagcctcggaccgcgatccgtcccgggatctcaggcgcctgtgggccgaggcggggcgcgcagcctgtaccacagcttgcgccacggcggaccctgtggccaggggccaagtttgcgcaataggacgtctagcacccccaaagtgaagggaagtaactccagagaaacgggaagcttccctgaaagcaggtgtgggaccgcagttctgtaaaatcgctgaacagatgtttgtggagagtttattgtgcaaggcacatggcagaggccttgtctaagtcgtttcaaagttaattagccaagcctggtggcgcccaactagagttcccactcgggaggtcgaggtgggaggaccacctgagccccggaggtcgaggctgcagtgagccgagatcaccactccacttcagcctgggcgactaagcgaaaccctgtcaattaagaaaaaaaaaaaatccaaatacattttgtgaaaaaaaaaaaaaaaaatccaaagctacgcacacattatccaactgccttttgctactaatattatgatgctaattgattccttacagcttaagtatatttacaacagccctttttgttatagtattttatgcataatctataattttgaaataggcataagcatacaa

SEQ ID NO: 24200 - DNA, 1035 bp, Homo sapiens
taggagagcaaacgaagcttatctccttccccaaattgttgataatgaaggcgaaaagagatatagctacaggtaaactagattgaatctgctgtttatgtgttggaagatgacgtttgaagatgagttttagttcttagcaccaatacaacaaatgatgggatttgaggtttaagtgcctaagtttaaggctctcatataataactcttaatttctttttgtgtcgggaaaagaacaaactcttgccttgaattaaccagttattttaaaaaatcatagacttctgtcattagaggaaacggcctgaactccattaccaggtgactttttagctttagtgggtggcacatgggactgtctgtggtgtgccatctgcagtgcgcaagccatttgtttctggaaacagtctcacaagcaatgattctggtgagtttagaaatgaatcaggatgtgctaagctcaatgaggactcattagccttggataatgtgattctataaatgaacagaatggagacggtgaagactcaggagtatagagaaaataggatgacactggaagctaggctgattggtgggagttttggaatcaatgtgcttcaactattagttgattaagcatatagttgaattagtaaagagtgggagacttgccccttgactgtgtgttattaaaaaaaaaaaagctatcttggccaggcatggtggcttatgcctgtaatcccagcactttgggaggccaaggtgggcagatcacctgaggtcaggagttcgagaccagcctgaccaacatggagaaaccccatctctactaaaaatacaaaattagccgggcatgatggcacatgcctgtaatcccagctactagggaggctgaggcaggagaatcacttgaacctgggaggcagaggttgcggtgagccaagatcgcgccattgcactccagcctgggcaacatgagctagactccgtctcaaaaaaaaaaaaaaaagctatcttgagtactgacatggtccaccatctcctttatgtaca

SEQ ID NO: 24201 - DNA, 1054 bp, Homo sapiens
gtcagtgaggttgtcttttgattgtaattgcagaactccctaaagataaagccaataatatctgaaataaaatggtttttgtccaacatagattaccaagtaaatggcctgtgagtctgtgttttagactcttaaaattttggggggaagtatatacaggttaatataaaatgaaagagaaataggcaattgcctctttatttggcatttagctctcatgttaaaaactgtgaaacagaaagaaggtggtaatggtcgggcacagtggctcatgcctgtaatcccagcacactgggaggctgaggcaggcggatcacctgaggtcaggtgttcaagaccagcctggccaacatggtgaaaccctgtctctactaaaaatacaaaaatcagccgggcatggtggcatgagcttatagttccagctactcgggaggttgaggcaggaggatcacttgaacccaggaggcggaggttgcagtgagccgagatcacgccaccgcactccagcctgggtgacagagcgagactccgtcttgaaagaaggtggcaagaccaaataaggagcacactaagggctccagggagaaaacgtgtagcatcagaaagttagaaggttgtcatggcttgctctcattaaataactgaggaaacacccaggttacctctttaagtacaggctaagtaagtaatctccctatttcccagtctagaatgctcttgaagcgtggatcccaaagtacagattgtcatagcatatttctctgcagcatgctagcaagatttttatcagtggttcctctcccctggggggcttgttagacatagattactgggccccatcccacagtttttggtccagtagttctgaggtaagactgagaatctgcatttctaacaaattatgaagcactgctgaggctacttactggtctggagaccacactttgagataaaattatttgagataattttaatcacctgggaagctttcctctcaacattttattatgaaaaatttcaaacctatagtaaagttgagaggtgtaaaatgaat

SEQ ID NO: 24202 - DNA, 1050 bp, Homo sapiens
aagttagtcattatgacaaaaccatgaaacacagatgataaaccttctagtaaaatttaatcttttgaaattatttgtcacctgggagagctgccattctgacacttagtgctttttaaaatcagtcaggtgtgtatgtacttctgttggtcagagatggtgagtgggtgtgtggtttctgggagacctgaaaatggggccagagctgtgggttttctgcagctctaacaagctgccacccttattttggtgatgaggcttgtgcccactttttaattttttgattaaattgtgctgattacatggttccaaagaacttagggaatgcacagtattgctccagattacttgtcagttaggatttacctattgtgagatatatatatatatatatatatatatatatatatattttttttttttttttttttttttttgctgttagtcattgttgtctcatttgatggatcagagtgtgagattgggaaatgttacgtattaatatcaggaaaagagacaggcctggagtaggtctggaggtagggctgcttagtgttttattaaccatgctgatgaatgcacacattcaagataatctgttccctttccattctctgccactccttttgaattgctcaaggctgggattctatgtctggaacaggtgactcagatgaaataaagtttgaaaaggaaaaaaaccctgtcaatttctggttactcattatcattcagggtccagattctgccttttctctctactctctcccccctctttctccctcacttaggctcctgtcacctttaactttctcaccacactttttaaaagttggccaggaatgaatggaaatggtgaggaatgccatgaattaatatttattgatcctctgttctgtggcaggctctggaagtattttgagattcggagaggttacctaacatgctagcatcatatggcttgtaggtggcagggctgtgcttgaatccaagattgactcaggacctatttctggaccatgttgcctccagtgctttctcatcctggtt

SEQ ID NO: 24203 - DNA, 1032 bp, Homo sapiens
atgaagaaaagttcgaatgtttaatattatttacagccatttgaaaagctggctaatgatcttagagtaagtttctgaactgctattttagcagcttttaaatggttcttttgagtagtaaagccatattgacagcacaggcagagggtttctaggatttcgtatttgagcagtgcatgtaggatattaccagtgagtctcttcatttggctatcacagtttttctctctacttcatccctgaattacacacagacattacttggttgcatttcatttacctaccacatttaaaaaaaaagattatgaagttaaattgaagcccaattcttaggcttcccccactaataaaaaaacttaaagtaactaataagttattttaatttttttaataagtaaagttatcccactttttatatttaagattcatagaggattgcaggtttaaaaactgccatctagacttcctagagaaatgtttaatttttttttatttagatatttatgtagtctttgaaaataggcaattcccctaagaagactagttgtgaagggtggggtagggtgacaggagaaccatctttttataaacacttgcaaatgtcattaaaatgtcaggatcttttatgactattatagaaagcagagcctaaatgtgggaaactaagcttcctgccctatactactgtaaaggaagtcaggtactgggccagatgcatttattctattaataactaaaactgtttagcatggtaggcaggatagaacattggttgagtggttggagactagcataagtcagacctgggtttgagtcctacctctgctgcttacctatatagcacaccctatgttattcaactttcaggacttactttctcctcatctatacataccaaccctttgaaattacttttgttaggagaattcaatgagttagtgtatattaatcatctaatgtaacgtggatacatagctacctatcagtaaatatgaattgttgtcattgttctttgttttaaacacccactcc

SEQ ID NO: 24204 - DNA, 1113 bp, Homo sapiens
aaaaaaaaaaaaaaaaaaaaaaaaggaacagctaggactgaggccagggctgtgtgagggtgagtgggtatttccatgggaccagcagttttttgagtcccaggagagctagcagatgggtagctccagagaggagaggatagaaaggaaagaggaaagcaggagagggtaactggacacaattaaaagaggatgagaagagagactactagaataggtctgaggactcgtgttctttagcaactttgcactgcttgaagattaaaagttttcacactgcaagttaaacttcgcataaatggacaatctttggccactaatagtttagaaaataggagtttctgaattatctaatttttgcatttgttatgaatttgtgtagtaactagaaagagtctcccatttcctcctcctgttcattctttgggggagacttttctcgtgtaggactctattttaaaactcatttttgattataatttcaggtaatactttgaattacatgctttatctctgaaaatcttaaacattttagaagtctaggattataccaatatctggtattatacaaatctcacctgtatattgtagaaatcatacaatagaactaatttcacatcttgtatttggaaaggttgaacaaattgattcagtattttcagtttatgtcaagtacattgatgtaatagatatgtagctatcattttttcagttgccatattgaacaatcattttagaacagtaaaacataatttaatgaaaatattttatggattttttcagagatcattttcccaatttagaagcaaccagataaactcagttgacaagtaattgtcatatttttgtaatttcccaagtggaaggaataccccaacaatagtcaattcagggaatccatggtactgaatatttttaaagaaatcacaattctttattttcatcactaatatgaaagtatatggagatacctgggttatgggtgtttgtagacttgggaaaaataagaaaaattgttggtatatttgaaaaattagctgttcttgagatattatagtctcaaaacgtggggtttgtctttgctcgttgaacgtgccattttgttactcgctc

SEQ ID NO: 24205 - DNA, 1045 bp, Homo sapiens
acagtatgtgttctagtgtcagctgctgcttttttttttttttttttaagtagactttttctaaacgttttttcagtattttgcagtttagccattctgaaggggtgtaggaattaataggtgtatctcattttaatttgcaatttcctaatgatgtatggtacatcttttcttatgtttgtatatcttctggtgaagtatttcttctatctttaatccattttgtaattggattgttgcttgcttattgttgagttttaagagttcttcgtgtattttggatctaagtttctgatgagatatgtgttttgcggatattttctgccagtttgtggcttgtttgttcatgctgtggaatgatgtcttttgcagaagagaagtttttattttagtgaagtccaacttactagttttttctttcatgaattgtgcttctggtattgtatctaaaaagtcattgccaaatccagagtcacttggattttcttctgttaccttctagaatctgctttacagctttgtgtttcacatttaggtccacaatccattttgaattgatatttgtgaaagtttcaaagtttgtgtagatttattttcttttgcctatggatatctagttgttgcagcagcattcattaaaaagactaacctttctccattgaattgcttgtgctcctttgtagattactgctatatttgtatagttctatttttttttttttttgacacggagtctcaatctgtcatccaggctggagtgcagtggtgagatctcagctcactacaacctctgccttccgggttcaagcaattctcctgcctcagcctcccgagtagctgggattataggcatgtgccaccatgcctggctgatttttctatttttagtggagacagggtttcaccatgttggtcaggctgatctcaagctcctgacctcatgatccgcccatctctgccccataaagtactgggattacaggcgtgagccaccgcgcctggtgtatagttctatttctgggctctattttttcccatttatcta

SEQ ID NO: 24206 - DNA, 1018 bp, Homo sapiens
gaatgtgtcagcacgtgggttggcaactactgcattagtgttagcagtaaaaatggacaagcacgtgatgatggacaacactggtaagatttcttgattattttcttttcctttttccctttcttttctagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacaggtaacacatataatgctggaatttcttaccttatgttctcattaagaaatcagataaataggcattaatcttcatcttattgtgatgatattgtagaattaatctgtgggagaggttttctatgggaaatattgttctgcctgtaccatccattatgaatgttgtctatgtcttcttttcttgtgcttacttatgtgttgcccaaaattgttctgattgtctcgtgtatgtatgtcatagcttcctaaatgccctgggagatgctcgggcccaggaactgtatatctgggtgtctttgtgcatgcatcacttaggtatctttatagtacatacactcaataaagttgctttaagttagattgaattgtcctatcgctcattatttcaacctggcaaaggaggcttacataatggacgtgtaagaacccccagctggccgggcgcggtggctcacgcctgtaatcccagcactttgagagtccgagacgggcagatcacgaggtcaggagatcgagaccatcctggctaacagagtgaaaccctgtctctactaaaaatacaaaaaattagccgggcgtggtggtaggcgcctgtagtcccagctactcgggaggctgaggcaggagaatggcgtgtgaactcgggaggcggagcttgcagtgagtcgggatcgcgccgctgcgctccagcctgggcgacaaagcaagactccgtctcaaaaaaaa

SEQ ID NO: 24207 - DNA, 1047 bp, Homo sapiens
cgtttcctggaaatccttctataagagaagacgttgattctccatcctgaaaaatgaactggtgttggctaggagcgtagggagagaaatggcatttcaggcagagggcacagcctgggcaaaaactccggagtgtgagaaaggacacagcgattgcttaaggaatcatacatagttttttataattatattgcaaactgcatgtgcacatatgataggagatgaccctagaaaggagggttctgtcacatcataaaaattcccagagatccagctaaaaagcagtttttctaagaacaagggcaaccaacagagaatgctctaaagcactgagcctggctggatattttggctgctcttagttttgatagtttatccatctcttcaggtagtcagtcagctatatatttaacaataaacactaaatacctaatactgtctaggcaataattaatagtcattgtgattatgcagtaaattctggatgtattattgagcaccttgtagactttgaacgatgccgggttctgtgagcccacagacatcagacacaatcctcatcctcaaaaaactgctgcaatatcctccagcattcttccactctgatttctaaataagcaaatacatatcatgggttcctaaaaataatttttgtctagttataaaataatgcctgttaagtgtagaaaattttaaaaattcagcaaagcccaaagaaaatattgtggttaagataacactagatgctgtaattgatgtctaatactgtcatagataaatctaatacgtgtaatgtcttaatagaagtttatttcttgcttagtccaatgtgagtgtttggccaagtgccctccatgtggaaattcaaggacccagtctcctgtctggtggcactgttatcccccagggcctcagagttatttccttctctctggcagagaggaaacagggaaggagtgtgggagagacaaagctgtattcaccagatcccatatcttattccttattcctggaaaatgatacttctctgtcctttatgtggtgtta

SEQ ID NO: 24208 - DNA, 1045 bp, Homo sapiens
tttccttctgttttaaggctgaacagtattccattttatatatgtatatatacagcacatttctttcatccgtttatctgacaatgaacacttaggttgattccataacttgaatattgtgagtaatactgcaaccaacataacagagaggatatctcttcaagatactgatatcacttcatttgaatatttgcccagaagtggggttgctggatcatatggtaattctatttttatttttctgaggaatgtccagactgttttttataatgactgtactattttacattcccatgaatggtgtacaaatgttcccttttctttacatcctcaccaagacttggtactatttgtcttttagataatagccatcctagcagatatcaggtgatatctcactgtggttttgatttgcacacacctccctggtgattagtgacattgagcactttgtcatactttccgcccatttgtatgtcttcttttagacaatttatattcatgtcctatgcctgttttttaattgagttctttgtttccttgttattgagctgagtcccttctatattttggatattaaacccttgtgagatgtatagtttatacatattttacccattcccttcactctactgattgtttcctttgtagtgcagaagcttctcatttgtccagttttgctttgttgccaatgctttggagatctaatccaaaaaaaaaaatcattgcccattgcgatagtttgctgagaatgatggtttccagcttcatccatgtaccctagaacttaaagtataaaaataaaaaaaagaaaaaaaaatcattgcccagaccaatattaagaagcttttttcaaaagttttcttctagtagttttgcagctaaagatcttatatttaagtcttaaatctattttgagttgatttttgtgtatggtatgaaataagagttcgatttcattcttttaagctttcccaacactcatttgcccaccacagtttattgagataatcctttccccatgtgtgttattggtatttttgcc

SEQ ID NO: 24209 - DNA, 1060 bp, Homo sapiens
gttggccagagccctccctcagctcctgccacatgggcctctagggcaactcagcacatctggcttccctcaggctgatgaagaaaaggtaagcaagagagaagaacagcaggtggcagattcactgggagccatcttggaagctgcctacaacagtggaagacccacatatacttattttcttgttatctaagtgtctctctcatgtatttaggtctttcttctatggttcttatgtgtgggcatatatgggtacctatgtgtgtgcacatgtgggtacatctgaacacctgctgtatcattctttttgtcagataggattattagcttaaacaaaactgcatctttactatgttttgttttcttatctcattatagcaacattctcactttaacatcactcatttcttctttacaattatttctgttaacatttaatacagagcctggtctataataattgctcagatttgttaaatgaacttgtaaagtagtttatttttagaattttattctgcaaaaccaagcatataaaaatagaataatataatgaactccacagatccatcaaccagcttcaacaattattaataatttcccagtcttgtttttatttctcccctcccaccccccagagtcatttaatgtaaaccccagacattctgttattttacttataggtacttgaatatgcatctctaacataaaggtttttttaaaaaaatagattccttgccaccgccatatctaacagaatgaacagtaatttcttatcatctattacctatttcatgttcaaatttccctgaatgtcccaacagtagctttttgtatatagttggtttattttaattgggagttaaacagggtttatgcgttttatttgattggtaagtatgttaagtgtcttaatttataacagattatagaattaatgtaaatggtaaattttgtttaagtaagtggatttcttatttgtttaacatagtatccgtttccccttcatagtagtatcccagtttccccaggaggaattagttctttttcgctggttatagtt

SEQ ID NO: 24210 - DNA, 1028 bp, Homo sapiens
tggcttccggaagtgctgggattacaggcgtgagtcaccacgcccggctgcaatttttttttttttttctaagatggagtcttgctctgttgcccaggctggagtgcagcggtgtgatttcggctcactgcaacctccgccttctgggttcaagtgagtctcctgcctcagcctcccaagtagctgggattataggtgcctgacaccatgcccagctaatttttgtatttttagtagagatggggtttcaccatgttggccaggctagtgtcgaactcctgacagttgatccgcccacttcggcctcccaaagtgctgggattacaggcatgagccactgcgcctggctgcaaattgttcttaacagtggcaaagcaaattcccttcaagaattcttggtgtttttagctaaagatctgtttttttcacactcttagcctcaccttatttaatggattgtaccaatgaataatggactcctttgaatgtaaatatttttgtgtgaattcattgctggaataattctggacttttaataaacatattcaatatcctgctactgatgctgtgataactttgtaaatttaatattataaatttccagaatgccatactcttaagcaatgtgtagaaatgtctttgaaaaagatcctaaggactttttatgaaaaatagcaaattagggccatttttttaaagccctttctaaatggacaacaatgaaaatgtttataaatatgtttaaacctcaattatgttaaaagtaggaaagccaccaccttatgtcacaaactctggagactataggcagacacaattttaaatcaagtgaaaaaccaagtcttcaataatcgagactcttttgcttgagaagatgctaaaatgttgtaggagcaaaaggaacagtgtggaagagacagctgaagaaaatacaaagggatatttacctaacaaaatggaagaattattttaccacagctacttaacactgtcaaggacatttaaaaatcagttgagtgaggaggagc

SEQ ID NO: 24211 - DNA, 1054 bp, Homo sapiens
cggcagtttaatgagtttctaaagagttctgtacttactaaatatatgctccattttttcttttggaaaaagcatggttttttgcttttgttctgtggggtttttttttttttttggtgaccaaccaaccattgaacctaaattatatgtgtaacaatttcttaaagtgtaacgttagtttgaaacacctaacaactttgccaagttaaatttcataccaattttagaattgaatatgggaaattttaagctaccacttattttgggaaaatgccttttgttttctattcctgtggcagattttcttctgagtgaatttaaaactgaaagattaggacatcggcaaccttaaagagtaaggtgatgatttttgtatgtagttgagctgtatggacgtggatggtgaggatgtttgaatactaatgtgtttactagaggcaccaccaaaatctggttcttagactgggaaaaaggtatcttgaaacactaatgctaaaccaaatacaaacccaaatacctggctagcaggattgttttgaagcttatggaaaaaccattaactgagtcccaattgatacatatgttttcattttttgttttttttgttttttttttgtggaagggttgggtatttcttagtttaaataataatttttcatgaaggttggtttaggagtgaaaaggtgtttatttcagataattatgaaatttctgttaattctgtcatggttggtaaacttgtcccagtgggccaaaccacaatttggatgtgaaatgccaattttcctttaattgtaagatgcttgggggcccaaaccacttgctggcactttttttctagtgcctagtaagtgccacacacgttctggggccaatgaacactgacagtgaacagataggttaacattaacagagagtcttttcctcaccaccttcccccagtgattttctggttgacctaattttacctttcataatatttaaattttgcattatttttcatgctaatatagatgtttctgaatcacataacaggaaaactgctaaaaaaaaa

SEQ ID NO: 24212 - DNA, 1046 bp, Homo sapiens
gcccatctgtatttcagaaggaattacacccaacacctttttgaggcttttctgttgttgatgttttaaactctcggaggttgatgaccactgggttgaaacaaatgatgtagcatagaaaaatacattctttagttttcatttgtttacctgttttagattctctgaatgcactgcatttttttactttatcagttttcccttttaaaaatatgggagggagttatgtttatggccaaacctaaatttttttattctaacaagatgatttgggctattttataagcttttatttgaaacaatacagaaattctcatagtgaaatatttagtaatttttaaattaaatgtaaacattgttttatgttaatggtatgaaatatttaatatcctaaatatttgcatataaatatgctaaactaaatattaaaattctaaatgttggtgatttttttgtattttttattactcaattataaatgtgtctcataactgtggttaaatgcagctatttggtctgtctctgtgtatatttttatttgctttcatctggcttttttaaatcagcaatccagtggggagaagatggccgtccatttcactatctcttctatactggcaaacagtcatactattcattaatgcatgtaagtatattgcatttatgataaataatatgagctgtaagctacaaaactaattatactggatactgttcgcagcttcagaatttacctagtattttataattgacaaaaataagacttctagaggtaggacagtgtgttgatgaaatgatttatagtaattcatttttgctaaaggtgaactttatagagtttatatcagaatggtttgtctttaaaatgcttttacttagaaattgaaatcatgttccaagatagatgttcaactcaattatagtgtgtacatgtgcttccagggtaaagaaggaggaggccaagtgtatgatgctgtcgggggctgtgaggcatttgccttgaaaaagaatcaaatggttatttctcattttttgttgttttatat

SEQ ID NO: 24213 - DNA, 1034 bp, Homo sapiens
aagttctttgggtattttgtttttgtaagttattggaggtttccattttttcccattgtggtgtttgaattttcttttaccctactctgtgtaaccctgttacctgggcatgaatacaagagtccctgtgtaatgtgaaaaaggatgggcagttgattcttaccttagactactgctttagaagttggaataaattggggaagtttgagctgaagaccatcttcgcactgttgatgagaagaggaaagcaccatgtgtgctattggcggctgcatggtcgtgggcaagtcacttagcacctaagtctataagctcctcctctgggcaagtaggttggtctctgtgcaccagaccttctagtacaagccgctgaggttcaataaaaacactacctatggcttaggctacttaattgcttaaggctcttaaaaatccatttgcttataagcaatttgtcatcatatgggattcatatctagtcattgaagtaatttgctagaatcttaacaatttgatgagtttgagctactgtgcatatctgaaagtaataaagcattcttacttacagttgaagctagaacttaggtcttttctgtattttgtcaaatactgctgttttattccatgcatgtcctttaagtacaagcaagtgtaaatgttatgggtatatcataaacaaggttttcctttgctctatgtacattaaatggtccttaataaaatacccaagccttgtatacagtaggaggagtgctaacgttggaagagtgaaaaagacaaggaaaaagtatggtccatttacatatttataaaagcaatgtaagagctttcccatcagtggtattcttggaatctatggtctttactaacttactatagctccagccactgctggggctcttccttatgggccatagctaagagtaaccccagcagttgcctagaaacataatcactcctgatgattgggagaatgaaagtttcccgtttaaactgactttattcttctagaagaaactgcctgtgctgagaat

SEQ ID NO: 24214 - DNA, 1050 bp, Homo sapiens
tggacagctaccaggcactttggaaagttggttcagttactactatgaggccataatatatttgctggtattaaaattcttcagaattggaattactatttgaaataatattttggttgacttaagttttgagagacaattctaaaattgatctagagactcattcaatagcaatgtgaccttttaaatacttacattaagtaaaactgccagtagattaaatcatatatatatatatatatatatatatatatgtaagagcttcctctatttactactgttgaacttcagtaatttttagaggctaaataatggtcagaatgtttttaagtgtgctcttttattacatgcttgtgcaggttttgtaattcagtacagaaaagtttaaccttgtacatttttgtatgtaaaaagtcttttaagtagtcttatccttatttaaataaacagaataaaattaccttgagtaggtctgttattcttattaaaatggaaaaatgctctgtaatgacttgatctgtttttatttgagtgaacaattttggaaagtattctttatagtacaactttctatacctggattgattaagatcagatgtgattcgagtagtccagccatatcttgtagcccttctttgaatgagagggtggctggagtggtctggtgctgggatatcacggtgctacagagcctgacatgttgactgtcactacatgttgagggatggaaatagaagtctctgaacttcccatgtaatattaaagctcttaacaaaatgagacaaactagagattcagttgagagattttatgttagagtgatctgaaaaaaagttaatttctaaactgctatcttaatattattatatttggagactgatgctgtaaattaaataacttggaaaagactcaggtaactttctactttgtcttttgttttgttttagagatgaggtcttgctctgtcgcccagagtgtagtgcagtggcatgatcatagctcactgcagccttgaactccttggctcaagtggtcctcctgcttcagcct

SEQ ID NO: 24215 - DNA, 1044 bp, Homo sapiens
gttcacagcaggatggaaatggctagagtgtgaatgaacctggaacctcgaacctgattcagtgagcagcctctacaacactcactttacatactgcctgttgaaccaagttgtgatgtatctaggtagttttatgcactgtactaagtgctataattaaaacctacatgtagtttttttttgttttcgagacagggtctcactctgtcacccaggctggagtgcagtggtgcgatcctggctcactgcagccttgaacatctgggctccagggaaactcctgcctcaacctgagtagctggaactacaggtgcacaccaccatgcctggctgaaatcttcatgtgttacttgtacatcccatttagtaattgcctaaacctacgccatccattgtcttttgaataactattagcatttgatacatttctaccatttctccaagtgaactgaggagctctagagaactgaaacacttatgggtcacccctgccaccaccaagctggactcactgcaagtgctcggtgtctgttgactgacattttttcatttttgtttgccagaaagaagtgtatctatttatagtaacggatgattccagataggcgtataaacaagtacccttcatataaagcaaaggtaaagaacaatctggggaaataagtatcagggacaaagaaagaggaaagtgttgtaagtgcccggactagctgaggggcctggccactgtgtaagaccaaatccagactgctgcctgcttttcaaatgaagttttattggaacacagccacgcccattaatttacttccattgtttacatccgcttttaagctagacggccgagtagtgtgcagctgtgtgcagttgtgcagttgttgtgtagttgtaatagttgagtagttgtgacagagactgtatggtccacaaagccccaaatatttatctgatttttgaaggaaaaatgttgccaatccctggggactgtggcatgagggtcacatacatgtgacttcaactgggggtcagggaatgatggggaatcaa

SEQ ID NO: 24216 - DNA, 1024 bp, Homo sapiens
ggctgctcttccaagtgagttgtctgtgccagcttctcgaacctacccttttgtgttaggagggccactggggccatcagagtgttgagcagccctccctggagcagatgggactgagataggacggtgagtctggcgtctctgttgggagaagctcctgcatgttccaagtttcagaggggctgcaatttgggcagtttctttcaactcacaggtttagatttgcagtcacactacctctcatgtggccacttctacacgtagcaggttccaggatatgtggtggcaaagaattgtttacttcaacatgcttaatttcccagcaatggtgggggcagccaggaagtgagaagtgaaaagtaagttagaaagtggtgagatcacagggagatgcctagaaagacgcccatgcccatcttagaggacaaagtccatcaatgtctccttcgattttccttaacggttatgtctcccatttaatatcttaagaattttggttgcgtgtttaaggatgtctgcaagtcaacaaatattttaattatgtcacttatgagcctggctacaggagaggagagcagttgctgtctctttcatgctttccctctcatcagctgtcttcattttaaggacaatcactttaaaagcttgtattcctgtttgtgtgtgtctgtgggaggttggggggagctgctgcattggtaagaaagcagctcccccaacaactttttttttttttttttaaactgctctgcatgatggaagccagcttggagacattgacataaaaagcacaagctacttgaatatttttaagagaccaagaaataacaagggattcagggagttattttgagacagtttttgggaaatttaatataggtgaagagtgaattttcatcaaacgattaaaaaaaagtgaaacaaccttggttgcagaatctagcaagatggttatagaaacagattttttttttccagccatttccattctttctttccattcttctggttctcccctcacttt

SEQ ID NO: 24217 - DNA, 1005 bp, Homo sapiens
agcagtccctggccggcgtgaactccaagtcaggagtctgcagtggtgacgtccctcttgagtgtcctcaggtaggctctcccttacagggatgtggccagggacagggagaggctctagagttgacgtttttagtagtttttctaaattgtttatcttttttgccaacattccattttgggttttgcttgtgattgttaccttatttcacatgtgtgagtgccccctccctttattgaccacatagcagaatgccccgtccgtaaatgtcacgtttccatagagtactgctttccacttgggcccctgacggtgctcacagggaatgagtgggaaatgcagcagatctgacagtgagagcccagtcactcctcagtcagacttgttttatttagtgccttccggaatatgccacttatgatcttacccagaggttatgttgaagattttgttgtgttcacaaagaccaacgtcagaagtacttgggaaaggcagggatcccaggagccagagacaggactgtcttccctgcctggagtctgggtctggtacaggcctttcttgtgggagaagctaaatgtaaccgtatcttccaacctgagagctcatttagtaacgtttttgtaatacattggtcattttcccagtcgttaagtaccacgtctcggcggcgtgtgcttagaacagaggtctctggaggaatcactggggcgtgctcatgtgtgggtgttgtgctttcatggctgggttttaacttccggccttggttcctttggcagtgacatggagggagagggtagatgaagttgggtgtgtgaacttggaattctaaggacagtcctgcacaggcaggacagtaacacagacctggttgccatgccccacagaattcagtgggaaaacatgctcagcatttgtgggacaccagtgtcaccctctccaccactgcagtaagatcaggagcccatctcccacctgagtctcaattccaggaaagagcatcag

SEQ ID NO: 24218 - DNA, 1032 bp, Homo sapiens
aaataaattaaaatgtgtgtgaagtaatggtaagggccatggaaaaagagaaaacagaagaaaggaatggagagtggtgcggcagctattttatatgaggtggggcaggtttggcttggcagagaattggatggaatcagagaaggaatatgagagaggcagggagagcaagggaggggacatttgaatggcggcttgaacaaagtaacagaacaaagagtcctgcagagagctggggaagagcattccaatgcgaagaccccaaggtgagaatcagagtttggaaaaactgcccagggtcaaggtcttttaggctttggtgcagctttggatttggttctgtttgggtgggaagctgcactggggtttgcagagaggactgacacaaatacctttagtttttaaagttccccaaagcgagtgccaggagggtagaacagagagactggtagactggagaggtgctgttggtctggagtgaagtgcatgggagagaaggggtggatctgaggcatattttgaaggcaagtctgtggggtttgctgctggaaagaatggggagtgagagacaagagcttgagggatgagtctcagattgggggctgggtcagcccacttaatggttgtctaatacccacttactcagaagggcagactgcgggaggcacaggaggtagtttgtttatttgattggtttccttttgtttttcatggggagaatgaagagcttagttttagacgtgagatttgaagtgcatgttagacatccagatgcagatgttcaccaggtagctgggtgcaggagtctggcatttggggatagagcagggtggagaccaacatttggcagcaacagatggatgacactcaaagccaagagggcggatggaggggaggctcctagacggcctggctacccctccatctttagttcagaagcacaagtagagtgagccagaaaactaagaaggaagggtcagcaagggacaggcagcagggctgtgtgatctccgcgcagctggtggacggtgt

SEQ ID NO: 24219 - DNA, 1055 bp, Homo sapiens
cttgctagaatgcagattgccccagcttgctgacttcgaatctctggggtagggctctgcaaccttggtttgaagaagccctctgagtcctttttttgttccaaatcctgagaacctatgaactcctgaataattctgatgcgccaatttgagaaccactacgttgtggagtatgcacttgattcaagcccttttgcatactgttgtgtaatatggtaaaattctgacttaaatgtatcactcagtcacatcaggtatgacactatggaaagacaaagaataacaaggacaatattctacaggtctatatggtgaggtattacatgtgactttaggaaatacatttggggatagggagggctaaccacacacatgcatactaactggaaagtggacagggaacgctccgtttgcctagattaggtagatgggacttggacagctgctctgtagttgatgattgacttttcatttatgtaaataagattacttccaaagttaatgagatgaatatttgaacatgtcagtgtggattggcttcaggcctgtggagtaaatattttatagagtgaacattgataggagaataggaaaagctggtgagactcttcacacttggggcaaggaagagataatctgatgtaaaaacaaagaacatagggtcaactgacagctagcagcataagtataggcaggagtaatttttattaaaagaaggctaccttagacaactagggcaggtgaccaaatagaatggtaaaactgaaaggcagtttttctgagataaaaacagagaaactattaatcagtggatcacgatttgcctctaacccatttgttctcacttttgggaggtaaatgaaccacttctgtggacagaagagtgccttctgtaaagaagtaaaaggggaaaaacatgtctttaccaaaagaaaagaatgatacaacttgtgataagaaaccaacagggtgacctctctctgggggtagaaggagatgtgtagattattgatgcttggagacttcagcgtggctggagatcagtccagggtctg

SEQ ID NO: 24220 - DNA, 1034 bp, Homo sapiens
ccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctctta

SEQ ID NO: 24221 - DNA, 1873 bp, Homo sapiens
gcgattaaacaataactcccattctgccttgcccccagcccctagtaacttctgttctactttttgtctctatgaatttgcctactctaggtacgtcatataagtagaatcatatatttttatccttttgtgtcttgctaattttacttggcataatgtccccaaggttcatccatgttgtagctatatcagaattttgttcctttttatggctgaataatattccattgtatgtatatactgtacttgtttatccatttatctgttgatggacacgggtgattttcaccttttggctattgtgagtaatgtcacttatgaacacttgagtactgtgagcactggtgtacaaatatctgtttgagtccctgcttttaattcttttgggcatatacctaggagtggagttgctggatcatatggtaattctgtgtttaccttttaggacctgtcaaactgttgaaaagttaactcttatgttatttatattttcagacatagattggaagatggacttatgctttttctctttctctcctttccttccctcccttcctttgttggaggctgaaagaatgagggtcagtgatcaactcagtataccactggaggctatatgagtaaacagcaaactgttctcatgaatgcagaatgttagcaagctgacaactgcgtctgctgcccagaaggaatgctgagggcagtcatgccccaggcacagtgttgcttgtgattaggcaaatctgaagcctgttagcaataatgtgaacctgtgatcagtcaagcagctgaccaatcgttacctactcctccctgctctttctacccaataaatacaaaggctgtagaagctcagggctgcctttgctcactagaagcagggatccccctgaccccttctttaaaacagtttcttttttgttttcatttctgcgttcatccgccttcgttcagtcctgtagtaactgtcactacctacctacctttgttccttccttccttctcccctacccttgacatatagggtctcactgtgtctcccaggctagagtgcagtagagccatcacagctcactgcagcctcaacctcctgagcttaagcgatcctcccacctcagcctcctgagtagctgggaccacaggcgcacactaccgtgcctggctaatttttcattttttgtagagacggtgtctctctatgttgcccagactggtcttgaactcctgggctcaagtgttgctcctgcctcagcctcccaaaatgttgagattacaagtgtgagccaacacgcccagcctttttttcttaagactatagattttcattggttgagaggacttggtaattttaacatggaacttctgaactgaccattttataagatatcgaacatatgatcagattcatattttaccctcattaatcaaaaaatagtaggaacttttttttttttgagagacctagtcttgctctgttgccctggctagagtgcagtggcacaatctgggctcactgcaacctctacctcccatgttcaagcagttctcctgcctcagcctccctagtagctgggactacaggtacgtgccaccacgcccagctaatttttgtattttgatagagatggggtttcaccatgttgcccaggctggtctcaaactcctgacctcaggtgatccacctgcctcagcctcccaaagcgctagaattacaggcataggccaccatgcccagttggaattttctgtaaagtttcaaagatttaagtgaacatgattcttgaagttgttgatttgaaggtacccaactttgtgtgtgagaacaaattggtttatttctactaataagtacaatgttatctctatgatctgt

SEQ ID NO: 24222 - DNA, 1059 bp, Homo sapiens
gtgtgtagttcagtggtgttaagtatgtttatattgttgtgaaatagctctccagaactttttcatcttgcagaactgaaactctatatccattgaatagcaactcctgctttatccccagctcctggcaaccactgttctactttcaatgtctataaatttgaatacagcagattctcaaataatgttgttttattcaacatgattttgttataatgttgatgagaacaaaaaattgattcccagttgggaccagtgtctgtgtggggtttacgtgtttctcccatgtctgcttgggttttctcctggtactacagtttcctcccgcatcccaaagatgtacatgttaggttaattgatgttaaaatcgtcgcagtgtgagtgggtgtggctgtatgccctgtgacgggatggagtctcgtccagggttggttcccatcttgctccctgagctgctgggataggctccagccacctgcaaccctgaactagaataagcagggtggaaaatgaatgaataaatggacacacattattgtaaaataaaaatttgtaaagtatatgatcatcatacaataaatgatgatcaataaaacacgacagtaaacgatgtggtacaaaagcactcaatgaagatgccctgttttccttttctttgcttgttttttgttttttgagatggagtctcgctctgtcatccaggctggagtgcaatgtcgtgatcttggcttactacaacctctgcttcctgggttcaagcgattctcctgcttcagcctcccaagtagctggaattacaggcatgcgtcaccatgcctggctaatttttgtatttttagtagaggcggggtttctccatgccgttcaggctggttttgaactcctgacctcaaatgatcctcccaccttggcctcccaaaatgctaggattacaggcgtgagccacctcacccagcctgccctatgttcttgtttgtttccaaataacgtggtggcaggaggtgctacttgcaattttcactttgcaaacattgattcattgatttaaccaccattttg

SEQ ID NO: 24223 - DNA, 1041 bp, Homo sapiens
gatgttgtctcaaaataaaaataaaaaagataccatcatgaagtacttttcaacagtttcaataagcactaagttttctgggaatgccatgaaattataaattgagtgaaggatgaaatttgcttggactttatgctttattttcataggtggtactaacattaccacctatgaacattttgcccttaattgttcctttatattctatttagaaactcaaatcctttaagacaatggttagaatatattaaaaaggggtgttttttgttgtttttttgttttgttttgttttttagatggagtttcattcttattgcccaggctggagtgcagtggcgtgatctcagctcactccaacctctgcctcccgagttcaagcaatgcctcagcctcatgagtagctgggattacaggcgcgcaccaccacgcctggctaatgtttgtattttttttttttttttagtagagaggggtctcaccatgttaggcaggctggtctcgaactcctgacctcagatgatctgcccgcctaggcctcccaaagtgctgggaccacaggcgtaaatcaccacgcctggcccaaagggttttgtttttaaatgagagatggttagtaaactaatgttttcctgagtgacatagggcatatacatagagatgagcatatacatagagatgagtatgatgaacatttggggttataaatgactttcataacaaggacctatgaagagtatataaaggtggagacactgattagcacttgatagattgggtaaatcaagttaggtgaaattatcccagatttttttaaagtcccgggaggaaaagatacgcaagtgtattgggcattgaacaaattttttaaataaagatctatgtccattcagaatagtctgtggaaagcatttatcctgttattttgttgttgctgtttcttttttttttttttgagatggagtcttactctcgctcaggctggagtgcagtggtgtgatctcagcttactgcaacctctgcctcctgggttcaagcgattgt

SEQ ID NO: 24224 - DNA, 1030 bp, Homo sapiens
gcagccagaattttgagattaattttaataatttattaatgaatgcaccagcagagaagaggtgggaaggatatggtcgacaagtggtaggagtaaaaaattcagctgtggggaaggggtagcttttgcttagaaagttcaccacagacccctgccctctaagttatggtgaattctgtggaagtgattagagtggagaaaaaggaacaaagagggttggaatccagacgttccatgactaaccccaagatgactaaaccagctactgaatgcacccacagaaagggaagtgacatttactgagaacacatttagtgttgctgaacgcttaaaatgctttctttgtgttctcagtccttaccagtctgtgaggggggtttattttgtctacattacagatgaagaatctcacctgcaaatgaagaaagttggctggccgacaggagatcgtttgaaatgaaaggattccagggtttctttctactgagcgtattcaataagcagggcttattatactatctagaatggtgctatcctgtagaaatacaatgtaagcagcatgtgtagttttaagattttctagtagccatttaaaacaggaaaaaagagatagggaagattaattttaataatatgtttaatttaacccagtatatcaaactgtcatcatgtccaagctatatacatatcatgtcatcagcattttaaagttaccaggagaattcagtgggtactttaaagtccatctgaattcagactagccacatttcaagttgctacatgtgactactggctaccaaagtagacagcatagctctaaaaaaaaggtagacagactcatcctaaaaaaaaatcgaatgtagaggccctgctttgaagtcattgagaggaattatggtggggcaagaaagcagcttcacctgagatggaaagctctgtggaaggaaggtaccatacataaaagcagggctgctcttgaaagaatgtgaccatatcatgcaaggacattactgactgaagggctatttat

SEQ ID NO: 24225 - DNA, 1035 bp, Homo sapiens
acataaattttagaattgttcgttcttctcttctcttctcttctcttctcttctcttctcttctcttttttcttcacttttctttcacagagtcttactctgtcacccaggctggagtgcactgatgcagtctctgctcactgcaacttctgcctcctgggttcaagcgattctcctgcctcaagcctcctgagtagctgggattacaggcacccgccaccatgctgttctgtgcgggagatgcctgaggggggaagaaaaacacacacacaatacctttaagggtaaacaagctttatcccacgtaaatggcaatgcagatataataaacaaatgatataataaacaaattgcaatgaaaaggggagaagggaaaagatatatatatatattttcttacactcaccaaactatggaggattcatcaccagaccgggaagcaacagcctgggctccagagtcagacacttgtccgtgcacagcgagggaaggtctcatgaagtttcggtgcagtctgggactctagctgttttcgtaacaagttgtttggcatgagacccagtcacgagtgcccttcgtgactgggcttaaggaacacaaaaaggtcacaacttgtttttgcgattgtctattgttttttaataactaacgtgtaagaatagattgaaatagagatttctctgaaacagcgatggatgaatgcctcaaggggctcactcaacctgtttcaggacttagtgaccattgtttgtgtccatgttcaattgagttcaaatttaatatttaacttttcctccacacacatgcctggctaatttttgtatttttggtagagacagggtttcgccatgttggccaggctggtctcgaactcctgaactcaggtgatccacccaccttggcctcccagagtgctgggattataggtgtgagccactgcacccagcctagaattgtttattctatttctgtgaagaatgtcattggtattttgataaggattttattgaatctataaattgctttgagtagtat

SEQ ID NO: 24226 - DNA, 1050 bp, Homo sapiens
cgtcaggtcctggccttttctttactgggagactttttattatggctttgatctcgttacttgttattggtctgttcaggttttggatttcttcatgattcaatcttggtaggttgtatgtatctaggaatttttccattccttctagattttccgatttattggcatatagttgctcatagtagccactaatgatcctttgaatttctgcagtatcagttgtaatgtctccttttcatcgcctttttttttttttttttttttccacttgagacagagtcttgctctgtcacctaggctggagttatcttggctcactacaacctccacctcctgggttcaagtgattctcctgcctcagcctcctggctagctgggattacatttgacagagttttagctcttggtcaggctggtcttgagctcctgacctcaaatgatctgcctgctttggcctcccaaagtactgtgagccaccatgcctggcctccttttaatctctgattttatttatttaggtcctctatttttctcagtctgactaaaggtttatcaattttgtttaactttttaaaaaaactttttattgaactttattatttcttttcttctattattaattttggatttggtttgctcttgcctttctagttccttaagatgcattgttaggttatttatttgaagggttttttgttgttgatgtagacatttagagctataaacctccctattagtactgctttccctatatctcataggttttagtatgttatgtttccattatcatgtgtttcaagaaatttttcattttccttaatttcttcactggcccactagtcattcaggagcatattgtttcctttccatgtatttatatagtttccaaaattcctcttgttatttatttctagttttattctggcctcctattttttttacagcgtgtgagctaagaatattttgaccttttttaatggttgagaaaaaaataaaaggatgatatgaaaattatatgaaattcaaatttcagtgttcataactaaagtt

SEQ ID NO: 24227 - DNA, 1018 bp, Homo sapiens
tggtatgaagtgttctcagaggaaccgaaatcggtgtggtcacacatcatcagtgcctcttcatacacccacgctctcctgaagtttgctgtttgtattgcttccagtgcgtgttgctgttcaacagtacccttggtttcagcgtagttgctatgatgaagaaaacctgttagaatctgccttttttttttttccagaactgttggaaacattgaataattccatgtactctaaaaggaaataaagtcttttgggtaatttggacccaaagactcctaaggaatctaggaattcagttacatagaaggtcacttctttcactagcttttgcctccaaacctgcaggagaaaaccagctgaagaggaatactcatatgagtggggactgcacctgagcacctcacgaggctcctttcagaaccctcaaaccgaccattcacaatattcacgtggactaggtctgggtcatttggagagagagaaggtgtgggctggctgaggtgtctgggtggtttctagtcagtgtttacactccggggcttgcgctgcggctcctgcgcctgtcatgcacccagtttcccagaagcttccggggttaggttgtcagtgttgagaggcagtgctagttcagacttgaccttgtgatggtctgtgggggagaatgttttaggccctgggacagtgcagtttaatgactgaaacaggaatctttgagtcaaatcaacttgggttggatccacacactcttattggttgtattgtttggtcaagtcgtttaactgctttaagactcagtttccccatctgtaaatgggtataatcacaatacatgcctcatagggttgagatggaggttaataacacataatgtgctgggtaggtactccaacgtcagttgttagtaataattatattacataaatagttgagagactgagctttacaatacaagcaaacatttttatgtcctagcttttttcttttgtaaactcgtaaaagtctttattattagagtcaa

SEQ ID NO: 24228 - DNA, 1029 bp, Homo sapiens
tttgttgcaactactgaaaatttcttagatttgaggttctgaaagcctctacaacattaagcctatgtgttaaaatactgcattaactgaagggtttagattttccctgttcctgggatgttcctgttttactgatgacagaaggctgcagtaaagagagacttcctttttttaaattacatttactgtttagtactttaatttggaggtcttgatttaagtgtttgaatattctgattagatggcgggaaggctatctatactttgtgtactattgttctttttcctacaaactaacttccagagtttattttaaattctctatttaaatgtaacaaggacaaattgacaagcttcaacttctctattaaatttgtatttgtcacagacagctatactacagtaactgtaatttgctaaagaaacatttattttaaaattgttgactcaccaatttttgaagagggtagcattaaaggactattattgacactaacattattagaacttatcgcttactatgtcaggtgtctcttagctacatttaatgtattaactttgaattgactggattaaacaatttaaaagtctcagagtttaaattgttaagaagtttgtatgtgaggttagtgaaaatattgagctctatattgctaaccagatagacaattggaagtgacctctgaaaccaacatttattggtagactccagtctacaatggatccaagagtgaagttaccaaaaacagttttaatttcagatttcggggtttggaggaatttccttttttaaaaaaattaagttatataaaaaaaattctaaaccaaccttttctttattttcagacaatagccaaagtactcatgagtaaaataacgtatatgccaaggaagtagttatttacatagttacaatgctctttcaaacaactagatttttttttttttttttttgcttagaatttaattaaaagaggaagaataattcttaagtattgcctgttctagttgtttaaagagaaatatttt

SEQ ID NO: 24229 - DNA, 1058 bp, Homo sapiens
cacccaggctggagtgcagtggcacaatctttgctccctggctaaagtgatcctcagccttccgagtagctgagactgcattgaaatatttttttaaaaagcagaatacttatttgaccatctatgcttaaagcaatatcagtaggtttggtgtccatcataagcagctgtgcaattcaacagaaacgtattgccatcacctttgtctatctatgttgccatctgctattatagctgtttaaaggaagactgttgtgtggtattgggaggaaatggtacattttattgtcagaattctaattgatcggggtaatgagaatgaaaaaatggcagtgttatagggaagaagtattcgtatgcgtggaactagaaacggatcacaacttacatgttggcttctaatttgtaatgtttcaaccatgttcggatggaaagaagatgtataggattgtttccaaaaaagtttcttctctatgaatgaacttaggatggtcttcagagatatatataaagaaagagaggagacagagactgaaattgactgcttcaactgtagtgagttaactttcactcataatagaaatagctagaggttggattatttcaaaaagccagtcagtgtttttagagcttctgattctcacaagaacagatgaaaaaatgcaagtatcagttatagagaagactttccatttgagactctcagaaaaggtgtgggtggttactgtgtttgtttgacattgcatcctttaatgagcttgtttagtacgtgaggaagtggaactttaccttgggcctctctgaagcccagtttcctccaaatataaaaagaaaggcttggtccattcagaagctttaaagagtcatttttttcccagacaggatttccctgtggattgtggtatgtgaaacaaagtcagtgattctccatggaggtgatgtgaggagagaaggctatgtggcctagactgcagattcctttcctgaggtccttcctttgtcccatggcagctgcagaggcgtcttggtttaggagatcaagatttgaaaaccaggtg

SEQ ID NO: 24230 - DNA, 1032 bp, Homo sapiens
aataatctccctgagctccatcgtggtgtttctcccaccaagcttttcttgtgattctgtcttgcacaccaccgttctttagaagtagtatttcttggaggtttgtgtttgagatggggactggatgctggctgtagcctctttgtggctccaaaggaaagaggagggaggattgtcctcaaagactcttacaagggtagagagggaggaagcaggctgggcaaagctcaaggaagtccatgcaataactgacctgtgtcaggttggggtctccttctagcaggatgtctgtagggggagggaagaaggactgcagggctctctggtgtgccagctgccagctctcatgcagcactcagttttcagtgactctcatgttaattcagcatgccagctgttcaatttaatgtctataccaatggggaatgggagagaggtagataatgaggaaagagaagaaataatgaggtaatatgtcatctcctaaaagctcattttgtaacagaaattgtccagactgttactgcattacattttaggtttttctcaatcccctcagaaaacaaagaagctcatacagaacattgcccctaccactagcaagaggcaaatctttcagccctcccaaggctggctttcaggctcctgaagctgtgccttctgaatgtgacaccttgtcctggcgacatctctggagagacgccacacacatcagtgttaagtggtacacatggtccttttcaccacaaatgtcctgaaatcgagggactatttagaaaacaggcggctgcttcattctattgtgggagtgatgtgacaggaagggaggctcaggaatgaccatgacaggaaagcatgtggagcactcacagtaaagcttcacagaagccctcacggccaggcgcagcagagcacagcgactgcccaaggagctgctgtcctagccaccctcccagtcatcttcaagaagaacaaaagttcactgatcgcctcagttcctttattctcctcttgttcttgaggactgaccaa

SEQ ID NO: 24231 - DNA, 1122 bp, Homo sapiens
aaaaataaatgaatccaggagctggggttttgttttgttttattttgttttgttttgagacggagtctggctctgtcgccaggctggagtgcagtggtgcgatctcggctcactgcaagctccgcctcccgagttcatgccattctcctgcctcagcctcccgaatagctgggactatgagtagctgggactacaggcgcctgccaacacacccggctaattttttgtatttttagtagagacagggtttcaccgcgttagccaggatggtctcgatctcctgatctcgtgatccgcccgcctcggcctcccaaagtgctgggattacaggcatgagtcaccgcgcccggcccaggagctggttttttgaaaagatcaacaaaatagatagaccactagtgagaataataaagaagaaaagagagaagaatcaaatagatgcaataaaaaatgataaaggggatatcaccactgatcccacaaaaatacaaactaccatcagcgaatactgtaaacacctctgcacaaataaaccagaaaatctagaagaaatggataaatcgctggacatgtacaccctcccaagactaaaccaagaagaagtcaaatccctgaatagaccaataacaagttctgaaattgaggcagcaagtaatagcctaccaaccaaaaaaagtccaggactggatggattcacagctgaattctaccagaggtacaaagaggagctggtaccattccttctgaaactattccaaacaatagaaaaaagggactcctccctaactcattttatgaggccagcatcatcctgataccaaaacctggcagagacacaacaaaaaaagaaaatttcaggccaatatccctgatgaacatcaatgcgaaaatcctcaataaaatactagcaaacggaatccagcagcatatcaaaaagcttatccacttcagtcaagtcagcttcatccctgggatacaaggttcattcaacatacgcaaatcaataaacgtaatccatcacataaacagaaccaatgacaaaaaccacatgattatctcaatagatgcacaaaaggcctcgacaaaattcaacagtgcttcatactaaaaactctcaataaa

SEQ ID NO: 24232 - DNA, 1128 bp, Homo sapiens
aagtatgggtatcatcaaattaagatttttgattctaaaattattaggttccaagaccaaagattaaattaataaaaggtgaagctggacaaaatctgctggaaatgatggcctgtgaccgactgagccaatcaggtaatagtaatattaaactaatttaatttaaaaagaaaaaggaatttctgttaaggcatatcttatgataaaatcttcatctgtccaggagataatttgtcaaaattatttctttttgccgtatcagttaagagcaataggtatggaagagatgtgaaaaatagcacattctttaaaaaaatgaatatttgatattgtttgttcctaggtggagaggatttcttaactctttctttatctggctgctagagcctctatcctgaatatttagtcacttcctgaactaagtataattattggtttgccaaccatttaacaccagctgattctaaaaacactgctgtggggatataaagatgaagaagatacggatctgtcttaaagagctgagagcgtagggaggaagatagaagatatatacttaccttatattaggctcttggaatttgtggattttttcccccatttttggcttgggataaatcctaaaggtctgttgcgtattacctgtgattttgctaagatacaaactttaaggtagttaggtggccattgaatcaagcagtgaactgaagaaacataatgctttctataaggagcagttttgatataaaattggatgaattttgtaaagagcaagatgtaatattaaatcaaagttattataagctttggtgtatagttaggctgttggccagagctcacattgctcttttattccatagctcacttttttttgtgggagttaggctttcagtccttaaagtgactttctacttttttccttttctcttttccttctacccttgcagggctctcataagtgcctttgcgtggtgtcacagttagataaaaattgcctgtattttttttaatgtctttgatctgggcatcccgagggtgcctctgtaagtgtgctgagacacaactgtgtagtggtaaccaaacctaattgcccagcagaattaactcgaaggagggtttttaaaaaaa

SEQ ID NO: 24233 - DNA, 1065 bp, Homo sapiens
ggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtaagcaaagattttaacaaattaaatattctgaattttgtttaattttttttctaacttaacttttccttaaataaaacaggtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagccctgaactgtgtatttagaaagcaattttagtaaattgaactattttttagacctggaaacgtagcaaaattgagacttctagttcagcatgaaataaacactctaagagcccaggaaaaacatggccttcaacctgctctgcttgtacattgggcagaatgccttcagaaaacggtgagttttaaagtataagcatttttaaagaacattaccttaattttttaaaatcatgaactttttattgaaagtttttttgttctgaaaacagcagcttggtcacattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctatatacttaaggtgtgttttgtgtcaccatgag

SEQ ID NO: 24234 - DNA, 1063 bp, Homo sapiens
ctgtttaaacattttcatagtgtagacattcaggtaacagagttcctttatgaatttattggagatgggaatttccagtttataaacaaagacatagagctatacactgcttaaattaattgccttgttatttaatggtaatcttgttttctaaattcactagctctcacacataagatatgacagagaagaataatgagatgtttgtctcttaagatcatataaaatctttggaaaatcatttgggttttatattctgagtataaacaatttgactaaaaactattctgtgtgtttaggcatcagaaattgttgaatatgaagaagacgcacacataacttttgctatattggatgcagtaaatggaaatatagaagatgctgtgactgcttttgaatctataaaaagtgttgtttcttattggaatcttgcactggtaagtagatgcagtacttgagctaaaagttttatttatttatttattatttttttaaaagacggggtttctctgttggtcgggctagagtgcagtggcacaatcttggctcactgcaacctctgcttcccaggctcaagcgattcttgtgcctcagctcccgagtagctgggattacaggcatgagccaccatgcgtggccaagctaaaagttttttgttttaaaaacctaatgatttcataaaagcactatttgtatagatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaagtaagtagcaggttgttgtatgtacgttcttactgataacccactggtcaatgtttttgcgttggtcttatattttggtaatttcaaaaatactcagtaatatgttgttattaatgcacagaagggatatgtgtgtctaaatgcttatatttgcttgctttgtcttaggtttggtgtgtctttttaaacttgggaatctaggtatatgctcttaaaaa

SEQ ID NO: 24235 - DNA, 1041 bp, Homo sapiens
tctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcacttttt

SEQ ID NO: 24236 - DNA, 1032 bp, Homo sapiens
agtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaagggtaagtactttgttgttaaagttaagcacaatttttctttcttttaatgtttagcttgatgcagactctttgtaggatactaatgttgggatataaatgatgctttgtgaacacccccaaaatatttgagcaattttttttctcccttaataagttcacggtgaggtttcaaagagcaagagaacttagtttaagacatttcagtaactggaagatacttttatcatgctagggcagagcaaaagaactcggtacggtatacggactcatgcttgaatcatgcacattaacgtgagtctttttttaaagtgttcattttcatttgttcagtttcttttgtcactcagaaaacatgatattgaggctgggcacggtggctcactcctagaatgccagcactttgggaggttgaggtgggcagatcacttgagctcaagagttcgagaccagcctggccagcatggtgaaaccctgtttctactgaaaatacaaaaatgagccgggcgtcgtggtgcgtgcctataattagcagctacttaggaggctgaggcaggaggatcacttgagcacaggagatggaggtagcagtgagctgaaatcatgccactgcactccagcctgactgagtgactgagactttgtctccaaaaaaaaaaaaacaacgtgatattgagatgttctcattttatatgttgtatgtcagtcttgctcatgtattaaatgagcaaagaatgaaactacagggataaatgaatatg

SEQ ID NO: 24237 - DNA, 1025 bp, Homo sapiens
atctaagttggatattatttaatgctaaaaatatgtggcagaaagaaatgctatgggtatcaagaaggagtaagcattttgaaataaagatgtatccatatataacatgaaatgttgaaataattgtggagagaaaaaataattatgcctaaagtatctgtatgttacataattagtatttgggagcttgactttttttaatacagttttctctttctctacttaaataagttaatctgtgtaacacactttgaacagttctgggtaaataataagtactcaaatgttacctattatcattattattactatttcatgttgcactcacaaaatctagttgatctagatttaggatttagacatgagctacgttgaatgtagggtaaggaaagtgaaaattgcttttaaggtaataattataaatttatggaaattattttctttttaactgagttttatcattttttatataatgacctgggtataactctaaactataatctaaaggttttggactatgaaggttttcataacattggacccctagttgtgatctggtctgaaactatgctgtccagcacagtagcaacaggccacatgtacctattgagtacttgaaatggggctggtctgaattgagatatgctgtaagtgtcatatacacactggctttctaagacttagcatagataacaaaaattagccgggcatggtggcgggtgcctgtagtcccagctactcgggaggctgagacaggagaattgcttggacccggaggcagaggttgcagtgagccgagatcgcgccactgcactgcaacctgggtgacagagtgagactccgtctcaaaaaataaataaataggcatggataaaataatgtaaaatatcttaattttgtgtgggtgtatgtgggtttgcagggggcgagcctgttgcccaggctgtgagtgcagtagcataattgtaactcactgtagcctccaactcctgggctcaaacgatcctctcacctcaggctcctga

SEQ ID NO: 24238 - DNA, 1026 bp, Homo sapiens
aaggatatcaagcaagaggaactcacctactgctgttgggagagtaaattgatacagccactttggaaaacaatttggcatcactagtaaagttgaatctgcacatataccctatgatctagcaattttgctactacttatataccctcaggaaacttttttttgttttgttttgttttttttttgagatggagtctcgctctgtcgcccaggctggagtgcagtagcgcgatctgggctcactgtaagctccgcctcccggattcacgccactctcctgcctcagcctcccgagtagctgggactacaggcacccgccatcacgcccggctaattttttttttttgtatttttagtagagacgggatttcaccgtgttagccaggatggtctcaatctcctgacctcatgatccgcccgcctcggcctcccaaagtgctgggattataggcgtgagccaccgcgccctgccaccctcaggaaactcttaaacttgtacaccagaagccacgtacgagactgtagcatctgtatagccaaatcagctcaaatttccacctataggaggatgctgtatacagtgtttgcaaaataggatatacagtgaagatttgtgaacctgtttaaaagaagaggttatagaaattatgttaatataattacatataaaatataaaaggcaaaacaagcaaggacttttaagattaagtagtggagattaaacagcaaagcaaagcagcatgtaacacttacttgcattagtggtaaatttggtttaggggagagaggggaacatgattaggggcttttaaggttgctttccatttcttggcaattagtgtctttttatatcctttaaaatattttattttgaaatcatttcagacttacagaaaagttgcaaagatagtgcaatcaattgctgtatacccttcacccaaattttcgatgttaccactttaccatatttgctatatttttctttgtctctcttgaaactttttaatgttatattttgtacttaaa

SEQ ID NO: 24239 - DNA, 1018 bp, Homo sapiens
actctgagaatatttgaaacaataagttaataaagtttataatgcaaatgttattttctttgcagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcaggtaagaactaaatactgaatcgagaattcagaaatatttatgttctaagaaccaagcatttacgaaatttgaatataatatatttcattttaattactttagataagtttgtcaagagaaggacggaaggggacaaactcaaattatagggactaatgaagggaaaaatacagtggctgagagaaaatagagacagtggcgtttttatttgtaggtgtgtgtttcagactgtcttgtattttatttgatttccatcccatccttacttaagtaataaaatctgataaagtatggtttttgatgtagatgctctagctttattgttttaagtacttatatataaaaagtcttcttgtcaactctcatcaaaattgaactcttaacatttgcttattatctgcctttcgggttttttgtttctaaagtgtattttttttttttttttttttttgcgatggaatcttgctgtatcacccaggctggagtgctgtggtgtgatcttggctcactgcggcctccgcctcctgggttccagtgattctcctgcctcagcctcctgagtagctgggattacaggtgcaccccatcccgcccagccaattttttgtatttttagtagagatggggtttcaccatgttggctaggctggtcttgaacttctgacctcaggtgatctgcccccacttggcctcccaaagtgctgggattacaggcgtgagccacagtgcccagcctaaagagtataatttatatattaagcatccacgaga

SEQ ID NO: 24240 - DNA, 1131 bp, Homo sapiens
tctaagttatttcacttaggattaatgacctccagctccatccatgttgctgcagaagacatgatttcattctttactatggccacatagtattctattcatggtgtatatatatcacaaattttattgtaagataccataagtaatataataaaaaaataattggatacccaggaataaatctaaagagagatgtgcaagacatctctacttgaaaactacaaaacattattaaaagaaaataaaacctaaataaattgaagatatgttcatggataggaagactcaatattcttcctttccatatataggaagtcagttcttccatatatatatacatatcagtatatacacagacacatatacacatagtcccagtaatgcaatcccagttatagctcattgtactgcatacttaggattttatacttttctttatatgtgttatagttcagataacagtgtacttattaataaaaacattttcactaaaatatatgtatatgcttttaagacatctggagtcttgtacatttttcataaaatgaagtaaatgatcttacaaaccattaatattttagggaaaaacgacaacttcagttgtgatctaagttaatcatgaatgctgtctctgttttgttacattggttagtaatatcaaccagattagatagtagattgggaaacccttagtatgaaaccagttgaaggtgtatattgaaatatctaactttttctaccctttagttaaatgaagcaagtgaagaaaacaggaagatagacattcaggctaaaagagttcaagctcgtttagataatttacaggtaagttgcctgttcttctctacagacagaagtatgtttttagatgattacctttgagtttactcatttagatacaattgttctttaattcacgcatatatactgttgcagaggaagtacgagtttatgacaatacagagattgaaaggaagttcccatgctgttcatgaaatgaaaagtttaaaacaagaaaaagcaccagtttcaaaaacttacaaggtaagtttgaattatgatttgatatgattgaaaatttctcggctgggtacggtggctcacacctgtaatcccagcactttgggaggc

SEQ ID NO: 24241 - DNA, 1049 bp, Homo sapiens
ggaactgggggaggggatggggatttaaaactggaaacagtgttaaaagtgactgatccctgcttctagggtgaaaaagtccaacttacatttaaaatgaatgccagggcaacatcaaattataagcattcactacaacattatgtagaacttattcagtctattggtatggtcattttaccggtttgaataaagcacagaagctttacttccctttttatcccttaaccttttctgtatacgcttagaaccacattagagaatgttaccatttttgcttcaaccgtcaaacagaatttatagaactcaagaagagaaggaaagtttattgtatttacccatatttttgtttactatgttcttctctccttccagatgtgccacagttccctctttcattatatcctatctatctgtttagaggacttctttatctgttctttagagtagttatttttctttttcttttgaggcagggtctcactctgctgcccaggctagagtgcagtggcatgatcttggctcactgcaacctccgtctgctgggttcaaaccatgctcctgcctcaccctcccaagtagctgggattacaggcgcccaccaccatgcctgtctactttttgtatttttagtagagatggggtttcgccatgttggccaggctggtctcgaactcctgacctcaagtgatccacctgccgtggcctcccaaagtgctgggattacaggcataagccaccgcacctggcctagagtaggtttgctgatgacacaaactcttagtttttcttaacatattttgatttcctttcaattactgaaggatattttcactgggtatcagattctagtgtgacagttctttactttcagtacttgaaaaatgtgccaattctttctgccctccatggtttctgataagaaatctgtcatttgagttattttccccatatatgtaaggtgtcatttctctcacacacatttgtctttagtttttataagtttgactatgatgggtcttggtgttgatctctttattttagcctgt

SEQ ID NO: 24242 - DNA, 1022 bp, Homo sapiens
attattttgcctccttatggttatggttctcaagattacaatagactaggtggttagtgtgtgaaaggtcacttacgagaagcagggattagctcaaaataaagttcgccacagacctatctccaaatcttaaaaaaaaatacacacacgcttacatacccacaggtaaatggattctaaataagaattttagctgacacatcatagccacacattaaagcatagattcactaaagatcaaataatattagtatcaagaatttgaagccaatttaatataagaaaaattattaatcatttatcatttaactaagatgtttgaaataatatgtcaacatacattatatcatttaataacatgtaatgttcatttctgataatatgctaagaaaagcaaaaatgcaataagggatatttatgtgaaatagaagggaattaggtgctctctgtcaccacttgtgtgcagcagttttggacatctgtaatgagccatgaaaaaatgaagtatgaatattgggaaggagtagagaagaccgttaatttgtggagactctgtattaatcgagggctttcaaagaaatataacagggcataagaatatggataaataatggatggatgaataggttgatgaagattattgctgaagttaaatgtcagaaataaagaacttttattcttcctgcctatgaagacgaagtgttttaaaaataagatgtcccatatggcttaatgtataataccagttaaaattctaatatagtttgcgtaagttgaggaagtgttagggaaatttatgtggaaaaatttgcaacaaatgcgatgatttataacaagtaaaacagcaacactggggcagaggcttagccaactttaaaacaatcctaatatgtaatgatacaaaatgagtaataatttatttaataaatcaaaataggacaaagggaataggaagtccagaaatgaatcaaaattggcacttcatattatgtattgaattaatgactttgcttccctgtgca

SEQ ID NO: 24243 - DNA, 1065 bp, Homo sapiens
attgtggtactgcaaatgcaaatttgaataaagtctattagaggagatagtcaacagtcagtcacatttgtttaccattgtccaggttactctcaaattcagccaggtgcagtggctcatgcctgtaatcccagcactttgggaggccgaggcgggcagatcactggagatcaggagttcaaggccagcctggccaacacggtgaaaccccgtctgtactaaaaatataaaaattagccgggcatggtggtgtgcgcctgtaatgccagctactcaggacgctgaggcaggagaatcacttgaacccaggaggtggaggttgcagtgagccaagattgtgccactgtactccagcctgggtgccagagtaagtctccgtctcaaaaacaaacaaacaaacaaaaaaaacaccaacgctgtgcccttgttgttcaaatcaagtaaataagcagtatctaatggtgatcactactaaagccgtattgtgtttagtgatgcgaaaattttggaagtttggaaatgggtgaatctttgatgatgtctgactgaagagcatttacttgcttgaattttaatgtaaattcagtacttgttggtcagccagtacgatttattagagcgaggaaagattgatcaaagtgtagcaaatacttctttagctgttggtttttcatttttctaggtttgagattggaaacccattttaccatatatttaattttctcatgctatttttttctttttttttttaattttagatttagggggtacatgtgcaggtgtgttacatggatttattgtgtgatgctgaggtttgggcttcaactgaactcgtcatttaggataatggcatccagctgcatccatgttgctgcaaagaacattatttcattattttttatggttgtatagtattccatggtgtatatgtatcacattttctttatctgatccaccactgatgggcacctaggttgattccacatctttgctattttgaatacagctgctgcaataagcatgagagtgcaggtatctttttggtagaacaatttcatttccttt

SEQ ID NO: 24244 - DNA, 1047 bp, Homo sapiens
gaaaataaataaatagtaacacattcacatatctcataatttcaaaagtacaaaagtgaaaagtctgccttcagttactgtttccctccctggagggaacaactgcagacacacacacaaatacatacacatttttactttttcctttttatcacaggaatgctactaagttttatatatattttatatagatatatattatgatcagcattatatcttgaagatcttatataaatgcataatttcttcaattaaaattcattcatttaagcagaccacgattgatggatattttggctgtttctagtctttggctaatataaacagtgcttctgtgaataaccgtatacaaaacttaagtgtgtacatgtgggagcttatttggtagtagtgatttcaaattctgtcagttaattgatatatctccatttcattaggatcagtttctagagattcatctctttgtcttttggggaaaatatttccttgtttcttctttttccttgacattctctgttgatgtttttgtgccatagacaaaataattacctctctaagtcttcatggtctggactcattctggagaagaccctcaccaatcagccctgacagaaattctgggatctttcaaaccttcatgccagtcctatccactttctttgttcttaatagtccctaggcatctagaatatttcaggtcccttcagcttctgagaccatggagactgaagccatttcctcaggcagtccccatttaaggtgagtggttggacacacggtactcccctatccattcccaggtagaagctaaagagctggggtttttgcctgcttactccgtgatgagccagaggtagagggcggggtggctatagtgatcaacaccccaaattgccatgagtggccagagtttgttgggttctgtcagtgctccaagacagggtagacataaaccagttttctgggtagttcctagaaaactttggacattagacacatagggtacctctttctcttcctggggagaagctaggagctgggggattt

SEQ ID NO: 24245 - DNA, 1026 bp, Homo sapiens
atgagtaaaatattaccttattataaattcccttttcctcccctgtattataaatagtgcattatattgattaaaaagatacatgtaaacagattatattgttatattgtttatggttatttttaggttaattaaaggggaattataaaatatttattatgaaaagattctactgagtcactgggttgagaactgttccactagcttagctatgtttttatatatatgtataatttatataaataggaaacctggggctctgagaaattaagtgacttatttaatgtcacagggctagggccagggcagtgataagaggaataactaagtcttttagaagaagaagaggtggacacaagagagaagctccccgctggaagctagaactccagaactgagagattccagagtgggaattactggcagcactaatgtgtctttaggaattgaaaaagcaagctagaaggaaaaaaataaaagtcttgaaattctctcaggaatgagaagtagaaggaacaacatggttcaaaactggaaaaatggcagactaggaagtttacctggggagttgttagttacgaatatggattaccctgctccaagagtgtctttgtccttggactagcactcccctccccaagcctttggcaagttcctactcatctttcaagaaatagctcatcttgagtgcatttcacaccattcctccttccaaaaaggaatgagggtggacttgaaaaaaaatactgaagaggaaaattcatttgggtgtttttcaaagactacctaagtctattcatactattgcttttttttgtttgtttttaaatatttctttagccttatccagtttgagggatgggcaactgaaggtttttggttggtattgaatgttgctgtgttatgttccagcctttgagtcatcagaactggaataaaagccttactaactagacatcatacatttttgtcccgtgtaataaatagcatgttactatctgggagctgaggtgagttttctttaaa

SEQ ID NO: 24246 - DNA, 1940 bp, Homo sapiens
gagactggtttcagacttgcctcgttcagggcacatacagggaatgcggcatggtttgaatctcaggaagaaggccaaggaaggcagtggtgggcaccatagcacatgaaaactgcagggagactacagacctgtggatgtgtaggaggaagaggttatgcacagaggaataccatacaagatctaaggccttcagaagaagcttgggtgagattctgggaaattaagacatttacaggcagccagaggaaacaagaaaaaaagaaaaaaacagcatacacaggcccagacaggatgcatgcccagacaagacctgagatgaccttaagcacactccctacaccgttcccaaggctcaggtgcttgataagtagtgaaggcctttcatgtcagtcttcaaagactgggaggggtggttttttcaaatgtcagattttcagcaaaaaaaatcgtagaacacgcaaagaaaggatgaaacctggctcatccaaaggaacaaaataaatcttcagaaactatcctgtaaagacacacaaattaattggatttgctcagaaaagactttaaaacaactatcttaaatatgctcaatgagctaatgagaaataatgaaatcagggaagtgatacatgagcaaaatttctcagctatcttaaatatgctcaatgagttaatgagaaataatgaaatcagggaaatgatacatgaacaaaatttctgtcaacaaagaaacaaattatttaaaagaaccaaattctggaactggaaaatacagtagctgaattgaaaaatttactagaagagttcaacagcagacttgaacaggcaaaagaaagaatcagtgaacttgaaggcaagttatttgaaatgatcaagtccgaggaacaaaatcaaagaaaaaagaaaagtgaacagagtctgaaggacttacgcagtaccatcaggcagaccagttgatgcattactggagtccagaaggagaaaaaagagaaagggtggaaagataatttagagaaataatagctgaaaacttatcaaatttgaggaaagacacggctctacaaatcaaagaaactcaaggaatccacatttgataaacccagagtccgacatcaagacacattatcatgaaactgtcaaaagtaaaagacaaagagtatctgcaaagcaacaaaagtaaatgtggtatgtacatacggtagactattattcagtctaagaaatgaagttctgatacatgctacagaatggatgaacctggaagacattatgctaaatgaaataagccaggcacaaaaggatatatcttctatgattcctcttatatgaggtgcctggagtagagaaataagtagattggtgattgtcaggtgttggggaagagggaaatgggaaaattaaagttattgtttaatgtgtgcagtttcagaagaagatggaaaaaactctggagatggatggttgcacagtaatgtgaatttacttaataccacagaactgaaaacttaaaaatggttaaaatgataagtgttatgcatatttaacaccaatttaaagaatgaatataaataaacttctagaactcaaaaaattgaaatgaacctcattatttagaaatagccgtcattaatgttaggtgaacattattttagacacgttcctatggttgtgttcacatgaaaagatggatgaatggatagatagaaggaaatacttttacagaaatggcatgcattatacatgttatttaatgaaatagtattcaacaggaaaaataaaatggattagagtcataaatttttaaaattataagttcctagccaggtgtggtgtctcatgcctgtaatcccagcactttgggaggctgaggtgggcagatctcttgaggtcaggagttcaagcccagcctggccaacatgatgaaaccccaactctattaa

SEQ ID NO: 24247 - DNA, 1033 bp, Homo sapiens
agtaaatgacaagggaatttgtaactatataaggaatagctccctaaaaatggcaggtggagagccaatggaacatgagctgacactggctggccttacagccccagaattctaatagtgtgaaatgaggccaaagcaccaggagcagagaacagccaccccactctttcgctgaaaacattctgaggagggtgcaagctgttatcctggaatggcacactcatcacaagtgacatttgcagtctaattaaggggagactcactcatcatcatcacaaggcagggggaagggggcaccacaggatttcaaagaggaattaaaaggataattaagctctgccgtggagtatttagcttgcagggtaaaccaaataggttcgaaaaacagcagcaaacagacacagtaaatgatgatattaaatattcaggacctcattatgatcctctcacagtatgtactacattcgttggtgggaaattgcttgttggtgttaaagatatgactgattttccccctaaagcattttttcagtcatgcaacttgtaatttttacaacctcgctttataagtcagagactttgttttaatgtagtaataaacacagacctgccatcagggagttcagcagtgaactctaacccctggtgtgatcactagcctggctcctgagctcttggcagttacagggatagtacaataatatgccaagaacaatgccagtttattaactttctgcctataaatgttatgtcaaaccattgcagttattgtgaaaatgccaagtctgagtttttctgtttttattcccatttaaatggacaaaccacactgtgttgacttccatagagcacctcaaaggcctggcatttcctatagctccactttctttttgctcacctgaaccctacctgccccaattatagaatcactaactaacatctcattggcagacgagaaactgaggcagagagaggaaaagacaaggcccaaggtggcacaactagaagccagctccctcgacatcaagcccag

SEQ ID NO: 24248 - DNA, 1034 bp, Homo sapiens
agatgtcaaatcttcccagattgatatacagttttgttgcaactcattaaaatcccagcaaggcattttgtacatatagggaagattattataaaacttatatggaaaggcaaaggaactagaatagctaaaagatttttgaaaaaaaaataaaggaaaatgggagcagtccatttgatttcaggacttatatgttattacataatttatacaagaatcaagaccttgtggtattatcagagggacagacatgtagataaatgcaacagaacagcaaccccagaaaatagacctatacaaatatgccaaactgatttttgacaaagtttgaaaagcaattcaatggaggaaagataatttttcaaaaaaatggtgctggagcaattggacatccatagacaaaaaaatgaactttgacccaagtttcatatcttctataaaaatcaactcaaacttaaatgcaaaatataaaactatgtgaacttaaatgtaaaacataaaaactatgtggacttagaatgtaaaacattaagctataaaacttctagaaaaaattgtgggagcaaatctctgggatctaggactaggcaagagagatcttagatttgacacaaaagcatcatccataaaaagaaaactttataattagtttcataaatttgactcataaaaatttaaaacatcattctatgaaagaccctgttaagagactgaaaagataagctaaactatagaatggagaaaacatttataaaaccacatatccatcataggactagtgtctagaatatatttttaaaaaccctcaaaactcaacagcaaaaaaatcatacgataccattgaaaaatgggcaaaagacatgaagaaacattcattttactgaagaggacacacagatgaaaaaaacacaagaaaacatatttaaacaataggaacatgcaaattgagaccacaataagatatcataacacacttctcagaatagctaaaacaaaacatagtaacaccaccaaatgctggcaagcatatggag

SEQ ID NO: 24249 - DNA, 1049 bp, Homo sapiens
gcccccgccatccagaatcgcggggtggtggagctcctccggggtgaggcctggagaggtgaggaagcgtaacctctctctccccctttcctcctgttttggttcccaggtcctcccacacaacctctcccaacaggaaagcctcgggtgctgctcattgttcagcaagtgtcctggccacactgtggggagggcggagcatcaggagaagcacctgccaaaccgcaggcaggggcctgggcccaggagagactgggacaaggcaatccgcatccacagcctgacagccacttggattcaggaatgaacgcagcctttcatggagctagtcacaccggcctgccaagactcctgtgatcctcctctgtgacacagcgtgacagcctcgtaagaggaagtggggcctccagggtcctaccctggggaagccttgtctgcagtagagggggcagcatgagcccctgagaggggctgggattcggaggtgaggcgggggccttcaattttggtgggcgttgggactggcagtgaggctttgagcagacacagcacatcatggagccaacctggaaactgtccccatcgtctgcacccctgcggagcagtgcgaaggcactctgaggcacgtgctgagggtgtctctgcacagggtcccttgcctgcccagcaggtgtgctgggccttgctatgtcctgggtgctgagagtggtgtggactgagcaggtcactgtcccatggagtagggcgggaggcatcaagattccagcactggaaagaatgtttaaaagcccagagagcagcctgcccactaattctgcagatggctgtccacattcgcctgaattcttctagaggcagggagctcaccacccttccagtgtccaacttctttagtaattacacactttctggtaaatgtatcagaaccaagcacgtggtcttcaggccatagagtcagccctggccttcgggtactgatggacaccttctcaggtctgaaccgtagccaggccagagccagcagcataggtcggcgaggttccgtggtg

SEQ ID NO: 24250 - DNA, 1100 bp, Homo sapiens
gacgaacatatgccatgatgcacaggaaccttccctcccttcctccttttctttctttcttttggaaaagtcctgcaacagcctaaaggcattaggtagaaattagcgaaagattattggaaataaattaagttggagaggctgagcgcggtggctcacacctgtaatcccagcactttgggaggctgagacgggcggatcacgaggtcaggagatccagaccatcctggctaacaaggtgaaacctcgtctctactaaaaatacaaaaaaattacccgggcatggtggtgggcacctgtagtcccagctactcgggaggctgaggcaggagaatggcatgaacccgggaggcggagcttgcagtgagccgagattgtgccactgcactccagcctgggcgacagagtgagactctgtctcaaaaaaaaaaaaaaaaaaaaaaaagaaagaaattaagaattaagttggagaaggaggtgagagctgtgtaagtcagcagccagggaacggtggagaagagcaaaagaccaagggccctgtcagtggggactgacatggacaatcttcttttccaaatcccccaggacttaagggcttcttcactgagatttctggaaagagaatggtcctttaggagatgcacccaatgccaagtacatatgtgtttttaacacataaaccgtggggaaaacattcaaaccatagcagcatggaaatgtctcttcccatccgaggcagacaaggctgctgcttaacttgtggaactaatcagttaactggctgctagggagcttccagtctgcaggccttccagagatccctggggagcacgcctgtcctgcctcccgagtacaacagcacatgccctcgctcccgtaggaagagggtgggcagaatcctggcagggccttaagatggtacgcttgtttatcattgcaacaaataaacacccacaaaaaatccaaaggaacttcagtttcctggaacaccaagcagggctgtaacacctgttgttgggtgagaaagaaatgatagagaagaatgcctccgggtgtatttgtaaagtttctaaatgcatgaaagcaggtctggagcgatg

SEQ ID NO: 24251 - DNA, 1046 bp, Homo sapiens
catgaatttatgtgagtttaaatgaattaggattgaccacaggaattcggatcaggaggaggtgtgagagaatttagaagcatgcttgcaccggggcacctgtaaatgtgctgcagccgggctctctgagagcaagacctcaccagagaatcagggagttcgcagggagccatctttaccctggttcaaggaatgggatgctgatgcttttctctctctggcttcactgcacagatatttaagtacctgctgtgtaccatacactacagtggacactgggggctccagggacagcgattgcattggtctctatttataatgaaatgtaattttttttccatttagttaggtgaccagatatgctgcagaggaaaacatgtgtctatatctttttattctctgtttatctggcaggaatttctaatgaggaaagtggtattggtgtgatttggggcttagtgagtttgcagtgggttctcacctctttttgtttattcttccatagtctagatttgccaaatgaaggctttgcacttcttctttctgaatctttctgactttgtggtggggaaagaagatgatgaggcaggtccatcccacagctggaggctttctgagagcagcttggtgttgcgggcagcacctttcagagaagctgtctgctgtttgctagttctggagcagatgctctggaagtgccacatgctcaggagataagagaacttgctgctgtggctaggacgatggaggtcaggagtgtccagcacgttttctgaagattcttttaattttttgttggccatcaaagcacaccaccttaggtgagaattatttggatttatcatttaggatctaagatacattcatgggtgactgcattccatttgttgctctaggatgaacccagagatactggagagaaagaggaaagatgagggaggcttaggcacatttcagtaaatggttgcaggttaactaatctcattagacaccacccgtcctgatcagccgttgtttttgcgttcaaagactaatcggttaatcct

SEQ ID NO: 24252 - DNA, 1619 bp, Homo sapiens
tggtgctgcatttgctggcaaagtggcaagcaaattttgagtaatattctggacttcatgtattgtattgaactggatcttttagagaggggtcagggcagcccctgggcagcccgctgctgctggttcattctagtcttcctgttcatctgcagtgaggaagtgggtcactcttcctctgggtctgcacaccctgcctgcagactgcagctgtagggaacacacagaatgaatggtggcccaggtgctggggctgtggagctgtcaccatggccctgtgtgagtgctgctcttgaagactggcccagaacgagtgatgttaataattaattcagtccacacatatgtactgactgcccaccctgttgcaaatactgtgttaagcactggaatatacattgttcacaaaaccagaagtgatccaggcctttctgcaactgaccattcagaggacactgtaaacaaatagccaataggtatctcttgacatgtggtaataagagacatgaagacaaggggccacagcctgatgatggcaggggacgtggagtcatgggtgatgtctgtggatttaattatgcagcttattttatttatcaaaatgtatccacatctttactcttttatggataagccactggattccttaactctttataatcatatcccaaatctgcgtaacttaaaaattgcatcctattttctcttcccaagcacagccaaaggtaattaaaaccagatgtgtttgcatgagaaaatgcgtgcagagcatcaagaatgtagattgtgctaaattaatgtcgccttaacaaagatagccaatgagactgacctttttttttttactgagttcatgatgcccatgggttaattttgtcactagcagtcattgtctggaccaagtttgtagtctaaacatgtgcagtatgaaaggtgaatgctctcacacagtcacactcctaataggaagacaactctcttgtatcctgagcggcatcccccttgtgccttctgtggctgaatttgtgttgtggactatagcagagggaaaacttccaatgctagaaatctgagttttaaaaattaatttaaaaatgtgttccttatggaattgggagtgtatctgctgtctcggtttgacaaactaagctttgacttgtgtacagtaacaagagttttcctggatttaaagttgttgtccccagcatatcaaatgaggtgacgtatatcagatcctgtggttgagcctcacagtgcagaagggcacctgctatgggtcagcagcccattgaacaatggagtttaagacttgcagtttttgagcttttcaatcacctctttgccaaagaccaatgtgtccattgcttggcagtttgacatctggagtcgtgtggacaggggtctacatccaaaaggcagcgccactggggcttagtttgttcaggtttgtgttcctaggcagatggaggctgtttgtctcaaatatagctgctttaaaaaaacaggagggtttattgatcagaggtagtgactcatgacgttgaaactgtgcctacataactcacatgacaaggctggggtgaagaggacaggtctgcggaaggctttccacttagtcc

SEQ ID NO: 24253 - DNA, 1057 bp, Homo sapiens
ggaaaggcagtactttagtgtgaagtcattgttgttatgatgcagctgagtttgagcctgtcttagaagcacgttttgatgggcagaaatggacccagtctacagacaagggaccatctgcaaagacaagacagtcactgtgaagcttttgtcagaaaacccattcccaatggagggggaaggaatcagtggggcaaatatttcaatggaacagaaccagcatctaaacttatgcactgcagcgttctgctaaaccctgctatgggtgaggctgaatgagtacattcatttctaataaaagaaattacattaattcttgaagggaatgtaggtgtttaagctgtcactggaaacccatttctgagaagaagctaaaattgcatgcctttttttctctcttcttcttagtgatttaaaaaaatttgtatttttgctgaggtttggaaaggcaattacgctgattttgcccaaaatttggacagattagttctgctgagaaagaagtaacgaaggtatgaaaggacatgaaataactgaaacttgccaggagaaatattaaggtcaaaagcagaggaagcatgggctcggctcagtgtgcaatgccttatcaccgggtcacctgccccaggaggtgggcccgacagatgccctgtgtgtgtggaagctgccgctgtgaaagagtgtggcatagtaaaacatgagatcaccccagttattttatttctgacacactgggaatgaatcttgatctagtctccagggtgtgtacttgtctgctgtgcgttttgtgctgagctgggttctggtgcattttggctaaagccacattaaccaccccccgacccccgatgccaccatcttgctggagctgagatttcctgcagacctgcttcctgagggctgactcctggtctcccactgctctgggacattagcagtcgggacttgctacaccagttgcagggccgaggacaaaatgaagtgcaattataaaattattaagaatttcattacgtgaccacagagcattaagccaaatttgggcggcagccaagtg

SEQ ID NO: 24254 - DNA, 1050 bp, Homo sapiens
cgagctccagcttcctcaggtggcctttggagagtgttggctttccaaatcacgacttgtcaaaagaggctttccagatttcaggacatgttggattgatagccagccttcataggagtcatttttctgttgggttcataaaatagagtggagtgtgttctggtgtgctcatggaagctggggctctggcctccctccgggccagggcaagggttccatgagccacataaaggcattttgcaaactacaacttgctatgctgatgttcggtggtgttcggcattttgcaaactacaacttgctatgctgatgttcagtggtgttctcatccatgggcaccttgcatctatgcctattttatagtatttgtggaataattttcccattttaagtgattatagagttggaagttggatctttgttttgttttgttttagagatggagtctcgctctgttgcccaggctggaatgcagtggtgggatcttggctcactgcaagctccgcctcctgagttcacctgccattctcctgcctcggcctcccgagtagctgggactacaggcgcccaccaccacgcctggctaatttttgtatttttagtagagatggggtttcacggtgttagccagggtggtctcgatctcctgacctcgtgatccgcctgcctcagcctcccaaagtgctgggattacaggcctgagccaccgtgcctggccggatctttgttttgatgacacaattttggctatttgtgatttatttcaagcagtgcctggcctgtaactccatcttgaattgtaacactgttcccatgggaactttgatagggtttctagcagtacttgagaacaaaaagggagttcccacatcctgccaatgttgatcatagcacacgtgctggtgtgtgtgaataacgtagaatggaagatgttccagaactaggtggtcagccttcaaactgctaaagctttgttataactattttggtagctgtctttccaagatggtcatatgtattgtaacaagtgctgtattggatcgggctaag

SEQ ID NO: 24255 - DNA, 1048 bp, Homo sapiens
tatttaaagactaccaataaggttaataaaggtttttatttccctctgaaatcacacataaatgacatattactccaggtcatttttccatcataggatttgcatcatctgactgtgggaagggctctccttggtaaacacaggtggctccaggctcatagcaccccacaggaccttcttaggttttaggatgagagcacttgaatttgatgtcccagagtgttagaatgttatcagaggggatcatagtattgactggggatattcaccgtctcttctactcctcagctctgctggtaggtctagttttaaacttgcagtcaggccagcagagagcccgcattcctgtctcctacagtgatccttcacagcacctttttaaaaacttaaaattcaatattgcattacaaatattgcattcgctttatagactcccacgtgccatccataaaaatcatttaaaaaggtgaatatgtgtaatgttgccttgaatataaatgacattttcaatctgtaaaaataaaatatctgcatttccatactctctggacaccctctggatctgaaactggccttagagataatctcattgggtcttcaagaacatatgaggaaaaagatttccttggtctcatctggttgttaaaagaaggagattggaacttgggcttcctgaatcccagtctagtgtgcttcctagccacctgaaagggatataaagatgtgattcagttggttactgagctgcctgttttatcacctacaattgaatttaataggatcatcctgagatgccatacaaatttcttgatgtcatcaacagggactttgccctcatcatccagagggtaaaaggacacctttatcaggattgaggattgtatgggaggagcactgcaaagcatgtccaggattaaggccacacagctctcctaggagaccctcaggatggcttttctctgtggcagctgctcgtgtttgatttgcaggccgctaatacaaatccactgtttagtgacgagggagtacttgccttactagtaagtaa

SEQ ID NO: 24256 - DNA, 1026 bp, Homo sapiens
cttcccccctcctttagtaaggacaaatgaacttaggtcatcaacttgctgcctaagccacattaaatcatcaccctcaaaagctgagggaagactgtgctaatcctgcaaagaagtctttactaggtgtatcaagaaggttcagagtcattttgcaggaaagagtaactgctggtgctactggcagggccactgtttgcgttttctcattccctccctcatccttcctgctgcaaacaggagatgttggcggatgctgtccattgacagggtggttggagaaatgaggatggtgtgctcagagaccccaccacccctgctagaaggaaagttaagtttggatggaaggggaatagagagaagtcttaagacaggagctgtcaaactatgaccagcagtagttgggacccagctacacttgctcacagatgccttgtctgtgggggactgtgtggccagcaaaacccagaacattttgacccttgacagacattgccaactctgccttagagcactgtgctgcactgaccacaggagtgaaaaggccacacttggagcccacatagcaggtcccccatggcctggtggtatggacgagtggggaggctttctgctgcccccactctccccactcagatccttcttttttttagttacttaagaatcatcatttagcatgagtgtgttaaatgagtttatttcagcacatttcagtgcatctgtgactcaccctagacattcagtgctctacgtgtgcccaggctggatgcctgtgcaagaagaccatgttgtttgtgacatgggtggtcactagttttatgttttagtgtctgactttagctctgtcttcctttcctttttttcccgctgctattgcattattcatttttccttttcccccagtttgctgctcattctgtagatacataccttggtgagcctcactggagagctgtggcacctttcagagtggagactggtgggggcagagcttaggaatgggtcaggcacaaagaagtagtgcag

SEQ ID NO: 24257 - DNA, 1050 bp, Homo sapiens
gtcttcctggtgggcaactgtgttttttaagacctcagtgagagttgtctttggaaacaaatgaatggaacgctgcatgctggcctgttctctgctgtatcttcaggactcctgagccaaacctgatttcatcatcttctcgagggctcagtacacattgagctgtcacctgtggtgtgtggcctggaagaaaggcagctcatgagtttgcctaacaggactctcccttggtcactgagggctgagaagtggcactaggaaccaccactgaggcagcctttggaggagccagaattctttggagcaggattgctggtagatttgttagttgtaaggcccacatctcgtcatatgtactatttaataatactgagttgtgactttatttgtggttagaaaaccagctatgggacaaacagtgctggtttgtctctaagcatttaaaatcatttggaaagtgtttgtacttgctgagaggcgggtatattatttttgccaagttcatagtaccatccattggtggtatgaaattaatttctgagcccaccaagtttcaggaagggtcccttgctccatactatgatggtgatgatgtggctgatgatgctgtgctggtgaagaacacagctcagctccctgtggtggaggagggtgttgaattgtcggggaggaagctggagggagcttcttatctctgctctgtgctctcttggtcatgggtccattttcatttctgtagcttctaaggggtccaggctaaaggcataaagttgctttatgctgaacaaactgaccgagcttagcaagtaggatagctctccataagtttaatagggttgggcaatgtatttgaacatagcatgtgtttaattgttttcattgtttggctatatctctctctctatatatatctatatatataaccaaaatacatatgtataaaacaaccatacacacacacacacacacatgaccccccaaaatcaaataggctgatagattactcagaaaaagataagtcacataggaagtgggctatataaaaccaga

SEQ ID NO: 24258 - DNA, 1037 bp, Homo sapiens
aaggaatgaatgagtgggtaagtaatggctccagttacattgtaatgctttgaggctaggctggtatttccttgatatcaactactgcagtggtctacatataaagtaattctcaatttaaatgatttcttatttttaattttaaaattaaagtgtcaggccaacttggatatttgaatttctaggaaatagaatgctcaactgcctgtttctaatatatagtttatttccatatgcatattgccatataaaattatactgtttttcactctcatatttcataaaataacttaaacgtttcccatgaatctttgacattggtgtcttcatcatcacaggaccccattttgggtctcctaacaggtttcagagctcatcatccttccacatgactgtgtcgtgagatgtattttctagtcgtttttatcccaagccacaatgactaatttattcagcactaaaaattaactttttaaaagaaatctttagaagattgtgtacaaaactgtccagcactgtccaaaactgacccagaattgtgggtcattccttctgggttaattactgaatctgtgttaacttgccttcttgtatactgattctcaaaaagcacatcctgagatgactatcagttgagttagtttcaggcttgtgtattttctccatatactgctttcgtgttcttaataaagtaactgataagtgctttgcaaggtgagagtctacacagggaaccaaagagatggtgaactctcccttgctgctgggtgattttggaaacaaagctctaccttatatctagatgcatatagtagttcaactcccacacagtaaagatctggaaattgaagcctggagagggagaggtttcagtggccttttgaaggctgtgccttttgtgtataaaccaggactagaacatttgagtcttaccccagctcttcacaattcagccttaacttttatttttgagataaaaaaaatgagaaattaacttcttttatcctgcccgtccactcactctttgattctgaaaa

SEQ ID NO: 24259 - DNA, 1028 bp, Homo sapiens
gggggagctctggtcccctgtctgtcccagccgtgggtctgctcactgctcagagtcctgtgcggatagagctgggctgggaggctgagctgttgcttagctttgagcccctctgatccaggttgttggcttcccccatccagtgctggggtgctcctgtgcctccatgggcttcccagagagtgagctggtcccaccagaggtcccagcccacactgggctgcctgcttccccctgccaccaggaagcagcctctccaagtgcctcctgtgaatgtgcagcctcctattctgccagaactttctggttgggtttgcagagttcagggagttgtgccacatacaagaaagtatttgccaagcccaatgaggcagttacgtggttgtccagaaaactgagcaaagacagtttgtcattgaagctggtccctcagcgaaaaaggcctcatcaaacaaccaagaatgtaagaaaatatatacattttccatttatttccacctgaaaaatatgaaaagaattgtaggtgtctgtgaatatacccatattgtagcaccacctacctgattaaaatatggaacctgcttattatctgtttgtgtatttcgattccctttgttggggctgttacaccgtggagatagtaaaatgtgattagagtggaatatattcatttgtagacagtttggattgcatctgagatattttcctgattgttagaatttctctcccattgggatttaaagggtggttatttttccgtatatttatcaagtggaagaataatttgacagggacatgttatcaggtaaggcatctttcctaatcgatgtgaataaaatcccatgtaagaggagctcagtgtgtttgcatatttttttaaacaataaaagattggattgttagagcatcagagaagagtgaagacagctgtgctttttatcacagggaacctaaagaaaaattcttactttaaatccttgatccgaagaggcaagttaatttaacaaaataaactcaggacatcacat

SEQ ID NO: 24260 - DNA, 1048 bp, Homo sapiens
agtgagcaaggggtgtgtgcgagaggtagaggggcacagtgggctacctcttgggtaccctgcccagcacagattggaggatgatagctgtctgagtttctcaggctgctataacaaaataccacacactgtgtggcttaaacagcagacatcgatttctgtgagatgtttgtttctcatagtcctggaggtgggaagttcaaggtcaagcttccagcaggtctcattcccagtgagggctgtctccctggtttgtagacagccagtgtcttgctcctcacatggtggagacagagaacatttttcgtgtctcttaaaaggggactaatcccattcgtgaaggttccaccctcatgacctaatcaccttcccaaaggcctcacctcctgataccaaacctaggaagtacagcctttgacatacctaggctacgtggcacagcctgtgttccccggctgcagacctgtgcaggatgtgactatactgaacaccgtaggcagttgagacatagtggcaaatgtttgcgtagctaaatgcagaaaaggtacagtaaaaatacagtcttatgggaccccatggtatatgcagtcatcatggactgcaggtcttcacgtggtgtgtgactgtatttacatggtggccttaagcaccgtcttgagtttttctacacagttccacttaaaaaatggtcttgggggtccaggcatggtggttcatgcctgtaatcccagcactttgggaggctgaggcgggtggatcacaaggtcaggagatcgagaccatcctggctaacacggtgaaaccctgtctgtacgaaaaatacaaaaaattagccaggcgtggtggcgggtgcctgtagtcccagctacgggaggtgcttgcagtgagccgagatcatgccactgcactccagcctgggtgacagagtgagactccatctcaaaaagtaaaatggaatggaatggaatggaatggaatggaatggaatggaatggaatggaatggaatggaatggaatggaatggaatggaatggaatggaatggaat

SEQ ID NO: 24261 - DNA, 1046 bp, Homo sapiens
gtgcagagcctccaggctcccggcctccagccttgctcttctaggcaccgccgaccttttccacctggagatgccacagcctcttaaagtgagcttgtcccagcagcctgccccacccctacctggccaagctggaggcctcttttctcctggtgtccctgcactccggttggttcacctgctcacaggctctatttcttgctgcccctcctcacccctcatgcccactccatgaccaggtcctttagggccggctgagcacagaagaaaaacacagggccctgagttcacaggacaagagaaaagcttttcccctaagtgcggcctctcagcctgtcatggggtttcctatgtgctgtttcatgtcactcctccttgggccctgggtgctgttgggatagtgcagacctcgcagtggcccggggcccacccacactggcacccgggctgctgctggggacaaaggggcagcagcagcagctaagtggctgtggggacctgggtgggaccctgtgagctggagctccaggctgaagcagccgtgctcagggactctcagttctctcccctgtccctcagcacagaccttattttatatcaggtacggctctggcttcacacgtcttccttccggcggcctctgcatggctgcaagatgcacggtcctgaaatgatgctttagttttgcctcttctgcacttaaaaactcattttgcaaagtgaaaattttgctggccttgtatttgaagcctttcacagacagaccccagccccactctcccacaggcctccctgatctgtgacctagaacccacaggtacatggcctgggctttgggccttggccccttgcctgtgtgcaggctgtttcccggatctctctgtctccaggcacacatccaggtatctcagccgccacaggccagcagtcccacctctctctctcttatctctctctccccctggctaccccaggccacccttgctgtctcctgctagggtctcccctccctggtttggaagttgctctcctcctctttcagtttt

SEQ ID NO: 24262 - DNA, 1045 bp, Homo sapiens
ttgtgcaaacaggtctgtttacagcagttcatttttatgagttacaattattatttctggataattttggtgtatggtaatcattagagtaagctgtgtgtctgattaaagaatttgtctctaatttatgccaatttaaagatgtcttctgtgttctctttgtctctgggggagggaagcaggttgctatggagacaacataagaaaaagtgacaggcaagaaggcttggcagtttcgattttgaaaatatttgtgatgtaggtaattatatatgtaataatgttatgcagcagaaccatctgcctttggagagatgcatgtcatggaatttcatggtaaaacagtgtttctcttaggaacaaaatgttatttgtgtgctattaagatattgaaattgtggaaaataaagatgcaatggagccctaagattgtttccaggggtgcagttgctgtatgatgtaaggtgccacctatagaatttggaaagctattttcacatggaaacaaaacatttgtataggaagacttacctgagactgaattattttatgttgtaaattgctaaaatcaactgtattcaggtttataactgattttgatcagtttaaatggcacaattttcttttttaaaaaaaattaaactatacctcatattgtttggggaccaatttaacaaattggcctatggcagtttccctgtatcatcattttcccagggatcttggcttagttttgctctaatctggaattccttcttttactcttacacagttgagcattccccctcccccatttttaaattctggtgagatttaaaagaagaagaaactttagcatgcgatttgttaaattcaacaattctgcaaatatttacggaatgcctgtgctgggcacagtgctgggccctcagacacacatgctgctgcccccatgggctcagagtctgagcttaagctctgctgagacagcatgcaactgccctgtggcacctacctggctctgctggcagagcaaagctgaggttttagttcacatcttcatgtg

SEQ ID NO: 24263 - DNA, 1033 bp, Homo sapiens
taggtggagaaagacaagaaccaggtgagagccctgccttccctgcacggaccaggcttgtagaggggtgtgtctctcttcctcactgtttctgttctgggattatgcctgttatgggcactgacctctctttcttggctgcagtgccatttgggggctcagtcctcatttagctgaccttaatttggatggttcccaactttccatcaactggcattgcacatgactggctttgtggagttccacctctctcgctcacaccccattcacaatgaggatagaggggctaccgcctggagcatgggaggatcctgaacttgggagcttccatgagagaatgtatttgagttgttctcagactaccgtttttgctcagcacttttttggggggctcagtattatttccaaaacattttgtgtaattacataaggtttctacttctttaatttgccaagtaaaatgttaaaaaattttcaccatcacttaataaaacaaggaacattttagtattgcaaaaggaggaagaacagccatttttatccgacatagaattggaagctctagacagagaaattagggaaggaaaataaattattggcttccaaattggaaaaaaaaaagtaaaattatctctgtttgcagatgatacgatcttatgcatagaaaactctaaggagttctcagagttttcagagctagtaaatgaattcggcaaagttgcaaaatataaaattaaagctcacagttcagttgtatttctatagacttgaacaatccgaaaaggaaataaaaaattcaatttgcaatctcatcaaaaagaataaaatacttgggaataaacttgaccaaagaggtgaaagattggcacactgaaaactacaacatgtttttgatacaaataagtggaaatgcatctcttgttcatggattggaagacttaatattgttgagatgacactactactcaaagtgatctacagattcagggcaatctctatcaaaaccccaatggcgttttttagagaaatagta

SEQ ID NO: 24264 - DNA, 1052 bp, Homo sapiens
actacatctaggtacctcgtataactggaatcatagaatatttgtcctttgtgtctggcatgtcacttaacatcatccaggctcatccatgttttggtatgtgtttagattttttttcttttctttttctttcttttttttttttttttgaggcggagtctcgctctgttgcccaggctggagtgcagtggcgcaatcttggctcactgcaagctctgcctcctgggttcacgccattctcctgcctcagcctcccaagtagctgggactacaggcgcacgccagtatgcccggctaattttttgtatatttagtagagacagggtttcaccatgttagccaggatggtctcgatctcttgacttcgtgatccgcccgcctcagcctcccaaagtgctgggattacaggtgcgagccaccgcacctggccgattttttttttcttcttaaggcagactaatattccgtcgtatggatatactatatattgtttatccattcaaatacggacattcctcaacttgggatggtttgactttagagtttttgactttatgatggtgcaaaagccatatacttccagtagaaatctgtaaccctggccaggcatagtgcctcacgcctgtaaacccagcacttccgagaggccaaggtggggggctctcttgaggccaggagtttgagaccagcctggccaacatggtgaaaccccatctttactaaaaaaaatggaaaaattagctgggcatgatggtgcatgcctgttatcccagttactcggggggctgaggcaggagaattgcttgaacctagtaggtagaggttgaagtgagctgagatagtaccactgcactccagcctgggcaacagagagagatcatcttaaaaaataaaaataggaaagaaaagaaactgtaaccccattgtaagtcagtcttccacttatggtggggttatgtcctgataaacccattgtaatgtcagaaaatcgtaagtcggggatcatcagctatgtcaccagcattaagtacattttttaacttatgatattg

SEQ ID NO: 24265 - DNA, 1031 bp, Homo sapiens
aatgcggctagaatcatcccaaggcagaattgagattctaaccgctacgcacacacactcacagccctggatcctcctttgtgtgtgttctttcaacatggtgatggataattttcagaatggggtctttgggtacatctggtatgggtgaaccatatcttgacactgagtgacattggggtgctgccctgtcccatccctgtgtcatggccgggcctcctgcccccaccactcagggcagcccgtctgcctctggccagctgtcggagctggacttatccctccctggtctgaggaataagatgtacccttgggtcagaaccccccacagccctctgcaatgactgtctgacagcctttttcctagtaagctgcttcttgcttgtctaggtgaaatctctagcaattgcccaaccaaaaactgggtcttggagctgatggctacacatcccctgagggtacctctgaaaagcaagaccttttgaaggatggaaccctgaagagctggtgcagaagcaggactgtgcaggcaccatgagggcaagcacgaagccagctgtctgcacagacccaccagcatcccgcagctccacactgctttcctggtgtgtgggacgcagggagcccccttcgcctctaactgtgtgctgcactcacaggggccgagtagggtgtgtttcttttggtgatgatgtctacttgggctgaaggctcagagcgctcgttcctttggagaccctgctgcaggcgagtggtgagcacatgcttccgcacagacacagctgccaacggtcctcctccacaccagcgctgagttgtcatggagacaatacaggctgggctgtgtgtggtcagcagaggggcactggcccagctgggtgggtatgtgagaggatttatgaaccagcatcaatgcatctcagttaaacagcccccggtactgccgcacacgcaggacgtcaggcttggtgtgtgtgggttcccggactggtgttctgtcggcaaacgttctctaacatccctgacccggt

SEQ ID NO: 24266 - DNA, 1052 bp, Homo sapiens
ggatctggatttcttagaaagttaaaaagtcattattccttggaacaaacattatggagatttgagatttcaagttcattggtcctaaacatgttatcattttttttgtatatcaaaagtgaattcctaggtgtgtgcccaaaagaattaaaaaacaggtggtcaaacaagtatacaaatgttcatagcagccctatttacacagtagcgaaaaggtgggaccagcccaagtgtctatcagtggatgagtggataaacaaaatgtggcctgtgcctgcaatggacttttattcagccatcaaaggaaatgaaattgtcatatatgctgcatcttgtgtgaacctcaaaaacattatgctcaaaaaaagccagccacaaaaggtcacatattgtatgatttcattggtatgaagtatccagaataggtaaatccatggaaacagaaagcagattggtggttgccatgggctgagaagaggcggcaatggagcagaattacttcacgggggtagggctttattttggggtgatacaaatgttctgatagatagaggtcgtggctgcataacattgtgaatgtagtaaatgccattaaattgttcactttaaaatggttaatttcatgttatatgaattttgcatcaataaaagagctagttctaagcaccatttatactgtaatatttgtagattaccataatgtaaaattgtccccaccatataaaaatgttctagatagaggtagtggctgcacaacattgtgaatgtagtaaatgccattgaattgttcactttaaaatggttaatttcctgttatatgaattttgcatcaataaaagagctagttctaagcaccatttatactgtaatatttatagattaccataatgtaaaattgtccccttagaacatctcagaacagcttccaccattaaaaaaaaagaaaatgtgttccacgcttgtctgccttattatcaccacagcaagagcctgaggttgacctttcatgaagctttgcacaatcatcatgaaatgtggtttctcgtactttg

SEQ ID NO: 24267 - DNA, 1033 bp, Homo sapiens
gagagtagagatgaccaaggttcatgtttcggggagggtgtaagaaggggagtcctgagctgggggactcggcttctccctgaaaggagcagtgggcaaatggacagaatcaacagacttccctcgagcacctgtcaaatggcaggcaccatgctctgtgctgggataaagctgaagtcagccccacgccggcggtccctcaactgtccagagccctcaggactgtaggagggggcatggggtggcaggtcagccttctgtatcttcattacgtagttagaaacagttcccagaatttcagtcgcatctgtgcctggtgtgccctgcatttcggatgtgtcacacttggcctctccctcactgtacaggaacctggatgtgactctggaatcaggatcactgaggtttgcagatgatggtttgattggattttgaaatgattattttctcagtgtcatttcatttactgctctttatgtgaccccggcctcggtgatggaaatcaactttgtgttctcaattactacgactgtataatttcataagatttagtatctcccgtgaagagtcctacttctgctaggacattgggcagctgctgcatctccgagcagtccgtggaataccaagtgacaggcgctggtccgttgaaagtgcctccctgagacttacgtgtacactgtcgttatctatcaccctgcactcctccgcgtgcgtagctcagaactgactctgaattaaacaggcagtgcttgggtttggatgtcctctcccactcagggtgcctcccattcatgaggagccccaggtgtattgtgacaacaagatcattaccacaagcgtggctgtgggtggatgtgtaggttttgggaaatgattacttggaaaattaagttcttatacctggcagtcttacctcttaaaagtggagaaacagtggccaggtagactttgctgtgaattacaagggcatttcttctgctgaaaggcatttcaggccgggtgtggtggctcacgcctataatcccaacat

SEQ ID NO: 24268 - DNA, 1096 bp, Homo sapiens
ccatgtcttcatggtgaaaggcaagtccctagggatgcaagcccatctgtacccaactgaaacccatgttacccttcacctgtatcttgtttgtgggtattgcatcggccaaggcaaatcgtggggctaagcccagggtcaagtgtggggacgtgcactctgcagaagtggagggtggggatgagtgtttgctgggcagtagtacacccgaggctccgtgagaatgtctactttgagcagtcaagagaagacacagattttagacttgtaggtttcctcattccaaagttggtgtgcttgtacttgattttgaagttatctttcttccagggtgatgggggagcatgaaagtaagaggatcttgggaactgctgtgcccattaattttatggcaaatccacgtatcacctggaaaaccatccatgggatattgagtagtggaccaagagctgtggtccggattccatgcatacgttttgggaagaggctgacatgaagcgtgctattagcttgtcgagagccctgctgacttctgaatgtggcttagctcctgccacgtcctttgttcttccaaggttaactgctgcaaagggattgcagtggccagtggagggctagtgaaggttcaagcacactgacaattaggctaaatcggcagtggcaggttcttgcatggaagttgcatcacctgctggagtgactgtcccttgacctcctcctgtctactgggtcttcctccacctcactttaatgctgctatgctgctaatgtgaactctgaggctttaactggggaagtcgccaccgccccctccatcacccttgtcctacaggtcagggctggaatgaggagcacttgcagttgcctagtgggtgggatttcaaggaaacgggatacctttcttccccaccccttcaccttttcccagaaatggtctcatcactgtttccttttggaattctgtcattggaatttcctgcttttgcagctcttgccagcttgcgtttcttttgaaattcagtacgcttgggagcagtgacgcgaaacttcgcagacgctgacctcgctgacagagccaggccgggcaagaagaggt

SEQ ID NO: 24269 - DNA, 1048 bp, Homo sapiens
caggtgaagtgtcatattttaagatgtgctcatgagaggcatggatacaaggccaggcctccctggctgacatttgggtgcttgccatgggccaggccctgccctccttgctgggtgagcgctgtaccagttggtcatcgcaatggtcttaagcatcactgaggaagacattgaggcccagatagggactgtccttggccaaggcctcctagccttgagtaggggccccggccagcagtggggctcactgcctctcaggctcaacatcccagggggatgggaagaaaacattctgggagatgagtggagagagactgattctctgtaggtgatggcatgtgccttgagctgaaaggtgcttccggtttctttgtagcgatggggtcagctgctccaggcagctgtggcagcatgagtgaaacagaggggcttattccagtgcatgtgggggagaggagggaggtgggctcagccagagcagagggatttgaagagtggcagtggaggagatatttgaaaggtgtgttgggacccgtatgcagggtgccgtgtttggactttgttttgtagggcacaagacagttgaaggctttggaactgggaggaaagtgacaagaaggagtaccaggctgtgggacactggacactgagaaaaggaagaggctatgggggaagagaggggccgtgagacccggggcaagtgtggacttgggggacacagtagcggaaagcagcaggcctgggcagtcacctaactgcaggtgccaaggtcgtggtctgtgtcccgggagaccagcgggtgggtgtccagagatgggggcaccagaaccatgtgggtcatgtatatttaatgctgcctgcttgagaaagcaggggcttggcatatgttttaggagaaagttttatttcttgaaatggttaaactgataaatcctcagttatcccaaaggctcagggttccagaaaatggctccgttgaagggtgaatcccatagatcttataagagtgattgtaaccctgccttggtatagccagggagcagagata

SEQ ID NO: 24270 - DNA, 1047 bp, Homo sapiens
agagcccatacacgacacgtttccatcagtgcagaaagttccactggacagcactgctccacaataatgaagaaaaaggaaacctgttttactttactgagtataattagcagaaagtcttatttgatgacttttctctgggtcccccttgtcaagtgtgagtcctctgagtggagagggctatagtctctccatagtaaggcagaaagacgtgcccactgggaaacacccagcaatttaatagggccctgggtccaacaccaacttggagttcttaactaatgccaagccaggtaaagtgctttgttcattgagtcttgcaactccattagtgattcaaaacaaagtaaacctctgtccctatctctgtaggatagttgcagggaagcaatagcttgtgtctgtagaatgcacttgcttttactaagaggcagtaaggaactgtctcagtatgaaaatgtgcatatacagaacgaccatccgtttttggtgtaagcaaaggggaccatgtgtgcctgttgtgcactgtctgtgcagaactttcagaaactgtcagtgatgcacaaggacgtgtgtgtccagagaagagacgcctgtgcaggctttcctggcagtctataaaggggcgagctctgtctcagtccaggctttcccacccagggttcctctggggctctttcatctcattatgtctggctattgtgacatttagagtattcaggtgaatgccggttgctgccttggtgtggaagggacgtcgtcgcttttccaccctagaatgacctttgatcttacctgtcaggacgtgatctaggcatcaaagccaccagttcccagaacgtcacctgcgaccagcataggtctgtgtctctgggttgttttggagaatatggagccttttgagatgcattagcagaagtctttttggtctgactgtgtgagattatatgtgcatgcatcaggggcttttttcacccaaattgcaaagattcccagtatttagagattagatgtggttagaaaagtgcatttccagtatgcaattgt

SEQ ID NO: 24271 - DNA, 1308 bp, Homo sapiens
tcagatctttgccaggggcaccctgtcatgcccctggggtctcccctgaggagagacctctcaccagaggagctgcagtccactgcctctctggaggggtttgcctgcaccctcagcacctggccgatcctccgatgggtcttcctggtgctgtgactgtctgtgactagtcgtggatgccggctgagcctgggagcagcggttaccggaaatctgtggctttctgctttagctaaagagagaagactgcatgtgtttgccagtcttttgggtgcttctgtttagcatagacattggccaaggctgctggtaaagagcaccagagaggcgctttacccatgagagggaagcatctgcggcccggagccctctgcaagctgcctcatgggacccctaacagaccttcttgcctctctgagttcagggtagaaacaacctgctgatccgtctgtttccctctggcacgccaactctctcctgagagagctcctcctcctgattctgtgttctgagagttgcgcccaggggtgctgcacttgctccttccttctcagcctgtagctcagctctgacactcccgcgactcccccagcaccccgagcagggtgcaggtcttcctggacgggcttggggctgagtgcagcagaagcagcacaaggctcctttgctgcctctgcccctaaggagtcccaggatgtgtgaggaacagagctttctcctgtcccgagctccccgcagttcagccctctctggactagacagttctgcatttcttagctcactgtgctgtgctaaggaagccagggctgccccgtgggtggaacatcctctaatttgccaggcaggaaaggatggggcgatgagtcacccttctgagtgattcctgccgagcttcctacagaacatatccaggagcagccaccccgcccccagggttagtgtgtggaggcacaggtgctagtgtgggtggtgagaaataggactcggaatcaccctttttaacgtgcacagtatgttaattgtgtcctcacaaaagtgttgaagtgtttcttgccttatagaataaatggtcagaaaccagtggattcctttgagctgttttgatgggaggaaattaactgtgacagtgagaccttggtggtcccaacatcagcaggatgcagaagacagcctagcctgctgggtcatgtattcgtcttcggcagcctgggattgggaatgcgcgtgagtgcagagctgctcactgcctggtgccctgcagctccagtgctgcctcagtgcgttccaggagagacctcagtttccagc

SEQ ID NO: 24272 - DNA, 1063 bp, Homo sapiens
ctggccctggtccatttctccccgaaactgccgtagctaatcccttcccacctgcccatgtcccttttgctgcccctcagcatggcattctacctaccaggcaacacacagacacatacctgtgcagaaggctcctgcccgcccttccagaccatctgacatgttcacctctccgcagctttctatggccccatgtcacctttccaccaccaaatcaattcccccactgtctctttgcctacaggacttccagtgtgcccatgatggaatattatttgtgtgtatggccatccccccttcctccctgggcttttaggtccttgaaggcagggctaggtgccactggcccacaggtggggctctcacacgctagcttccttgttgggtgggccacaagacagcaccggcagcattcctcactggatggtcttgtacataaagcagcatggtacctgagagactgtgtggccttccccaactcccgcaggcccggctgcacatcgatggctggggagaggacacagctgcggggctctggctgaaggtgtccagggcgtgcagccggctgagcctcagatggcccgtcctgctcatgtttgcacccctagggattcttcctctgcgactgggagaggtcagaggctcagctggtgctctgggcataatggagtatcattcacatgtcagtgctctgctgggggagggaggttaatcagaggagagggaaagaggccattcaggccaactccactatgacacatttgcttttgaggttactggatcaaatcgggaaatgattgcttacattttagaaaaatttcctcataaaccaagtatgaagtcaagcaggtgcccgaggaccctaaatgggcagtcagctctggagtgcccaggtccatcactgagagcagctatatcacgtaataagcagcccacgttctcggaggcaccaagctgtgaatgcttgcttctcactcatactatgagtcaccggtagaagagggcttggctctaccatcctcacctgggacaccaacaaacaccaggctgagtctagccacta

SEQ ID NO: 24273 - DNA, 1065 bp, Homo sapiens
cacaacaatactgaaatcaggccttttagtaacgctaagtgacctctaagtggtcaagtgaaagctagagtcgaacatctctcactttaagtcaaaagttagaaatgattaagcttggcgaggaagtcatgtcaaaagctgagataggctgaaacttgtgccaaacagttatctaagttgtcaatgaaaagaaaagttattgaaggaaattaaaagtgctactccagggaacacacgaattataagaaagtgaaacagcctaattgctgatacggagaatgtttgagtggcctggatagaagatcaaaccaactgcaacattcccttaagccaaagcctaatccaaagcaaggccctaactctcttcaactccgtgaatgctgagagaggtgaggaagctaaaggaggaaagtttgaagctagcagaggttggttcgtgaggtttaaagaaagaagccatctctgcaacataaaagtacaaggtaaagcagcaagtgctgatggaaaagctgtagcaagttatccagaagatctagctaaaatcactgatgaaggtggcgacactaaacaacagattttcagtgtagacaaaacagccctatattggacaatgatgccatctaggactttcatagctagagaggagatatcaaggcctggcttcaaagctttaaaggacaggcagactctcttgttaggggctaatgcagctggtgactctaagtgaagccagtgttcatttgccattccgagaaccctagggctcttaagaattatgctaaatctactctgcctgtgctgtgtaaatgggacaaccacgcctgcatgatagcacacgtgtttacagcatggtttcctgaatattgtaagtccattgtcaagacctactgctcagaaaaaaaagattccttttaaaatattactgctcattgccagtgtacttggttattcaagagctctgatggagatgtacaaggagatgaatgttgttttcatgcctgctgacacagcatccattcttcagctcatggatcgaggatagtttagattgtcaagtgttcttat

SEQ ID NO: 24274 - DNA, 1032 bp, Homo sapiens
agcctggctaacatggtgaaaccctacctctactaaaaacacaaaaattagctgggtgtggtggcagacaactgtaatctcagctacttgggaggctgaggcaggagaactgcttgaacctgggaggtagaggttttagtaagccaagatcacgctattccactccagactgggcaacaagagcaaaattctgtctaaaaaaaaaaaccaaaaccaaaatcaaaaacaaaatgacaacaacaaaaaaactcaatgcatacctacacatagaaaaaaataattataccaaaatgagatatcacaattctacttttaaattttaattttaaccttattatcaaaaaacctttatggaagtacagcatacatacatactaccagcttgggaacaaattgaaattgcaaatgcaataattatcagaaaatgtctttctttgcttgtgcgtgatgtggtggcagcaggtgcggctttgagatgcagaatgatgctggtgagttcgtggacctgtacgtgccgtggaaatggtccgatagcaactgcatcattgatgccaaggaccacgaatccatccagaagaatgggaccaaggttgataatgtcgcaagcaggttttttttttttttttttgaaacagtttcgctctcgttgcccaggctggaggggaatggtgggatcttggctcaccacaacctccacctctgggttcaagtgattctcctgcctcaacctcccaagtagctgggattacaggcacatgccatgacgcccagctaattttgtatttttagtagagacagggtttctccatgttggtcaggcttgtctcgaactcctgacctcaggtgatctgcccgcctcagctttccaaagtgctgggatagcaggcatgagccaccgcaactggcctgatcgcaggcaggtttaacagccagtttaaaatgtatgctacctgcggggccattcgcaggatgggtgagtcacatgactccattttccaattggccaatgccaacagattgtattaaagaact

SEQ ID NO: 24275 - DNA, 1059 bp, Homo sapiens
ctgagaaatcttggtctgtaggtttttttcttcctgtacgatctttgcctagttttggtatcacagtaacactggcctcataaaatgagttgggaagggttccctcctcttctgtttcctggaagagattgtgtagaatcagtgttattttttatgtaaatattgggtagaattcaccaatgaaaccattaaggcctagagatttcttttttttacaatcttttaactatgaattacattttcttaaactttaatgagatgattcttgttatgtatttcatttcgtatgatccttggtaacatgaaatattcaaggaattacttcatttcagctgttaccaaattatgtgtgtaaggttgttcatagtgttttattttatccttttgattactgtgaggctgtactgctttcccttctttcatttttgatttcagtaatttgtgtctatttttgtctttgtaaatttgttagaactttatcaattatctttttgaagaacaacctttacttttacatttatttttctctatcatatttctatttttattgatttctgtttttatatttattatttattttcttccagttgctttgggttttactcttgtttttctagtttcttgaggtatacttagattattgattttagacttttcttcttttctcttgtaagcattttatgctataactttgcctctgagtactacttttcctgcaccccacaacaacttatatattgcattttcattgttctccacttctaatttcccttgagacttcctccttgacccatgaattatatatagaattatatatagaagtatgaggtctaatttttaagtgtctagaatttgtcctgttctctttatgttattgatctcaaatttatttctattataatcagagaagataccatgtctaatttatgtttagatttttttaattgtcaaaatttgtcttgttacccaggatatggtctatcttggtggatatttcatttgtccttaaaaaaatgtgtatttgctattgttgagtagaatgttataatgtcaagaaga

SEQ ID NO: 24276 - DNA, 1086 bp, Homo sapiens
tgcctgacaaagaggagaagcccaggagatgttgagagtcagtccagctctgcctgttagcctttcagacaaataaagttgaagaaggcaggtagcaagaaaaagatcctgacctctgctctgccaaagtgtttttaattacctggatctagctgtaaggtttgccacgtagtggtgacagctgaggtctagctcagcactactcagcagggaagccacacatgcattaagcacttgacataggactagtctgaactgagttgtgctgtcattattgatacacactggattttgaggagacaaaaaagaatgcaaaatagtttaattgttttcatatgggttacatgttgaaatggtgttttaaatatataggttaaataaaatataaacttgtattgcagttaaacacaaagcgtaaaatttaccatctgaaccatttatttctaagtgtactgttcagtagtgttaagtgcacttattttgttgtgcggccaatctccagaacttcttcaccttgcaaaacagaaattctgtactcattaaacaactccccatttccccctccccccagcttctgacaaccaccattctattttctgtctattaatttgacaacttcagataccttatataagtgaaatttatatagtatttgctcttccatgacaggcttatttcacttagcgtaatgtcgtcagggttcatttatcttgcaacatgtcagaatttccttcctttttaaggctgaaggttgttccagtgtgtgtatatcacatacttcatttatccattcatccatcaggagatacttgggttgcttccactttttggctattgtgagtagtgctgctatgaacatgggtatgcaaatatcttttgggggattctgctttgaatttttttggatatatacttggaagtggaattgctggatcatatggtaattctatttttaattttttggggaaccatcatgctgttctccatagaggctgtgccattttacattcccaccaacagggcacaagggttccagtttctccacatacttaccaacacttttttttttttttttttaacagtagt

SEQ ID NO: 24277 - DNA, 1045 bp, Homo sapiens
ttattagagatgggtttcaccatgttggccaggctggtctcgaactcctgacctcaggtgatctgcccgccttggcctcccaaagtgttgggattacaggcgtgagccaccacacctggccctacttttagcatctatgtgttcacttgtagtatatagaaatacaattgatttttgtgtgttggtcttctgttgtgcagtttgctgaactccttaattctaagagtttttcatagatttcctgggaggtctatatagttatgtgatctgcaaatagggacagttttatgtcttctttctgatctgtgtacatttctttttcttgcccagttgcaccagctagaatttctagtgtttatgttgactaggagtggtgagagcaaacatccatacctagtccccaatcttagggggaaagctttctgtttttaatcattaaatatgatgctaagtgtaggttttatatgggtcgtctttaaaagaatgaggaagttttaacctgtattcccagaatgctgagagtttttgtcgtaaatggatggatgttagattttataaaatgtttctgtaccagttgatatgatcccatgatgttaatttatattaacctgttgatatggtacgttccattgatttgcaatgttaagtctctcttggatgtctgagacaaatcctgcgtgggtagggtctgtaattctttttgtgcactgctggattgaatttgtcgatattttgttgagagtatttgcgcctaagttcttgagaggggtctgtcgtcttcttttaagactggtttttatatcagaaccttaattaggaagggttccctcttttattttcaggacgatattgtgtaaaattggtattgattcttttctcaatgtagaattctgtagtgaaaccatctaggccaggagattttttttttggcgggggatgggggcgggggtgggggggatggggggcgggcgggcatttagattatagattttttttttcttagtttttgtaggattgttcaggttgtctgtttcttcccagttga

SEQ ID NO: 24278 - DNA, 1030 bp, Homo sapiens
aaatctgggaaggtaatgggaggccgttttgggaaataatgaattcaaattacctgctgtcttcacaagggaattatcctctcttggcaagcgagtgtatctcactgtgctgctttaggatggatattaaccttttaaatgttgagtgtctttatttgcttaatgctattacaatgccttgtctaaagtgttagtcttttattgccacgagccttgcaaagcctgacaggatattttcccgtttttccagttagagaaatagaggaagttgtcgtgtagttgtcatgtattcagtccacttaagggcagtggggaagcgtttgagacggagctgtggaggctgaatccttgaaggaggaggtgagagaggcacaggtgagcgcaaagtcccagtgcatgtcccctcttctctcccgatgcagtgtcattcccaggtgaacctgccgggctgaacggcctggcccctctattcagtcggagttttactactccagtggattttggtaacttcatttggaaataatttcagacttacaaaaatgttgcaagaatgacacaaagaaccacccttttatatctgccccacttgttttcatgttttccctctttgcacacatgtacaatttatttcagaaaaaactacagacatgatactgcttttcctacactaaaaatacttcagtgtatatttcccaaaaataggagtaatcccttatgtaaccacagtgtaattatcaaaattcacaaatagtgttacaaaactattatctgatctatggaccttattcagattttaccacttgtcccaacaatgcccttctcagaaaaaaaaaaaaaaaagaaaaaatgtattttctggcctaagagccaatgtaggataatgcattgaattcacgtgttttacctctggttccgttaatttggaaccgttcctctgtctttgtcttttatgacagtgacatttttgaaggatcagggcagttgtaatttgcagactccctgagtttgatttatctgatatttctgcatg

SEQ ID NO: 24279 - DNA, 1012 bp, Homo sapiens
ttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcagga

SEQ ID NO: 24280 - DNA, 1041 bp, Homo sapiens
cttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagttttggtgagcgtttgatttgtttgcacaaaatgtcagagaaacagctgaaattatatatgaacatgtacacgcccacacatctgctattatcagtcataaaatgtagctgtgtgtagctcatatatttttgcttgaagacgaatccgtgcagtacacttaaaagtaaacgagtctttaaagttttgatgtggctggtgcgaaaagtattctgcctgcacagtcagatatgactcagcacttgggtggggagttgtgggggcagggaagtgtactaggagccggctctgtactgtgttgatgagtgatatggcaggtgcccagccatcttaccccatcaaccccataatagaaagggcttgtctgcagcacctgctcagggtcaaaggggtcacccaaacgtgcctagaccctgtgtgtga

SEQ ID NO: 24281 - DNA, 1029 bp, Homo sapiens
ttgtggtatataattatttttatatattggtgagttctatttgttgatattttgttaataatttttttgtgtttatattcatgaagaatgttgatctgttttttctgtatttttgtctggttttggtatcagagcaatactagcttcataaaatatattaggaagttccaccctctcttctaatttctgaaggagattatgtggaattggtgttaattcttctttaagcatttggcataattctccaatgaaaccatctgggcctggagatttgtttttcggtagtttaaaaaattatgaattcaatttccttaatagttatagcctgattcaaattatctatttcatgtggggtacattgtgatagtttatgttttttgaagatttaattcacttcctctatgctaccaaattcatgtgtggttatttgtactattcacttatccttttgatgtctgcagagtctatggtgatttcccctgttttattcctgatattaacaatttgtcttctcatttttttctttgttggtcttgttagaggtttgttaattttattggtcttttcaaagaatttgttgtttgtttcattgattctgtattgctttttttttcattttctttttttatctattattttcttctttctgcttgttttgggtttattttgctctttccctgtgttctaaacttaaatgatggatttgagacttttcctctattttaatactataaattttccccagcactgctttagctgtatcccacaaattttgacatgttgcgtttttattttcatttagttcaacgtattttttaaaatttttttcttgacacttctttgacccatggactatttagaagtttagtttgcggctgggcgtggtaatcccagcactttgggaggctgaagcgggtggatcacctgaggtcaggagttcgagaccagtctgaccaacatggtgaaacctcatctctactaaatacaaaaaattagccaggcttggtggcacgtgcctgtaatcccagc

SEQ ID NO: 24282 - DNA, 1060 bp, Homo sapiens
gtacattcagctgttgttggatgaagtgttttgtgcatgtggtttaggtcttgttggtttagagtcttcagtcttctgttgccttgctgatactctgtctcatggttccatctgttattgaaaatggggaattgagatctcagctcttatttttgaattgtctgtttctcccttccgttctatcagtttttgcttcatgttcttttggggctctgttgttagaaatatccagggcctctttccctagaggtagacatttatttatttgtttgtttgtttgtttgagacagagtttcgcgcttattgcccaggctggaatgcaatggcacagtctcaactcactgccacctctgcctcccgggttcaggcaattctcctgcctcagcctcctgagtagctgggactacaggcacctgccactgcgcctggctcatttttgtgtttttagtagagatgtagtttcaccatgtcacccaggctgaggtagacatttatatacatggacataactgaagcatgggccagccctttttaaaactgttaccaaagtgctgagttgtttgaagagcctgagaggacatgaaacatgaggatggtgagcttcagggagactctcaggaagagtaccaccccaccttgagacggcaggtctcagtgacgtgaggtgggtaggatggttgaaaagtctgaaaacaccaggtcacccctgatgatggaagatgatcacacacaagatttacctgctctctttctgccatggttttgggtgttcatggtacacatgaagaagcatcctgagacagccaaagtccagtgttttcttgcccaccttggattctgtggtgctggatatgatgattctgttcttgtcccccttggctagctcagcctccattcatcctttctcctttccatctctggtaggctttccagatttggcaaataagaatacaggacacccagttaaactgcatgaataatgtcgtgacatacctatactgaaaagttacttgttgtttctttgaaattcaagtttaactaggtgtcctttatattctct

SEQ ID NO: 24283 - DNA, 1035 bp, Homo sapiens
ttataccatttcacatatattccattttctccttcagatatttttggctactgttgtcaaatattttactttaatgtatcttaaaataccattgctacactgttgttatttttgttcagtcagtaatcttttacaaagagatttatataaccaggaaaaacacatgtttatgcattatagttaccatttctagtggtcttcattttttggtctttatattttatctgacatcattctccttcttcctgaagaacttttttaaaaatcatttcttctagtgtggatctgctggtatggtattcagctcctgtagtctggggaaaaatatttattttacttttgaagtgttcttatttttatttttagccttcatttttgaaaggtatttttatgaggtatagaactgtaggttcacaattttagcttttgtttgtttgtttttactttcagtacattaaaagaagttgctcccctatcttctcgcttgcattgtttcccacatgaaatctgtgatcatcctaactttgttcctctgtatgtaatgtgtcttttgttcctatttttacccttatcactgattttgagcaattgaattgtgacaggctttggtgtaattttatttatatgccttgtgtttggagtttattgaacttctggggtctctgtatttgttgtttacatcaaatttggaaaaagtttggccattatttcttcacattttttttctgtttccacctatcctcttttttaaggactccagttacatatatattagaccatttgaagttgtcccataactcactgatgatctgttattattttccccttcttttatctctacattttattttggatagtttctgttgctatgtcttcaatttcactcatcttttttggtgtagtatctcatctgacattagtcctatccagtttatatttcatctcatacaccgtaatttttatctcttttttgcatttttatgtctctaagttttggaccatccagaatgcagttataattactttccttttttc

SEQ ID NO: 24284 - DNA, 1025 bp, Homo sapiens
aaaacatttcgtagtaaaatggtagcagataggggtgcctaattggaaacagctcatcctaagtggacttttcccctccgaaacattagacccctgacacacacacacacacacacctcgccgctgctgaagccagaccacctgtccctttccctcctctgtgcaatgcgtgtgctctgtcccactctgaaggatacacggaaggatcacgtttgacctcataccttctaaaaagaaacaatgtcattcactgtaaatacttttaaagatggggaaaagagaatatgatgtttgccaagaagtttaaggtttttctcattcctttttaaaaaccttatttgtgatattagtgatatggaaataaaagatttgtttccttatttcatcactacactgtaataaattaaagcatcctttccccccccggcagaaactgcttgcaagttttcctttttaaaagatagtctttcttcttgtttcctctatcatctagcatattcctctgcagacactattgaagttcatggtggatattgccctgggaatggagtatctgagcaacaggaattttcttcatcgagatttagctgctcgaaactgcatgtaagagtcctcggctatcctggaagggtttggacctcatggtgtttggtctttgcagggttagtgagaggacctgttcctgtttagataggcaaggaagctgcagtcagcgggggatggtgtggcttgctccgaagatggaaatatggctgggtgtttgggagttttcactgcctctgtatctgagagtctggttggcttccaaagctttcccttatgactccagttttaccttcactctctcactcggtaggaatgcaaggtgtgacccttgtgatccttccccagccatcagctagctttggacctagagttatgtgtacgtcagctcctcttaaagacagcagtgaaaatcataaaggcttttccctaagttttcacaacacttccttaggaagaagttttgtactttgaatacatgg

SEQ ID NO: 24285 - DNA, 1068 bp, Homo sapiens
ggccgacgcgggtggatcacgaggtcaggagttcgagaccatcctcgctaacacagtgaaaccccgtctccgctaaaaatacaaaaaattagccgggtgtggtggcgggcgcctgtagtcccagctactcgggaggctgaggcaggagaatggcgtgaacccgggaggcggagcttgcggtgagctgagatcgtgccactgcactccagcctgggcggcagagtaaaactccatctcaaaaaaaataaaaaataataaaataataaaataaagtgctccctgagagatcatgtgtttagacaggagaaagaactaccagctgtgacacacacacagcacacatcccatcctgacagggcccccgtcttcaaggccaggcagtatggggaagagacccaggcctcggagtcaataggccacgctctgcttcctaactggccctgtgagtggctatggcaattaatctcccccaagcactttgctgaccttattaaaataatttcttgtggcattgctggtagcttggtgatggtgatttgaaccttcctaatggggagtctcctccctgtataataagggccatgggcttggagaggggcattctcaccatatttagcaagaacatttcaggactgtgggcctgcgctggctctgtcatggagtgccatgcctgggctgggacaggtgagtgtggacagcaccctccctacacacacacacacagacacacacacacacgccctgctgcctcacatgggagagagagcctgggtccctttgcccacaggctttccgggtcccttctaagccaaaaagaaggacactgttttaatcagagcttcgtcccgttggtagtggttggtttttattgtggtggtagatgtataacattaagaagagaaacaagcactgtaaaacctttaaaacatcctgaaatgctaataaaattagttctagggtttcatggtagtttttaaaagtgccatgtttatgaagtgcctgcttctgaaaataaggaagcatttcagtcaaacaatgttgactatggaaagagttttgttgcagttt

SEQ ID NO: 24286 - DNA, 1034 bp, Homo sapiens
attctttgttgaccttttttttctttcaacacttaaaaggttggtcacttgaatgtcttctggctttcatagtttcagaaagatgtctgctttagttcttatctgtgttcctccacatgttatatgggttttgtttgtgtgggttgaggtttttttgggtgagaagggctggggaattgtctgccttcaggattttaactttatctttagttttcgtcattatgaatatgataattctaggtttgtgtgggcatatattttcatttctcttggctgtatacctaaagtggaattgctagatcatatggtaactctatgtttaacattttgaggaagtgccaagctgtttttcaaagcagctgcattattttataatcctatcagcaatatatgagggttccaacttctccaaactttttgttaacacttattattgtccacctttttgattttagctcttagtgactatgaagtgatatgtcatcgcatttatgagttactggaatgcaaactgccttgctggggactagtgttaaatatatttaactatggaattcaaactgtcttgttgggggactagtgttatttaactaaactgtgataactgaaattaatgtataaatagtctgtgcaaagtaagaactgcctattcattatgaaactaacaatacactgttatacttttttattttagcagtcagaaaaggaaaatatgggtgtatatattcttttatatttcccatgtatttactttttcttctttctttcctctatatatgagctaagaccttcctcctataggtctttctttaatatttcttataggataggtctgctgacaacaaattctctcaattttatttatgtgaaaatgtatttacttttccttcctttttaaaggatagttttgctggatatagaaatcttgattgacttttgtttgagcacttccaacatgtctttccaatatcttctggcttttgttgtttttgaggagaaagtagtcattaattgtattgttctcatgtgtgtga

SEQ ID NO: 24287 - DNA, 1068 bp, Homo sapiens
aaaaaagatgcactgtataagtctctgatgagggataaaaatcctttaaagtgtattattaatcttgagctttcagcaaaaaaaaaaaaaaaaaaaaaaattagttttgatttgcttctgattctcaggtttttctttatgttggaatgtaatacttctttcaattttattttatcttatttttttgagacagagtcttggtctgtcacccaggctgaagtgcagtggcgcaatctcatctcatttcaacctctgcctcccgggtttgagcgattctcctgccttagcctcccgactagctgggattacaggcatgtgccaccactcagtgctaattttttgtatgtttagtagagatgaggtttcaccatgttggctaggctggttttgaactcctgacctcaagtgatctgcctccctcagcctcccaaagtgctgggattacgggcatgagccactgtgtccagcccccattttatattttagtatttttttctctctctcttttttaccataagcatctgttaaacttttaaatcttccttaattataatattttaaagaatattctaattaaaacaggctaagtacggtggctcatgcctctaatcccagcactttgggaggctgaggcaggcagatcacttcagcccaggagttcaagaccagcctgggcaacatgacaaacctctgtctccaaaagttacaaaaaaaattagcagggtgtggtggtgcatgcttgtagtcccagctacttcggaagcctgaattgggaggatcgcttgagctcggggaggtcaaggctgactgcagtgagccatgattgggcccctgcactccagcctgggcgacagagtgagaccctgtctcctgctttttttttggagatagggtctcgctctgtttcccaggctggagtgcagtgacatgatctcggctcactgcagccttggctcatgcaacctctgcctcccacgttcaagcgattctcctgcctcagcctcctgagttgctgggttgctgggattacaggcatgcgccaccacagccaactaatttttttttttt

SEQ ID NO: 24288 - DNA, 1087 bp, Homo sapiens
ggagtcattaaggaggaaggaaggtaagagaggaccttctgtggaaggccttacgtgtcagggaaagtcactcggactcaattctcttgtgctgagggttcttctgaagatcctctttcatgatgtcaagaccctttcgtggttcccatctacatcttgaagaaattgagtgatttttcaaaatgtttaagagaaagtcccgtacctgcaagggacgatgtcaacacaccaaagttgttctttacttagaagctaggcctttgccattgcctgatggttacgacaggcatgattgcatgattccatcttgttcatcagtctctgcagccgataagtgcttatcaggtgctgcctacctggccaggctctgtatgaggccatgggttcacagtggggagcaaagagagacacaggccctacctttcgtggggagagactgtgagcagacagataccaggcagatgtcaattacaagcgaggacaagtgcttcaatggagaacaaaggatgttgaaaggtaacgtaactgagccaagggcccacgatgggaagtgatgttggaactgagatctgaaggccaaacgcaagttagatgggctaagggcggaataaggcagggatccgcaccttccctcaccaaatcaacagtggtgtgcccagtctcacccactgtcctttcctatcaggggtttgtccctccatggtgctctagacctttccctcctcccgctcctgtcttctcatctggcagttaacattgtcacctttttccctctctgatgcataattcttgtcagcatatgcagtcccagcagattttcccaactattcaaaaagatgtcctcccctgatgccacatcctgttccaatgatcacgccttctccagttcccttcacagccaagcttctggagagcagcttctgcacaagctgtcttctattcctctgttcccatccatgttccagtccattccaggctggctcccatcctgattgcctcacagaaactgttctttgcaggtccccagccaagtccttattgccacctccagcagcctctttctgtccccacccccttggacctgtca

SEQ ID NO: 24289 - DNA, 1300 bp, Homo sapiens
ttcaggaggccacatcactagcagtagggagaacaagatgtcatttgtgttcagtgtaagctgagtaaacaggcccttcctagagtgtcctggaaatcacagcaacccattgaaaactgccctccccaccagaacgtgctacgttctttcttcatgcctatgtgtgctccattcctcatttctacttggctcaagaaaacatttctgcagtcaggtgagacttttacaaaagaggagaaaatcaatgcctccttgaacatgatgagatgtgagaacttacaatgaaaaaggcaataatgatagaaattatttcttaggtacagcaatagttgataggatgtgagggtgttaccttggggtgaagtggagaaggtcccaggtgaattggctctcatggaaatttggaattacaaaataaacgtcctgggggttacccagaatacagatttaaaagtttgcctgtagagcaaaataaaacagtcagttgtagtcattaatccttgaggcccaacgcagccgatgggttggtgtttgggaaattctgagatgggagtgagatctgatcggatcctgggaagatgtatacccagttagaacgtgtagggttctgggtccctggcaagtctaggtgggcgggtgacagggaaagcatgggcatttttgtattgctgtcacatgctaacagaggtttgtaattatcttttggacccaaattatagagacattcacgagttttctagccctcacagtaacagagctaagaattcagatgtcaggaagtctgtgaatcttgatggattttctgagaaacctgactcaatggcatatataagagggaagtaagacttttaagaaaagaaaaagttatgcctcattcctcatgtggcttccaataagtatcttaggaacttatttcctttttaaaaaatattttttaaatttttaaaatttgattttaaatttcaaataaatttaaataaattttaaataaattttaaataaaattttacagagacgtggtctcactgtgttgcccaggctggattgcagtggctattcgcagttgtaatcatagcacactgcagcctcgaatttctgggcttgagcagtcctcccgtctcagcctcctgagtagctgagactacaggtgcacaccaccaagcctggctttatgtatttatttctgttcatgcggaatgattggttcagaactgttcctttcccttccatgatgtccttgacacagaaggttatgcctggctcccagtcaggcttcatacttttggtccatgtaagtgct

SEQ ID NO: 24290 - DNA, 2001 bp, Homo sapiens
tgagtcatgaaagcaagattgaatcgaaaagtgtaattgcattattagcgtagagtaatggtagcagaattcaagtgagtatggtgggggaaagcttcgtttagtaagcatccccagtgtctccaggcactaggctcagaggatgtggaggaggcagtcccgtgtacgagacagttcatgcatttaagtgctccctgtcgtgtttgggggttgaaggggtgaagataatgaaagcagtgcatgccaatgttcttgagaactgctctgccaagggattgtgtgggctactgcgggagcctatgggcggcgcaactaatccaggagtttgagaaagggcaggattagatgagttcaagaagtgagaaacgtgcatttcgtccaggggaagagtagagcagagtcacatgcttcggggaccctacctgtggttttgttgggtaagatttgtgttgtgggagatagggatacagataatgtggagagctttgattgccagtctgattcttgaactctattcggcaaataatatgggagccattaagatttattgtttagaaagactagaggggtgggggttatttgtattgtgcctggattgttacagtatcatgtctgtgagaaaaaattcctaattaaaagttaatcgggctgggtgcagtggctcacacctgtaatccaggactttgggaggccaaggcagaaggatgacttgagcccaggatttcaagaccagcttggataacatagtgaaaccccatctccacaaaaatttaaaaattagtggggcatggtggtgcgcacccaagtagctggtcccagctactcgggaggctgaggtgggaggataagttgaacccaggaatttgaggctgcaatgagctatgattgtgccgctgcactccatcctcggtaacagagtgagacctgtctttaaaaaaaaaaaatccaattgagaaattttagaaaagcactaatttaaaaataagccagtcggctgggtgtggtggctcttgactgtaatccctgcactttgggaggtcaaggcgggtggatcacttgaggtcaggagttccagaccagcctggccaacctggtgaaaccccatctctactaaaaaatacaaaaattagccgggcatggtggcacatgtctgtaatcccagctactcaggaggctgaggcacgagaatcgcttgaacctgggaggcggaggttgcagtgagccaagattgcaccactgcattccagcctgggtgacagagtgagactctcccaaaaaaataaatacataaataaataaaccaattatatgttaacatttttaagaaaaatattttccaaagcaaaaaagaagttagatgaattgcattattaaaaatctttttaatgtctggcttaatgaaaagacagctggattctcatgtctgcttgtgcattcagtcccttgtgataattgttttggttgaagtagatgaagaaaatttggccctgcatagaaaatgatgccacaacttagctaggactataataatatagtatttgaaaaagttctgtaaaacacagtaacataaataactaatacttataaagccaagggaaaaaatagttatcatattttttacttacaaaacataattttgccaagtttctttggagtgaattcctcctttctgtgagtcagaatttatgtgtctgtcttttcaaaatacaattgatttttattacttggggattccatatttgcaaattcacctactcactaaaatttacttctactccaaaagcaccatgcccagaagcagcaaaaaagttgagttgctcagtgtccattttcccagctgagatctaacaaggtgatgctcggccttcttgttttaagttcttaaactataaacagaggttgtcttcactatctatttagtgccgtgttttgtgctttttgttggtgattttgctgtttaaaatgtcccccaagcaaagtattaaagtattaaagttctgt

SEQ ID NO: 24291 - DNA, 1049 bp, Homo sapiens
tactcgggaggctgaggtgggaggactgcttgaatctgggaggttgaggttgcagtgagccatgatcatgccactgcactgcagcctgagcgacagagcaagaccctgtctcaaaaataaaacaaacccattttttttgctcatcctctaagaagcaattcctcatccattcagtctgattatgggattgcagcaattcactcatagcttcaggctctacttctaattctagtggtcttgctatttctaccacatctacaagtccagtagtaacatcagagatcactaatcacagatcaccataacagatataataataataatatttgaaatattgcaagaattaccaaaatgccagcacagagacacaaagggaacacttgtcgttggaaaaatggcattgataagcctgcttgaaatatctgaagtgcagttaaaagaaataatgcctgtacctgttttagagacaaggataatttgatatctgaactgatacagcagctgttgaccccatctggagggaatctggaatgttggatgaagcattctgatgtgattgtgctgtttgtttcctttaccaggggtcactcccattgatggagctccccaccgatcatacagtgagtgctaccctgtcctgctggacggtgtcatggttggctgggtggataaggatcttgctccaggcatcgcagattctcttcgtcattttaaggtgggcttgaggctttgtgaattgtcctatcccttgaccttaggtttttcagttcctttctagttttggggttaacccctgggcggtctagagtgatcaagtggtcagggggtcacaatgtccagaatgcctgtgcattccctctggtgacagaggcttgccttatactggcctcattggttggggtcagtgacagatatttgacccatatacattctttggcagtttcattgaggcacctcagtctgcttatctaactaattttaacttttttcccccttcttaatactagtggcatagaagggatctcaaaatacagatatttcagtaatat

SEQ ID NO: 24292 - DNA, 1082 bp, Homo sapiens
ctgagttaatattactgtgatggttaccacatggtgttttcccccaccagcattttttctatgtttattagttgctattctgtaagggagggctttcttttctattagttgttcatttatttatgttagcgtagatttatagatgcttgtttaattttgtgaatattctgttactacttattttgatgctcagaaagtgtatgagatttgatctagtgtacagttgagggttttaagtacattcatgttgtggagtcatcaccatcttcagaactttctcatcatcacaaattgaaactctgtaaccattaaacaatcattcctctttttttttttttttgaggcagagtctcgctctgtcgcccaggctgcagtgcagtggtgtgatcttggctcactgcagcctccgcctcccatgttcaagcaattctcctgcctcggtctcccaagtagctgggattacaggtgcacaccaccatgcctgggtaatttttatatttttagtagagatggggtttctccatgttgccccggctggtctcgaactcctgacctcaaatgagctacctgcctcattagtctcagattttatcttttttatagagaatttattttcattctcttttttttggttagcattgtggagcatcggaggatgaggacacttaagatctgctctcttagtaaatttcaagcatgcaatatagtattcttaactatagtcacatgctgtacatgagatctccagaaacttaattttgttgcataactgaagctttatactctttgaccaacatctccccgtgtccccctccaccaaacattctctcatttttaatgataatgcatctagctgtgaatccccatgagttctgacacatgggtttgttgttgttgttgttgttgttgttgttttcaggtttctgtaatttaggtttttatttctcctttcacccaggagtttgttggagtttttttgttttgtttttgagacagggtcactctgtcacccaggctggagtgcagtggcatgatcatggctcactgcagcctcaacctcctgggctcaagtgatcctccca

SEQ ID NO: 24293 - DNA, 1087 bp, Homo sapiens
gcagattccaatgtctgggtcatcttagtatcagtctctttgagtataagtcaagtttcaccatttctttgtatgcccagtaatatcggattgtattatgaacattgcgaggagtatgttttaaaccctggatcctgttagggtcctctgaagaggattggttttgtttgtttttagtgtggtgtttggccttcaattacattttaatttttttcattttatgtctttccttcttaatacacagtccatcacctggttcagtgcatgtcaccaaaaattctccaggggaagaggattggtttttagttttcactggtacttaacttggtgaacgtggcagttgaagtacattcttcagccttaggtgggctgctgtgatctgtcccatgcatgcatagttcaggagtccaccaaagattcggacccaatttatatgctgaatttaagggtctccctttgtggttctctcatttctgaaatgttcccccttcccaattgttgtcatgctcagaactctatttcttggttcttcaagccagtaagattgtgggtttctatctaagttgtagctgccacactgggccataaggcaaaaataaatacataaatacttaaaaacctggaaattcacccagtgtgttccttttgtccaagtaaaaattcttctcagcttctgacagcttttggttactctccagtgctgtatgtgtagttgggggtctgcgtctcatacttatgtgttgagggtggtctagtaagagtagccctttattactggaagctctaagtctataatttttttaaaaatttcacttgtatgtatttatattttaaaatcattttgtcgtgaaatgattctctgtactgtgaggtagtacacagaggaatctcaccccatgctccactacttagaattaaatacatattccgctgtaagaaagtaatctaattacgtaataattcctatccccttttcttccccgagtagtgatagcctgtaatttgcgtacttcctttctgtccccttctaaagcttttattacatcatacatgtatccataaactaagtatagaattgtttggggtg

SEQ ID NO: 24294 - DNA, 1025 bp, Homo sapiens
catactatccttttatagccatctctacctctgtcccccatttctaacccctggaaaccactaatctgttcttcataattttcttatttcaagaatcttacgtaaataggatcacgaagtataacctttgagaatggccttttcactccattcccttgagatacatccaggtagttgcatgtatcaatagttaattcctttttattgctacacagtactccatagtatgaatatactatgtacatagcatatatatttatagtttaaccattcaccttgaacattttggttgtttccagtttgggggcattaacaataaagctgatctgaacaatcaggtataatagtccccctttatctttgaagattatatcccaagactcccagtgagtgtctgaaaccatggatagtatatacactatccatatgtgctatatgtactatatgtcctctatatattttttctatacatacatacctttgatgtttaattaagcactgcaagaaactgacagcaataaatagaacaattatactgtaattaaatgaatgtggcctcaaaatgtactgttctcacatattttcagactgtgggtaactgaaactgcataaagcaaaactggctgggtgcggtggtgcacacctgtaatcccaggactttggcaggctgaggtgtgcagatcacttgaggtcaggagtttgagaccagcctggccatcatggggaaaccccgtctctattaaaaatacaaaaattagctgggtgtgatggcacacgcctgtaatcccagctactcaggaggctgagacaggagaatcacttgaacccaggaggcagaggttgcagtgagccaagatcacgccactgcacagcaacctgggcaacagagcaagactagagtctcaaaaaaaaaaaaaaaaaaaaaaaaaaaaaaaaggaaagcaaaattgtagataaggaggactactatacaggttattgtgtaaacataagtttcatttccctgggacaagtgttcaagactg

SEQ ID NO: 24295 - DNA, 1480 bp, Homo sapiens
gggaccccgggcgcgtgggtagagcggggtgccccactggccccccaggggcacgcagctattgttatttcccccctcccccgcaggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggtaagttctttttatgttttgtcctcttcgtggtgggtgagcaaatttgtatcatgggtggttccatttttgtgcataacctttccgattaacctttctgaatgtgccacttacataatggaattttgatatttacttaataaaactttactatgtttcaggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattggtatgtttaattccaaacggcttcttaattttcgttttcgtcatatgttaccatggcattaggtatgggaggatgtgttctaacgtcgagggacagacccaagaattttgaactcttaaacatttaaagtggtttttggtttctgattttcattatttgatattttttcttaatgtgttctattccagtgatgtcttggttcgtgtccccactgctttctggaattatgtctggaattttattcttcctggttcgtgcattcatcctccataaggtaacctttctcccccgtatgaagacctttcatggagcacacccaatcgatttcaaacccagtggtacttttgcagatgtgattggtgtataggtatgcggccttggaaaattttaaaaagctctttgttctgtgcatttcttgtatgttgtggagttctctgaaagcgagtttttaatactcaagagggcagtcaggaaggaaaaattgaatactat

SEQ ID NO: 24296 - DNA, 1198 bp, Homo sapiens
tccagagtagctgggactatgggtgtgtgccaccacatctggctaactttttatattttatagaggtggagtcttgctctgttgcttaagttggtcttgaacttctgggctcaagccatcccctgcctcatcctcccaaagtgctaggattacagacagacatgagccaccaccacacctgacctgcattttcttaagactagtctttagaataaaaatacacaccttagtttcctaatcttgttgactgccctcagagtttgaccaccgttgagttagttattcaaggatgcttaacagttcttgatttctgtatgctattgtttttgttttggctatttcactatctgttaacattctctattaaactatagataagagttaaattttagagtggttttcaatgagtgctcatctctgctaatttgaaatggtacctttactttacacatgggtctgagctttcccttgtttcactggtcttaagctactaactttccagtgtattgattattgttggaagctgtagggttttactttctgtttttcctccccaagattttccactggaattgtgatcaagataacattaaaccttttaggctaaggtctttataaagtttttagccttcccatatatgtattcagatctttgctcccaatttttttttttttctgagatggagtcttactctgttgcccaggctggagtgaggtggcccagtctccactgactgcaacctctgtctcccaggttcaagtgattctcctgagtcagcctccagagtagctgggactacagatgcttgccaccacatccgggctaatttttttggtatttttagtagagacagggtttcaccgtattacccaggatggtctcgatctcctgacctcatgattgtcctgcctcggcctcccaaagtgctgggattacaggtgtgagccaccgcgcccagcctcctcccattctttcggtgtttgacttgggtgttctcctatagaattaatacatactaggtatggtagaattcttatttttagtcactggccttactgttccttaaacatttcaagtttttgccttagggcctttgcatttgctgatatctctgtctggaacattcagcgcccaaataatcaggtggtttgccccttctgtacccatagttaatgtacacagcttgctagcttacta

SEQ ID NO: 24297 - DNA, 1885 bp, Homo sapiens
tttcagcttatcagccccatggttgagctactttcccctacagaatgagtcagcagggagctaagaagggttcttatatctgtaaagggttgtaaaaataaaaacaaaacaacaatgtgctacagaagcccgtaaaacctaaaatatttacagaaaaattttgggacccctgacatagggtgttctgcattgctggttgttcccaagtgagagttgctggcaaatgataaagcaggcaggaaaaatgttcctgaatgttaattgaagttcacatacattcttgttttgagatgagttttttgggggtggaggaaaggagacgtggaacaaagtagtatggccacaaccaaaccaaaaaagaccccccttttttttcctaggagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgagttggaattcctggtttcacttttgttacctgcagtggtgaggaggcttattgttttggatttgatgctttttgtattgaatgtcaccttggtgatcttgactaggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaaggtcagttgacattgatcttagtgttgctaaccctatttttaaaccatttatccttgtcacaggcctgtgcttgtggtagtggtactcctagcatttacaggaccccaaataatacaaataggatgaggtaatagcagttattgacataataagacagtacagttttattcttcagaggaattacaaagaatgtttatttttgtagatgataaatataaacagatactcttcacagagaaggcttttgtccatcaagatgagattcagttctttggtagtgaattgtgggatgtaagatgtaagatgaaaaacttaaaagtttttcatatagaatgattttgtagtttggtttgtaaactgtttattggaacctgagagttgctttaagctgcctataggaggaaagaggccaccatttgcctggcattccctccatcagagctgtgttcatttttctgttgtgtatgttggggttccatttatgtctttagaaagaaaggcccttttgccagatgagcttgaaagctgtactttagacaacctggtagatcattcagcagattgggt

SEQ ID NO: 24298 - DNA, 1028 bp, Homo sapiens
ccatggggaaggatctgacaccgatcacaccctctaggtaagtaggtggagcaggttctacaaatgtcagtactcatttttttcagagatataacactgtcgagtgctaacacaaatctctaaagtaaccaagtttgtataagttcatgatgttcttattgtcattgttctttttagattttacttgtctggcccttaaacattttggtcagacattttacccatttagctctggtggtctctgaagaaaatgacttttctgagaaagctgtgtatgctaagagcggatagttatgtatacttgccttttatttgtcttgggagctaagactcaatgtttaccaaactcttcaaaataaaagtgcaaattttatttaatagtgggattccagaaaaacgtaaaactggaagcctttgaataaggaaactgggcatctgtggcctgatttaaataaagtagatcttaggggttatagcaaataaagatgtcagtggaggttttgtgactgagtagaacaaagcaggactgtgttaacttgaggtgtagtgttagcttctcaaaaaagtcaaactcacttcctgacaagaatccttttgtgtctgtagtggcttcagtattgaactggcatctgccctcactgtggtgattgcatcaaatattggccttcccatcagtacaacacattgtaaagtaagtgtaatgccaatgtgtgtctttcaaatggttcttctaatatgtagggtttttagttttacttctctgatactttgatttagaaagttttgtgcagttggagtcttgaagagttcataagttatttcttgtgtttattcttatttaagcaattaaatagatattctccccaaataatagaaacattgttttatatacagcttactgtagtttctggctactaacctcttcctttgttactttatcctccctcattgtagtctctttataataattttttttttaatctcaagagtcatttctacttggcaccattatgttttatttatttatg

SEQ ID NO: 24299 - DNA, 1051 bp, Homo sapiens
caccaaattgttaaatgtggtttcacttgagggggtgggaggatgggccccagaggggtttttataggggcctttcacttggtatttttttcattttgttctgtttgaaattttgttttttctttttaaatggagtttcactcttgtcgcctaggctgcaatgtagtggcgtgaactcagctcactgcaacctccgcctcccaggttcaagtgattctcctgcctcagcctcccatgcctcctgtgtagctgggattacaggcacccatcaccatgcctggctaatttttgtattttcagtagagatggggtttcaccatgttggccaggctggtctgtaattcctgacctcaagtgatccacccaccttggcctcccaaagtgctgggatttcaggtgtgagccaccacgcccagccctgtttaaattttttataagtatgtactacttttgtaatcagaattattagaaagcattttactgatttaaaagcttagacatgttcaaatgcctgcaaaactacttaacactcagctttagtttttctaatccaaaaaggccgggcagttaatctttttggtgccaatgtgaaatttaaacggttttatgtttttcctgtgttgtgaatgaaaaatatttctgagtggtggttttttgacaggtagaccatgtcttgtcttgtttcaaaataagtatttctgattttgtaaaatgaaatatacaatatgtcacagatcttccaattaagtagtaagggtttatccttaatccttgctaatttaagcttgcataagtcactttactaaaagatctttgttaagctagtattttaaacatctgtcagcttatgtaggtaaaagtagaagcatgtttgtacactgttgtagttatagtgacagctttccatgttgaggttctcatatcaccttgtatcttgaagtttcatgtgagtttttaccattaggatgattaagatgtatataggacaaaatattaagtctttcctttacctaagtttgctttcttgactagtaatagtagtagatatttc

SEQ ID NO: 24300 - DNA, 1024 bp, Homo sapiens
aatgggacaggcagtccgggtgggagagtggacctgaggaagtagctgcaggcccagactacttcagccacaccctgatcccctgggaccctcagggcacaggaggcagtgctggctccaacctcagtccaaggagctgtggaagcctcagaggtccttggcagagatgagccctcaattctcacctcaaaggcagcgattgaagttttctcttgtttgggtggcagaactataagttgtcagagggcaggtagtgggtctttggtttttctgcagtgccacagggctagcttaccttagaggccataagtattatttgttgagatgcatgaatacaagaatgtcttataagctctaggctcaattttcaactcccacagatgtgcaatgaaaacaattttccagactactttttttccctcttattttgaaagcaatacacttattttttccatcaaacattaagacaacagagataagcaacatagaagaaaataataatcacctgttattctactacgaacaatttggaatttatcttaagtctcaaaatatatatgtattaaaacacaaggtcatattgtaaacattgttttgacctgctttatttcattcgatgttaaattgtaaatacctttttttttttttttttttttttttgagatggagtctcgctctgtcgcccaggctggagtgcagtggcgcgatctcggttcactgcaggctccgcctcccgggttcacgccattctactgcctcagcctcctgagtagctgggactacaggggcccgccatctcgcccggctaattttttgtatttttagtagagacggggtttcaccatgttagccaggatggtctcgatctcctgacctcgtgatccgcccgcctcggcctcccaaagtgctgggattacaggcgtgagccaccgcgcccggtccctttttatatcatgttaaatatttcttctaaaacaaaattttaagttgttacagtgattttttataggtttgtatgctctat

SEQ ID NO: 24301 - DNA, 1030 bp, Homo sapiens
ctaatcaacatactttcttatatttcttgataatatgttgaatttacttttgagcatgttttgaagaggtagttagtcaatctttatgtcccttttgaagatatgatgaaatagttacatctctattatggaataacatgaagtggtttaaaaaatgaatgatgtatggtctggcacggtggctcacacctgtaatcccagcactttgggaggccgaggcaggtggattatctgatgtcaggagttcaagaccagcctggccaatgtggtgaaaccccatctgtactaaaaatacgaaaattagccaggcgttgtggcgggtgcctgtaatcccagctacttgggaggctgaggcaagagaattgcctgaaccttggaggcagaggttgcagtgagccaagactgcaccattgtactccagcctggacaccatgagcaaaacttcgtctcaaaaaaaaaaatgatgaatgatgtatttctaattctagtgagaaggaaagagtatcagtgcatattgtcaagtgaagaaagcaaactccagaacaaagcctatgtatgttcctatttattaaaaacaaaagccgcatatgtatacaaatgtactctatctttctgttataattttatgaatgcagatgtatgcaaatacatatattcatatacataagacttagtctaaacaggaatattctttcaggagggaatcttgcttctcctacagaaaaatacctaacatggcaggggcaaagataatattggaccaaaaaaatctggacctatgtctattaaattgctcacagtgtttatataatatcggtgaagggaagtaaaattgaggttagtgaaagagactccacgttttaccctaatacttttctactgtttgaattttttatagttataatacattcaggtataatacataatttatatataaatactatatatacatccatacacacacatatatatatgtgtgtatatatatattttaataagaaacaaggtctttctctctcacccaggctgg

SEQ ID NO: 24302 - DNA, 1061 bp, Homo sapiens
aataagctgcttggaaaagtttctgttctttagctgattttttagctataaaaatgtatttgaaaagctcataaatttcaggattgaaaagataattgaaagttttaaaaaaacctaattcattgaagtaataaccaaataattttcaatcttgattcaactgtgattcaaatcttacaccatttgcccacttctatgaattttatgtataaaattttttaagagtcagagttttttttcttgattaattggatgtatttcacagaatttccaactgctcacgttagttttcttccttttagagttgatctctctaatgtattagatcttcatgcctttgatagtctctctggaataaggtatgttttgtataatttggttacttttattgttatgtaccttttttccccatagttaacaggaatgatttgcacaattgcatccatgatttaagcttcctgccattcctttggcatacaagaccatacttaatgaggtatattcttggaagttttactaactggttgtttggaaatcatattgcattttcctgtagaaattatagtgtaaatgatagttaactttagaggctaatcgttaacacttctacaccaaacactatatctagtactctttctatgagaaaatgcatgaaatacatagaaaattttagcttagcgttttcacacaaataactctcttcactttatttttttattttttattttttcttgagtttttttttaatttatttatttattattattataccttaagttttagggtacatgtgcacaatgtgcaggttagttacatatgtatacatgtgccatgctggtgcgctgcacccactgactcgtcatctagcattagttatatctcccaatgctatccctcccccctccccccaacccacaacagtccccagaatgtgatgttccccttcctgtgtccatgtgttctcattgttcaattcccacctatgagtgagaatatgcggtgtttggttttttgttcttgcgatagtttatggagaatgatgatttccaatttcatccatg

SEQ ID NO: 24303 - DNA, 1032 bp, Homo sapiens
ttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaaggacagttgtccctttcgctttattagttcgatcatttatgtttatcagtgtggacacatgaatattttatactttgggttacaatttaatactgctttattttgttgctcaaattagcccagctttgaccattgggaactctttccgttatctcctgttcccgcctttgacatgcccccatcaatgtgggtttccgttatctcctgttcccgcctttgacatgcccccatcaatgtgggtttccgttatctcctgttcccgcctttgacatgcccccatcaatgtgggtttccgttatctcctgttcccgcctttgacatgccccctcaatgtgggttttgtgttttgtttttgagtgcctccttatttttctcctgcatttttaaataaccccgatccctattgaagctggcgctgggaaaactaacaatactccctttcccaggtcatccgattcctatgctgatggaggaaatgtgcctcacatgccgggggcgctggggaggaggcgtctgggattttgtggttgaataagacacctggcctggccctcctggagcttagtttagtaggtcacacaagcagtcattggtaaatttgggattcaaacaaatctgttaggctcaaacctgtct

SEQ ID NO: 24304 - DNA, 1050 bp, Homo sapiens
aatctagcaaggcaggccaacattcagattcaggaaatacagagaatgccacaaagatactcctggagaagagcaactccaagacacataattgtcagaatcaccaaagttgaaatgaaggaaaaaatgttaagggcagccagagggaaaggttgggttccccacaaagggaagcccatcagactaacagcggatctctcgtcagaaactctacaagccagaagagagtgggggccaatattcaacattcttaaaagaattttcagctttccacagcgcgggggaaccggaggctgcaggatggtcaagctgacggcggagctgatcgagcaggcggcgcagtacaccaacgcagtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagggaacaacaacagaatatgccgtataggtgagggacttgatcaggctctgccctgtctgacagaactcattctcaccaataataggctcgtggaactgggtgatctggaccctctggcatctctcaaatcgctgacttacctaagtatcctaagaaatctggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatcgccaggggatgtagaaacaatcaagaatgctatagcaaatgcttcaactctggctgaagtggagcggctgaaggggttgctgcagtctggtcagatccctggcagagaacgcaaatcggggcccactggtgatggtgaagaagagatggaagaagacaca

SEQ ID NO: 24305 - DNA, 2044 bp, Homo sapiens
tttagaattttagtcctggggtagtctcattccagagctcactgctctactgttccctaattgagatacatccaaggagagtggtcaaattattagtccagtttttaagagtgtccattttatacatacttaaacccaaagctactaatttttagtacaaatatgaaacatatagggaggtcttagtgaccagttcactgatttgattaacctataacacattaaagtgaaatatggatttgcttactgcttatttgagtattgcaaggactgataattgctgataaattcagggcagctcaaggaaatgatgctaattacatatatcttcaaaaggaaggcatacatatttctgaagctgcaatttgaaaatgaataatctccactgatgcattacttactgtaattattttactcactatgtattatgtgctcattaatgactgcacaaaacacatatgaaagtaaaaaaatagaagaacttaaagtaatcaagtatttatttcagtctcagttctgtgctgaacactatggtatatacaagaaaactaaggcatgattttatacttgaggtttacagtttagtttcaaagatgaaactaatatgtgtgaaataattatggatggcttactagcatttaattgtttgggcagattaataagggctgtagtatttggaggatgatttatgaagaagctgaacttgatcagatccttggaaaagcataaataggatgtgatagatatatgggaagaaggacttcaaatctaggatgtgagctaaattgaaagctccatagtggcagggattatttcttttttgtgcattctctattcaagtgatagcgtcctgcatgatatttaataatgcccagcaaatattttactgataaagggaagtcatgaaggagtttcaaagtatttgggggatgggtcagttaggaaattgccctgcctggaattcagatatttctgttgggagctgtgggacagcaagtagtttatttactcatcttgccttatttcagaaggattttaaatggggcagaatggtttgcgatttatttgatagacagtagtggattgtgtagatcattaagcaaaagagtgataaaaggtaaatttatgcactattagtctgggtctagtattttactttatacagctttattgagttataattcacatactgtaaagtttactcttttaaagtgtgtaattgagtagtttttagtatagtcacaaggttgtgcaactatttccagtcaatttcatttttttttaatgcctggatgccacttattggaatccaatcaattttagaacattttcatgaccccaaaaaaccctacacccagtagcagtcactctccgttacctctaccctcaacccttagcaaacactaatttactttctgtctttatggatttgcctattttggccatttcatgtaaatggaatcatacaatttgtggctttttgtgactgatttctttcatggggcaagtgctgactgctgtagtcgttgtcttcagtggtgatggacgtatagcaaagggactgggaaaacgttgagaatctttgaaagcaaaattaaaggaatgggtagagggataaaggaaggcctatggataaaggaaaatcatcttgggaaggaaatgtttaccaaatacttagtgagttttattcactgttaggtcctttaatccttatgacaacctcatgaatttagttttattcccgatgcattagggatagtctatgatcacaggatcacaggctagtaaatggtggaacaagcattcagtcatgtcttctttatttcaaggttcatgttctccccactagtgaaaaggagttaagattttaaggtttaggcttgaagggaccaggagaatgtttctgttgacacacagagtaggcgtccaggttcttcactcaacagtccatcagtatttttgtgtcaggttaaacattgacttgcatgtcatgagaaaaatgttggagggaattggaaaagttttttaaaccattgctgtttat

SEQ ID NO: 24306 - DNA, 1027 bp, Homo sapiens
cgcccgccaccgcacctggctaagtttttgtattttttagtagagacggggtttccccgtgttagccaggaaggtctcgatctcctgacctcgtgatctgcccgcctcggcctcccaaagtgctgggattacagacagttagttctgtactgtttaatgcaatcttccacatttttagctttaggacagaaatagcctttataaaatatgtaaatcttacaaatcatgctcctaaaagcaaatgtaaacctctaagtttgtcttaataaaatgtagggagtgagctattttattgcataatacaaaattaattttatgtattttctttccacagatactacatttaaaattgaataaagtactccagggaactagttttttttttttcgattaactctttgtttttttgttttttttttttgtttttttgcctttcttctttctttgtgctcaaggctgttcttgccttagctgcatcttggacctcaagacaagtaggagaacggacgttgaccggtacggtaatagacagtggagatggtgtcactcatgtcattcctgtggtaaggctattttacagttactgaacagaacatgaaataacacatctggcaaagttaaattatacgaattaatgttacttttaaaaaactttaaatgctgcactataatttggccatttgtccagttatagctatgttttgctcaccgtttaaaacttttataaacaattcaaaatgtttcttttactgtaggtttgtactgcaattaagaaaattacaaattgcaatatctggaatggaagtatattaatggctttcattctgttttccagttggatgtgtgttagccatttgatgacctcttttattcataattaacagatttcagactggtgtacagggtaactgtataacagttagttttaagtacctgaactttagtagatgctttatggtttgtacttaataaagcatattaagaaaaatgcatcaaattagattgtcagaaataacatttttcttcc

SEQ ID NO: 24307 - DNA, 1054 bp, Homo sapiens
gttcatgactgtagtcccagctactccagaggctgaggagggaagataacctgaccctggagaggttgaggctgcagtgagccatgatctcaccactgcactctagcttctctagcttgagcaacagagtgagaccctgtctccaaaaaaaaaaaaaaaaaaaaaaggttggtgggggggtgctattcctttttattgtttacttttcccgccttctttagaattagtagagtattttttattattctgttttctctttattgacttattagctatgctatatctgttgtcatttgtttgtttttggtggtggttgttgtatgggttgtagtaaacatctttaacttaccactgtctaattacaaataacattctactacttcataaataataattatacaacagctttgaccttctagtctttgttcttatattgtcattcattttacttttatatgttgtgaactcaataatacattgttaacttgtttcattttgagtggtgtattagtttgctagaactaccgtaataaagtactacagactgggtacctaaagaataatgtatttcctcacaggtctggaggttagaaccaaaaattgtgatataactacaatgtgaggagtgggaaaggataggtatcaggattttggcagggttggtttcttctgaagactttcttcttggcttctagatgtccatcttctttatatgtcttcacatagtcctccccatacatgtctgtgtcttaatctcctcttcttaaggacaccacttatattggattagagaaagcaaccctaatgaattcattttaactagataccactttgaataccctatctccaaaaaacagtcacgttctgagatagagcttaggacttcagcatgggaatttggtggggaggaaaaacacaatttacccagtagcaaaaagttatctttaaaagataacttttttggagacagagtcttgctctgtcgccgaggctggagtgcagtggtgcgatctcagctcgcttcaacctctgcctcctgggtttaagcgattct

SEQ ID NO: 24308 - DNA, 1083 bp, Homo sapiens
ttttattgctctgtcttcaaattcactattttttcttcactgtgtagtccactgtaatctcatctagtgtttttcttttcatctggtagatttttaaattttagatactgtatttttttcttcagaagttccatttgggtctttttatatcttccatttctctcttcctcatcctcattgttgaccttcttcattatatggagtatatagttgctgttttattgtccttgtcattcctctgtattgtttggtttttctcctcgttaagtgttgtgtttttccgcttccttgcatgcttataatttttgatttggcactctatacattgttgtgtattgtatttttggagttctttataagtatttaggattttttcctgggacatagttaagataccaggaactagtttgatcctctcaggggctccttttaaatgttattaagcaggtccgtaacaggtttttgtccagggctggtttgtccccattcttgaggcaatattcttctgaggactctacttcatgtcttgtgtttgaaaacatctttcaactttggctagtgggatcaggaactatttctggctatgtgtgagctctggtggtggttctgtctacttttttctagaggtcctttctctcaccttgatggtttcctcacaggagtgtgctgatcagtattcagttaaggaggtactctcttcacatcttcccagctccctgttggttcaactcctccccctccaataatttggcctacaaacttcagccactttggcctttctgacctttaaattctatatccctaacttaatgagaccagtttgagttctctttcctattgttgtggcctagtaactctccctaggcagtaggatagagtgtaacattcacgttatttgtttcccttttcttagaaagtatctctgccctactctgccgattgtcaaatgtctgaaaacctttctttctttcttttttttttttgagacggagtttcgctctgtcgcccaggctggagtgcagtggtgcgatctcgactcactgcaagctccgcctcccgggttcacgccattctcctgcctca

SEQ ID NO: 24309 - DNA, 1059 bp, Homo sapiens
gcctgcaaagaatactgaagatgacagagaggtagaagccaagctaaaggattatggtcataaaattgagagaagtgaatgtttcaagaagggagggtaaatagtgccagttgctgcagtgaagtaacattagaggaaaccttagaagtacttggagtttttcagcatctaggttattgatgatcataggggaggcgtttcaatggagtgatacgttagagcagcttgttacttatctcagtgagaggtgaaggtttggaaatcagcagtctggacattctgagagatggctatgaaagaaaaagacagtggacgagtaagaattcagttgcaagaataaggctcaagatagttttaaatttttaagagggcttactccagttacaggagggaaggaattaagtataggtacaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctactaaaaaaaaaaaaaaaaaaaaaaaaaaaattagctgggcgtggtggtgggcgcctgtagtcccagctactcgcgaggctgaggcaggagaatggcgtgaacccaggaggtggagcttgcagtgagccgagatcacgccactgcactccagcctgggcgacagagcgagacttcatttcaaaaaaaattgagggcttgtgaagaataatgactttcatatttactgttgaggggaattgagagggtgactagtgagtacatattaatagtatggggcatccattctttactcaaggtagcaggttagatacccaaaacttttagttgtgcaatagtgtcctctcgcctcccccagacagttgtgggaaaggaggaaaaggttttgataaagcagagattaaagtattacagcatagaggagagagcaagtcctgaaagctg

SEQ ID NO: 24310 - DNA, 1025 bp, Homo sapiens
gtttggggagtttcttcagagtttgttgtaagaagtggagttactggtatgtgcatttaaaattttattagctatttgtattagtccgttttcatactgctaataaagacatacctgagactgggcaatttataaaagaaagaggtttaattggacttatggttccacgtggctggggaagcctcacaatcatggcagaaggcaaggaggagcaagtcctgtcttacatgatggcagcaggcaaagagagaatgaggaagacgcaaaagcagaaatccctgataaaaccatcagaccttgtgcaacttattcactccatgagaacagtatgggggaaaccaccctcatgattcaattctctctcaccaggtccctcccacaacacgtggaaattatgggagtacaattcaagatgagatttgggtggggacacagagccagaccatgtcactatgttactattgccaaattattctccatagtggttacatcagtgtatactctcacagcgttatatgaaagtttccatttacccagatttttgccagctcatagtatatgtatgactttacatgtttgctattctgatagttataaaatggtatatatcatcataattttgagttttctctgatttcagtgtcttcaatctgaatctgttagagaccagtattagtggtttctaaaaggccttttgtttttgaactgaaaactttgtttaaccttttattgtgatatttgtcagtagtgatatgatctctattatatatccaacttatttttcagtttgctaatccagactttacacaacctatctcagaagttgtagatgaagtaattcagaattgtcctattgatgtcagacgtcctctctacaaggtatttatagcaaaattgttattcaaggtcttactttaaaaaaacttaaacacctctcataaaaaggatataatagcatttcagtactatatattatatctttaaacttttctctttttaaatattatatttattttctctccact

SEQ ID NO: 24311 - DNA, 1023 bp, Homo sapiens
gaagagtacagccatttattttgtagcatatccttcagcttgggtttgtttaatatttctgcttgagtaggttcagattatgtacttttggcagtgatgccacagaattgatattgtatcatttttagtgcattgtatcagtagacacatgatagaatttgtcctgtgtgtgaattttgagcttttggttgaagttgtgtctgccaggttttttcactataaagttattatgttttcctttatatttaataagaatctaatgaggagacactttcagactatcctgtttctcttttaagtttcagtcactagtttttagcatccattgtgattcttccctaaaacagttattactgtggtagttgctaaatggagttttgcaatttctgtcattccttctatgtttttaagacttgttttactataagcaagagttttcccttctcccacattcatttattcttttagtaatatctatatgaactcctgatttctcattttgtggtctatatctttaatatcactgtaatatcataatatcagtaataccactcatcattaattttaatcccacatttttttttttttcagatttgaccagtgggagttattcaaatggctcttaggtttttttttttgatgcagccacatctttttttttgcctacttctgtacttcccggcacagcaaggtgtttcaggctgatcttgtactttctcttttctggccctggaatcagccctttttttctccttttctttcttcaagacacccttgtcttattcctgttagtggagaacgttactaagaaaccaagctttgtgctcattgctgttggggtatcactgagtctaggccttctcagtgattagagctaggggtgtgtgtgtgtttatacatctatatctaattctctacataaattaaaaccatgaatttttacagacgtctccagttatagaaggttcactctagttttctgcccttccatattgtaatgcccttctctgacagtgagaaacc

SEQ ID NO: 24312 - DNA, 1022 bp, Homo sapiens
aggcggtttcaaccaggactcaggaataagtacaaagtgaaatactaatattgaaaaaccaggctaagccaaaggaatggacaaaaataatagtgtcccattaccagaattaaaatttgttcagaaagatgttgagttaaaatttgttttccttccaaagaatgttatataattagaatgagggtatgtttgccatatctgtacccatgattgttctctggtgatcccatcaaggaagaaagatgctgggtagaactgcaatattgtgcattagggaagtgacattcatactgctgtcttcatttcaattctttctgtgacacttaccgttctgggaatctgattttcacatcataatatgaatattcaaaatactactttacatatcacatatggtttggatttgagtgatttcttcccaagctggagggatttctctcaagcaaatctatgtattttcttttaaacatttttactgtttagaaatgtttagaaagaaattctaagtatcctgaggaaaagtctcaaatagatatgaacatttttttcccctctcagatttttgaaatagccaatctaattttttccaaactttgaaaattaattcacttaagcctatgggtactatataatgtgttattaaaataatgctataattcagttaattaactcaaatgctcagagcatgagagattctagttaacttgaattttctagataattgaagcttttccttaaaatctctgcttttgcccatctcttaaagtactttgaaatcataattgaaaaaaaatcataattgaatatcaactcaaattgtacagaaatatagatttataaaaagatttgaatttaccatgagaaatagtccaggtatttttccatagtccctatgtatgtttaaatatatctacattatatcctatagaattgtaactggaagcttgaagttgggggtaacctgcaacttagtccttgtaaactgctggatattctgaaaggtgctttcatacatcaactca

SEQ ID NO: 24313 - DNA, 1046 bp, Homo sapiens
cgactcatttttttttaataagtaaaaggagtaaactctaaaatgatgatcaaaagtatagtaaacacataaacaagtaacatagtttattatcacgtattatgtattgtacataattatgtgtgctgtactttatacgactggcattacagtagatttgtttatactagcatcactacaaacatgagtaatatgttgcactacgacattgcagttactgatggcactaggtgataggaattttttagctccgttataatcttatggagccactgtatatgttgtccttaattcacagaaatgtcattgtgcacgcattactgtatttgcatatgataaatattggagcaaataagtggtcttatcaactgaattttcaactcactgcagtctagaagagttggggttgaatgttttgaagtggtatgaaaaatagtacttgtgtgaatgagttgtaaatgtctttttcaatatatcagttaatcatatgtttatcaaatacttatgtttattctgtaactgccattatctgacctcatctgtttaaatatttgacctcattgaagttttcctgtcctagactccttaaagtcagatgtacggtcttttgcagttaagaaatcaatatagctttcccttttccagtattttttctttaagataacttactttccctataagggaacaccataaaactataagttgttttaattacatgaaagagaagaaaatctaaataatttgtgtcaggaagccatggaagttctcatttgggatttcagtgtttctaagtaaacttctccttctttgtcacagtatatgttctgtttatttaaacaggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaa

SEQ ID NO: 24314 - DNA, 1821 bp, Homo sapiens
tgtatgtctgtgaaataccactatgagttgctgaactacattgatttgcccgtcttggccattcatgtaagtgatgatgatgagctcattgaaaacagggtatgcttattaaatcctatagattgtaggattggaggtattgccctctcctggaaacattgttctgagtagtttgatcaccactagatgatggatcctgtgtgggggagcgctgctgggtgtggaggggtatgaggactttcgaagagtgcaagacaccatcctccttgaggggcttgcggaacagttggggaaataggacataggccaagggatgagctcgaaatagggtaacagttccacaatttgggggttctactgctagtcttcctcaagattccagctctaatggatgtttttatttaattctagggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggtaactggcatctttggaatatcttcagaatgactctgcattaaaagttcacttattctcccagttccctgacggaaactgcattccacattcaaggtaaagatccctactatacagtgactgcagtatttctctggtattgaaaagtacttaaggcttttcagggctcaaacgggctgtgccagaggattgaaaaggatcagtgggacttaagttatgaaaatgagatccttggaatgatctcttaagaacagcagatgcctgaaggaaataaaattgcttaaggaagtagataaacttctgtagtatatgtggtagaataagcttcattgagaagtattttcaacaaacactggattaaagccgttttgatgatgaagcacacataatactcattttattagatcgctgttaatgcaaacatcatgtccagccttttttttttttttttttttttttttttgggcctcaatcattggcctattgggggtgatgtgcacagagcgattgctggcccagctttgtgggggtgtggtgaaggtgtgtgtggcccagcaccgtgggactacaccatctcagtacagacatgcacatactcaggatgcagatacgcaaatgggctcatgtggaagtcactgcgttaactcagattttctttctccaccaaaggaatatattcatcgtgtgggtagaacagccagaggcctaaatgggagagggcatgccttgctcattttgcgcccagaagaattgggttttcttcgctacttgaaacaatccaaggtaaagatctgtacttggagaaagatttctcttggtgtagggattgttagcaagcaacatttctacatgtgtcagaggagtctcgagtctggccagtgctgttacaaccattcttatggcaattaagcaagtaaggttttatgtacttctagcccaagaagtgagcacagaaggaactgcccacatggctcggctttctagctctgttacccagcaacacctctgtgtcccagcctctcctttcctgttccctccagccctctttgaaaccttctccactcctttgaagctccctcacacctagtcatctctgcttctgctccccttctttcctcttacctcatgtgaagcagtggggaatccttgttcgctctagcctctgcctcctcccctgccctctgtctcctattcatcaactcttggcctacagtctcttccttgcggttggcgctttaccatctcaaatttctcact

SEQ ID NO: 24315 - DNA, 1031 bp, Homo sapiens
gtgattcactgggcaatcactgtcctttgaagtctaccctgtcctaaagtgaggatcaggctgtgtagtgtataaggtttcttgctattctagttatcaccactctgtgccctctttaaatgttttccatggagtggctttgctctaggatatttaaaatctggtgttttggaggtttttgtttgtttttgtttattaaaaccagtgtttctttctatttcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgagtatccttttctttaatgaagttatcctgtgactaaggaacaaaagcttgacagaggggcatttggggctttgcagtggattggtatgtgttctggctcagactggaggctccagtgttcaccctggtcgatgtctgcttttctgtgctagcacaggacatagaggttggatggggtaagcagggcttaatcattaggatggggttacagggacaaggcagcttatgccttgagccttcaaaagacaaagaaatttgactgtcaaggagagacagagacagttgtgtgttccaggcagaaacacaggttaaaaaaatcaaaacttcagtgtttgctgaggctgcactgtgcagggtacttaggtgaatggggtgttttgaagctaaagagaggatgggacctttcaaggagttttaatcatcttagaacccctgaaggattttatgcaagaaagtggcaagttcagcaaaagaaaataaaacttaggtgttgcttaagataaaaggcaggagtacttccagttgcttcagttgtgatttataatttgtgcctttcagaagaagaaactgagcagctgaaatgaggcctgtgcttcagtgccataggggtaacttctgagggaactagagg

SEQ ID NO: 24316 - DNA, 1128 bp, Homo sapiens
taaagaaaatttcaaggtgattttacatttattctcatcatctttgtgcaattgtatagtcacctgcttgttttggcttactatctgagagtgtattatagttgagatggtatttcaacatctaaccatcttttcagtaaccaaacacttttatatagaaccatctgccgaaaaagaagtctgagcagttgagatggaatggaattcaaggtatagaggcaagaggatgggttttggaatcagacctgaagtggaatttcagttttgatactgcatgtcatgtgaccataagcaaattgctgaatctctttgacttggtagcctcatctgtaaaatgaggatgataatgtctacctttatgtttgttttgaagagtagagttactatatgtctggcagggagtaggccttccataaatgggtgccctataaagaataatgatgatgatgatgaggaggagagttctgtagctactgaaccttgctaaaagcaaccagatgatgatgatgatgatgatgatgaggacgaggagagttctgtagctactgaaccttgctaaaagcaaccagattatgatgatgatgaggaggaggaggaggaggagagttctgtagctactgaaccttgctaaaagcaaccagatgatgatgatgaggaggaggaggaggaggaggaggagagttctgtagctactgaaccttgccaaaagcaaccagatgatgatgatgatgatgatgatgaaggagagttctgtagctactgaaccttgccaaaagcaaccagatgatgatgatgatgatgatgaaggagagttctgtagctactgaaccttgccaaaagcaaccagatgatgatgatgatgatgatgatgatgatgatgatgatggagagttctgtagctactgaaccttgctgaaagcaaccagatgatgatgatgaggaggaggaggaggaggaggaggagagttctgtagctactgaaccttgccaaaagcaaccagatgatgatgatgatgatgatgatgatgaaggagagttctgtagctactgaaccttgccaaaagcaaccagatgatgatgatgatgatgatgaaggagagttctgtagctactgaaccttgccaaaag

SEQ ID NO: 24317 - DNA, 1022 bp, Homo sapiens
gtttctgtggtcactttgcaattggaatcgtatcttactcttttgcctttttttttttttttttttttttgagacggagtctcactccgtcacctgggctggagtgcagtggcgccatctcggcttactgcaacctccacctcccagcttcaagcgattctcctgcctcagccttccgagtagctgggattacaggcgcccaccactacgtccagctatttttttgtatttttagtggagacaggttttcaccatgttggccgggctggtctcaaactcctgacctcgcgattcgcctgcctcggcctctcaaagtgctgggattacaggtgtgagccaccacgcctggccttacctttttaaatctccagcaaataccaagaaccagacatattgtcagggcttaagtatttgttgaaggaaaatattatcttatagttttgcgtcgaagtatacctcatggagtgttttcgtttattcagttcctgttttcttacaaaatgtctgactttaactgtgttccttttagtgcctccctgcatttaagcacattcccataaaaaagtgatgacttactactgatattttacaaacttctttagtgtttagctttggtagactgtaactagtcactgggaaataacttaaaggtatcacaagaaatgtgatttttgcatcagagaaccatttgatttataagcaggattgtgtttgcatatgattttacacaggcatgattttaacagtctttcttgttttttttaaaaaaaagtacaagaagaggaaaagaggcccagacatactctgttgagctctcaaacagtggaacctcacagtgttgtatatattgctatcagactctgccatgcctttatttaaaggaaagaaagaagacatttaatgggaagtgacaagcttcttcgaattctccctctcagtgagcaactgagaaccatgcatactcaatggatttgatttttattggcaaatcccagggttggcagtgtggcagtttaaatttc

SEQ ID NO: 24318 - DNA, 1028 bp, Homo sapiens
tggttattttaaacatgcttttcaactgatgtgacagtagtgtctttattgccagaatggcacaacataatcatcctgtttttaggaagattagaatattttcattaaatagtctttttaataactaatttagcacttaaaattccttcccactaaatgaataaaatgttgaggtttgagaaataagaaagggatgagaatattttgggactcaatcattgacattttatatacagttatgtataattaatgacacaacattcaaagtgttctttccaaaactaagagaagtactaagatgatttcttcttctaacagtgcacttaaaatttaactgaaaattttaaatacctctacaccttgtttcctccattgtttctatgtgcagaatgagtcttacctgtagatttctgttgtgagttttcctgctttgacaatatgacctacagcctcattaaagggctagagtggaaaggagtgtcagtaaaaggtgctacatgctgaagactaaaacgggaagctggtaggggcgagactgatctacgtaagaggccagccagaaccttcagaacattgtgtgtatgatgagcttgttgtatacttttatacttctagattctcttagatttgtggcatataataaatattttatggtttggagtttagagagaacattacttaactgctaactggtttgatacttttttcaggtctcgtaggtatcagtagtagaaaagtagcatgaatcatttagtagcacgaatcatttagtccagtctgctaaattgtgaatcatacatttgaagagtattttgttgattataatttagaatgttgttgtaatcatttgcaatactttcttcattggtgttatcctcatttcatttcctttggaaggtaagttaaaaaatatcggtgattgatgtgaaataacttttttttttgtttttttttttttaagaatctttaaaatgcttgtggtggttgtagtgattcttttagcttaagtgttgccagtacaacattgg

SEQ ID NO: 24319 - DNA, 1043 bp, Homo sapiens
tttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatcatctgggttaagagtctgtttttcttctttgtggtaagtcttagaatatggtactgtggattaatctaatgaaattaacatatgtggttgaagttaccaagaaacgatgaaaagaaactaaatatagttgacccttgaacaacaggagttaggggcaccactccccaacatagttgaaaatccatgtataacttttgactcctccaaaacttaactactaatagcctactcttgatgggaagccttaccaataagaaacagttgatgaacacatattgtgtatggtatatgtattatatactgttttcttacaatagtgtaagctaaggaaaagaaaatgtgtttactcttcattcagtggaagtggaccatcctaaaagtcttcactcatgctatcttcatgctgagtagtaggctgaggaggaggaggaggaggggttggtcttgctgttgcgggggtggaagaagatgtgcattattagtgggcccacacagctgaaaaccatgctgttcaagggtcaactgtgtgtggtatcggtgagact

SEQ ID NO: 24320 - DNA, 1034 bp, Homo sapiens
acttgtttctcttgtcccaaggatgggtttgccctaagcccattggtaccatgaagcccgctgtaacccttggtaggaaaagacaggcaggctttagggcagcccattggaagagcacagtgaatcggttttggggacattatgcagcttggtgtcaggtgcaggttgcatctgcaatccccagattggctaaatacttttgaacttcctacttgcctcaaagttaatacctccatttatgtttaattatttgagttcactgagattaaattcacctggggaatagggaattgggagttttgcttctagctgatgccccaatttatggggaatatatgtggagttaatttgctcctgcagaaaaagagaaaaggaagaaaagcttaaggatgatgttttttttcatttgatactgagccaaatatatttatttgggttaaaatatgtaattcccagaactgatcgaaaattcacaaggctgagcacgcctcatgcgtggcctgctgtggaaacgctattgctgaaggaaaactgttatcttgactaattctctttcgaaaagcatttactgtaatatgaggcaaatggctggtgagaaaagcagcaggcttatttttgttccttacaagctaagtggtacccctagagtaaaaatgtatgtctcacatttagagaaggagatagtagaattcaaccagtgaagggatggagtgaaagagaaaggccaggaaaggtctccaaacaggttttggaataaaacttagggttttcaaaagccccgctgatctgaatcttgggatgttaccaaaaaccagttgcatggccagaagcttacagcagtcagcatcatggtcggaagttacaggtccaggattattatagtgttagagtcctgagctcctggggctgcagccagtgattttagggccattataagcacattcagtgtctgactcctaggggacagttggtgggtggggtggcagggtgatgtccccatgaggtggctgcttgctggggatgtcactgcagct

SEQ ID NO: 24321 - DNA, 1039 bp, Homo sapiens
gtgacattgttgatgagaaactaataattttcataagttaaaggacatagcattcccttattataaaaatatgacctctaaattttgtttccataatgtttttacagaaagtttcaaattttaattttcttattaaaacatatagttacacacacaaaaacaataaaatggggataacaatagtgcccaccacgtagggttgctgtgagccctgaatgagatgacatgtataaaagtgctgggtagagtgtctggaacagagtgggcaattaatcaataccagataaaagttaaacaagcaaagaaacaaaatcctcatccctcttaaagtgcctgaaactcctaacactttgtgactgttggctctcagccctggctgcataattaatcacagtagagtgaactctccattatccgcactagtgaagggcagaggcatggataaaacaaggggtaatctaaaaatcatttatatatttggctttggaatgaagtcggagaaagacacacacaaacacacacacctgtcatttctgtcctggcaaaggcttcccaactgggatctctattgaagcctctggagactttctaggggcaggaggtgggggaaggtagcacttggcacttaacaaaggagatacagaatatacaaagcacttaagatttttttaaatatacgacatataaaaattgtcattactgttattaataatagtttactttcagattcttgacaggtgacaggctgttttcatccacacctcccctgtaacaaataacgtacttttctgctgctccacactgcccacccaaagagaattttgagcagatggaagatgaaatatgattcatttttatattcctctgaagtctttaaaagtgcttggcatatagtgggaggtcataaagcgttgaaattgtgaattaatgtcttttagggatatttctgtttgaagtgagtgttgcattttgacttgggatagaggtctccaccaggtctgagagctcccaaaagtcactgagcagctccatttcatct

SEQ ID NO: 24322 - DNA, 1038 bp, Homo sapiens
catattggaaaccattgttccaaaaaggtttggacgactaggtcaaatttctgtgctaatgaggatgttcagaccttgttgctttagaatcctcaggccgcgtttactcgatgccatatatttgcttatcacagccagcactggccatcagttcctaacacagctttcatctgcacccaccaatagccttgttacttgatgaactttatcctacacagaaaataaaaagagtccacagtccattatattgacattgtaattgataaatacctattgggaaagctgtccatctggcctccctttctgttatcacaagggagaccagagaaagaatagaacatgtgtagggaagatggctggacctttttattcacactggaggatgccaagaaaattatttggaacactggggctctgttccccatgatcagtttggtattgccaaatgcccttctacattttaatggagaacccatttacagtcactcaagcatcaggcatcttcaaattgcttctgtaaactttatttacacttagaacactggactatctatgcctatgcaagagtgtcccccttcgtatagtagaaaacccacaggttttagagtttgacagaactttaacaaatttcactctaccacttattggctaggcactcttaatgccctgtttctccttatatttctgggaaaacagaaccctcccccatctttttccatcaaatgcacctcatgattgagagccaacttatatagtacagatattttgggccaatctgaaatgcattggattgtctgataagaaagagcatttctaagcagatttcagttcaatccagcgcaattccatattcagctattaagcacacatcttatgtcaagcactgcccaaggtacagtgagggacacacacaaaggtgagtcaaatatacatcttaagtcagagagatgcagaccccactgggccaagctgaggtaagggctatagttggaattgcagctctggcatcataaatgattctacaggccttcactagga

SEQ ID NO: 24323 - DNA, 1037 bp, Homo sapiens
acatgagaaaaagaccacaggggaagaactcccagaaacatcccagccacagcgcaatgccccaggtgtatatggcccttggctacttcatgcccttgagggaaaatcggtattttcattttacacttgatgaaacaggttagagaaaggactggcgtgtccagtacctcccagtgagaagatactcagagtagaccccagatccaggtccttcctctttccctctctacacgttttcagtctagaaaagagttctgtgcgagaatttttttgtttttgtttgtttgtttgagacggagtctcactctgtcgcccaggctggagtgcagtggcgcgatctcggctcactgcaacctccgcctcccaggttcaagcgattctcctgcttcagcctccggagtagctgggattacaggcacgtgccaacacacccaggtaatttttgtatttttagtagagatggggtatcaccatgttggccaggctgtgtgcaagaatttatgttttcacttgtggcttgctgagccctggtgctggctgtgggcacatactcgttcacccagggacatgcactgttgatgggtccttgcactctgggctatcttgggccccgtttgctcaatgcaggcccctctttctgaagcgcttttcttgggctcactctcaattcgtcaaagttcggctcaggcccacctcctgcaggaatcctcccagtccccgctgtccgaagtcagtacccttgtcaggagaccttaaacactttagtccactgcctggccctcccatggggcaaaggtctccagggtgtgtgtgcacttccttggggcttcttaaggctcattccctgggattagggaggacatacagagcctccttgcacctacatttgtttacatattacttataccacatacaacgttatagggcactgctgcataagtgtacattttgaatgtattttacttataaagaaatagagcagtaataggaacatgtgcccctaaatgtaattttactgaccagacaaaaaaaatttt

SEQ ID NO: 24324 - DNA, 1050 bp, Homo sapiens
ggccgtgacctcactgccgtccattgcaaactcgctcaactggagggagttcagcttcgttcaggtaaagtagtctctagtctgccagccagcttcagcgtggccctggcccacctctcatgagtaagtgctctgcctttgagaactgcctgggctctgatcatctgcacagcaggaccactcggtgagatgccaggccttcctgacccagagggcccatccaagcctcttgataggggctgcctgctacaagcttaacctcccaacacatgaggaagccagacacaggcatgtgaaaaaattacagaccaggacactgagccctgggtccaccattctcaagcttctagaattcttgagctttccaaacaaaattgaatgacatgaagtcattggacattttgctggtctaggtaggagtcatcatctacctagacatccatctaggtaggagtctagggagtgagcgagcctagcccaccaccctccacccctcatctcaacctggctctgttgttccccttaaccccttgattcatgcagcgtggatgagacacaagcattaggaccccagtttataggggatgcgacacagctttttcccaaggatgccattcctatgaaaaaatccagaaaaaggaggtctgtcatcagatgaatttgagaaaagatttacttccccctaagagatcacaatgcactttggcacatcaaagattcgaataacatctacaacaaacaaacctttgttaatcagacttattggagtgttagcaccctccccctccttttttccaaataacagctatcagcactccacaagctgggcgctgtggcatgtggctgggatcccagctactaacagaggctgaggtgggagaatcacttgagcttgagcgattcttccaggagttagaagttcaagtgtccagcctggacatcatagcaagaccttgcctcttaaaaaaaaaaaaatactccacagaacatactctgggaaatgctgctagtggcaaaagtttctttttgcatttgttcattcaacaaaca

SEQ ID NO: 24325 - DNA, 1051 bp, Homo sapiens
aataaatgtcaactagatttggaaacatggaaacctaatggtgagaatttcagtaggatgttgagggtaaaatccagattgagtatgaataagaaggaaatggagacagtaatactggacaactcttctgagatttggctgtaaagcaagggaaagagaaaggatgggtaatgggaggggtatgtgggggttgaaggagggctggttatttttttccatggttctgacctaaacatgttttaaatgcttctggggaataaacaaggtgaaaaggaatgatggaagatgagagagagaatgatagagaatcacaaagtcctggaggacatgggaagagatggagtgcagagtacaggtggctttagaggaggagattgtcctttacaactaggagagaaggggaaaagaagtggctgagtattgaggggaggggctagttgtgatgacacagcatgtgacagttcccttctgatgttgtctgttctttttaaaaaaacagtcaatcccttctgctgagaacaggggaggaggaaggtttggctctgagggctgaagagggacaaaatggctgaaaataattgttggagaaaatgtaaagggagcagaccagaaaaactgatagggtttaaaaaacaaaaacaaaatttgattataaccattttttatccagagtgaaatataccaaattgtgtttcctgggaagtgtgcaaagtagatttttgtttagttaaattccattttccctcaccagtttctttaataattctaggtagtttgtcttagttcagtgtcatctctaatagtcactcagaaatgccttggcttcatttttgttttctctattcagaaatgaacagtcacaaatggaactttgatgcactaggcaaccaaaaacttccattgccaatcctcccataaagtgaataatcaacactcttgcttattgagggttgattgcatttattggaccagaaacctaacttatatctataattctcatatatgaagagtctattcttaaaaatctaattttagccaacatttaaaactt

SEQ ID NO: 24326 - DNA, 1051 bp, Homo sapiens
acagggctctaagctataacagacacagccccagcttcctaaaagcctctgagcaattacagcaaggctggttgcattccttgtatgcggccattctgaatcctatccgaccctgtcctgtttcccaccttgggacttgccaaggacagagcctggccctagtcatccatgattgctgacatcagtggggaaatcaggacacttctgggtcacttcctgtagggcacagattactacctagggcaccagggaccctggctttaggaagatttttttataatattgcgtccctacacacaggtcagaggttgatctcagaaaggtgaagaaacatgctctagggctttgtcgctaagttgggtggtaggcagctgccttgtaactgtcaccctgcacttttccttctcccatgcctgctgtgtgctggaatcattagcactctgtcctagatcccttgtgaacattgttctcctggcttaggcctcgcctctccccatcccaggttcatggttctgtgggtatgaacctgcaaggatgcccgacatcccagagcaaccaaaaacagacccaggacttggctgacttacagaaaactacaacacacaaagactccccctcctcagcccgcccccccccccctttgcaggcacacacacacacacacaaacacacacacacacatctggatacagccagaatacagggaggggagtctcagagtcatggcgctgatgctggctctgctcttcactgaccctcctagccctgctgcctcagtccccaccagtgtccacaatgcaaggttccactcagccttgcctggagctgggcgcgcacacacacacacaaacctgatccccatgtgtgtgtagatcacaggctgagttccagatcaatgcatgggtcctcacccggcgaggcctcctgcctgtctcctccccaccatgtccctatagtaacataatggggcctttattatcctccagacactgtgctaggtttttagagacattttctcatttattcccaattggggcatgtggttggtaat

SEQ ID NO: 24327 - DNA, 1062 bp, Homo sapiens
ttacttttttgagaattaggttttttttatcccacagaaaattgtagttattcatgtacattatttaataattattgaatacctaacatacattatggagtataattcaaaaatagttggcagccattaaattatgagagagatgttggattctatttagaaagattttcagcttggttttccttctctggaaattacatgtagattttattgttttttgtaatatgtataatgcacaaaacagtgcagtacacagatcttcattatataactcaatgaattattttatgtatacacctgtgcagtaccaccagattaaggcattgaatatctctctcaataaaaaggattcccttgtgctcctctaagtatagtcacgcatcacttaacaacaggcatacatcctgagaaatgtgtcgttaggtgatttcatcattgtgttgagcatcatagagtgtactcacatgtagatggtataacctattacacacctaggatatatggtatggcctgttgctcctaggctacaaacctgaacagcgtgttagtgaactggctattataacatgatggtatttgtatatctaaatgtatctaaacatagaaaaggtatggtaaagatacagtattaaaatcttagttaggcacagcggtaggcacttatagtcccagttacttaggaggctgcggtggaaggattgtttgaacccaggagtttgagttcagcctggacagcatagcaagaccttgtctctgaaaaataaatcaaaaatcaaaaattaaaaatctataatctatggcagtggtccccgacctttttggcaccaggaaccggtttcatggaagacaatttttcatcggacttgggtgtggggcaatggtttcagggtgattcaagcacattacatttattgtgtatttaatttctgttattactgcattgtaacatatcatgaaataattatacagctcaccataatgtagagtcagtgggagccctgagcttgttttcctgcaactatatggtcccatctgggggtgatggtagacagtgacacccaa

SEQ ID NO: 24328 - DNA, 1024 bp, Homo sapiens
ttgcatttctaatctaaggaagcacgtgtgcatcaggtcctagtataaggtctactaaataacagaggctcaataaaagtcttcaaattaatgaattctcttttgagaggaaatattttgaagtctttaaaggcattagtagggttcaagactaagaaagagaccacatggccttattactttgatttttactagggaaagttgtaagcatataaaagtagaaagaattgtaaaaatgaacttctgtatatccagctttataacagttattaactcatggccaaccgttttcatggtggaaatccactcaacacaagatgacaactcaaaaaaagctatagaaaacagaaaaattcaggtggactcatgatataataaaatagttattgaatgcctactattgatagacgtgtagagtagggttttggttgttttgtttcgtttttttctttttcttttgaagtaattgtaggttcacaggatgttacaaatatagtacagagaggtctcatttactgtttactcagcttctcccagcggcccaatggtaacatcttctctaactgtggtacaatattaaagtcccattagttgacattggtaccatctacagatcttttatagctatcaccagtttttacatgctgtcatttgtgtgtgtgtgtgtgtatttgcatggatgtgttactttttacatgtctagattcatgtaacaattatcaaaatacagcataaagtattatatatgatgttagctgtgagacttcatagatgttctttatcacattgaggaaagttctctattactaacttgttaaaagttatcacgaacgaatgttgcatttttaaaaatgattcttgtctgtctattgatatgatcatgtgacttttcattagcctgttactatagtggattaccacaaacaaataaattttaaacaaataaactaaatatggtggattatattgagcttttttagaatattctgccaagaattggtatgcatttttctttttttttttt

SEQ ID NO: 24329 - DNA, 1028 bp, Homo sapiens
gaaacaactggaaggcttcttaaaatacagatttctgggacctatgcctagagatttctgaatcagaaggtctactttggaactcaagaaattgcctttcaaataagtttccttgtatcactaatgctgctagtccaaggaactatattatgaaaatcactactctaacccagtatgctgttaattaacactactaagttatgacatatttttcttggggtaagtttatttaccctttgaagatttcttttatataactcaattcttacattatttatttcattaggtttgagtaaatatgggaaaagtcacatacaggctgaccgttatttcaacaagccatgtttgaatacatggttgctaaaatgcttaaatctattttatatgtttcactatttctctcttatctattcatatgtttccactgtaatatcttaattcaagctcttatttgcctgttgtgtaatcctctttggtagcctgctaaatgcaattttttgcttcttgtctcgtttaactctgttgtattttgagagggaatggcaaagagacctggggtgcacagaagtgtttaagaaagaagcaggagcatatgcagagatcaagagtgaagaaacaggaatgctgaatttgaagaactggaaaaaagttttagtattaaacctttatttaataaaaggagaaggggtaaaagatgagatttgagcattacatgatatcatgaaaagccttttaatccatgataaaaatcaaacttacctatgaatttatttatatgactaaacacaagacttgtattttacacatatccctgtggttatagtgtagccagcaactaatagacagttgggagattgttggaataaagaaattgctaagaaagtagtggttggctgtggggaatgaagaaaagaagatgagtgctagagataattcagttaggagataaagtcaacaggactggttggtttgattcagatacagtgagttcatgaggaaaaggggtaaatcaaggttactacttcaaa

SEQ ID NO: 24330 - DNA, 1072 bp, Homo sapiens
tgtttaacaaattatagcacttttgaaattgctatgtttaaccttcggttgtgtatttttgttttgttttattagattaccctgtccttctaatactgctgcccttttagcttcatttgctgttcagtgtaagtatcagcccatttttaggtcaaatagcatataactgtggtttgtgttgctagtacattggcttcaatgtgggagttctttagaaatgttgctatatagaaaatagtgactgcagtggaaatgtaatgaaatctccagttagttagcaattactatgatttttgaaaaaatttcctctgaaattgagaccaagaagaatgttaaatggattgctgtggcttgcttaagtggttatattagaaacataagtattttacatccagaaatagaattaatggcatcgctgatttgactataataatttaaaaatttgtttattaaaatgtgaatgttttcctttcattattagctgaacttggagactacgatcagtcagagaacttgtcaggctacctctcagattattctttcattcctaatcaacctcaagattttgaaaaagaaattgcaaaattacatcagcaacacatgtaagagttttttagttttttatttgataaacttcttaatggcattctttctagagaaatgtttgaaattctaatatgatggctgtatttaatatagaacaattactgttacctaaaataatattatcataaagaaatataggtgatctatgctaaaaaacgatttcatagaatatatgaagctcattttcatttctattcagagccattaagctatctgtaaacagatatttatttgctattgtgtaatagtctaaataattttagaatataaacagtatagtcacaatatagagatcagtctgcttagtaattctttctcagtttttaggtataaaggacttgattctccttggtagtgagccaagaggagaacaggaactctatataatactgaattaatttttaaaaaatatttctttaagaacagtacaggttgaacatccttaacccaagagtttgaaattcag

SEQ ID NO: 24331 - DNA, 1077 bp, Homo sapiens
aattttttttttttttttttaagtggagatggagtcttgctatgttgctcaggctgatctcaaacttctcagctcaagcaatcctacctgcctcggcctcccaaagtgctgggactgcagacatgagccaccacatctttataaaacattttaaggactttggcttttaattataatcaaaaccattagagagttttgaggcaataaaagacatgttgtgaatttacatttttaaaatataacaatgacttttgttttgagagtatactataagatactaagggaagagactgttggagtgatccaggtgaaaggtaatggttcttgtagtattggggtggtggacagtaatcagattttgaatatattttgaatatggaagtgacagcttttactcatgtgtactggctatgggtgtgagagaaaaaggatttggtaattattccaaagcttttggcctgaacttttactaagttgggaaagacctgggagaagtagatttagtagaagcataagtcaagaatttatcttgggacatgttaaatttgaagagacgtaaatcctcacgaaagaggggtaggcaattcaatttatagacctggagttgagaggaaaagtctggactagaaataatacatttgggaattgttagcgtatagttaatagttaaaatcatgagatgagagcactgaggaagtaaatttagtagatgttgaagagaacaggtcctcaaagttagaacacttcaatgtttagaatttgaagagatgaagaagaaccaggaaagagaaccaagaaggagcagccattcagaaaggagagcctttctttctatcaaagacacaaatgtgtgtctctgaagccaagtaaatcaggagcagtcagctttgtcagatgatgctgttaggtcaaataaaatgaggacagagaactggattagaaaagtggaggtcactggtgacttttcaagagcagttttggaggtgcagtgatggccaaagagtgatgagagaatatgaaaaaaaaaacaaaaacggagaacagtaattttgagggcttttgctctacaggacacag

SEQ ID NO: 24332 - DNA, 1033 bp, Homo sapiens
cagataaaccagtagaaatgctgactgaggatacatcacccaagcaaatctacccttcagaagtgaagtagaaataaagtctttctgagataggcaaaaactgagagaattcatcaccactagatggatctcacaagaaatgcttaagggagtccctacatctggaagtgaaaggatgctatgaactatcatgaaaacacacaaaagtataaaattccctgacagagcagataagatatatctagagtagatgagaaaaagaaaggagtcaaaggttattactacaaaaaaaaaaaaaacaaataatcaagggaaacaataagaggatgaaaggaataaaggatgtacaaaacaatcagaaaacaattagcaaaataacaagaatagatctttacttaacaacattgaatgtatatggtttaagttcccgttaaaacttagacactggctgaatggatgtaaaaaaagaagaccgaattctatgctacctacaagaaactcaacttcacctgtaaaaagcacaatagactaaatgtaaagggaaggaaaaatcccatgtaaatggaaaccaagagcgtacagaagcagttattttagacaaaatatactttgtaaaaaaccataaaaagagacaaggtcaatatcaaatgataaagggatcaattcagcgaaaggatataacaattgtaaatatgtacctaatactggagcacccagatatatgaagtaaatattgttaaagatagagaaacagactccaatacaatagtagttggggacttcagcacaccagattcaccactggacagatcatctagacagaaaacaaacattggacttaatctgcacggtagaccaaaggaacctaataaacatttaaacaacattttatccaacagctgcagaatatgcattcttcacctcagcacgtgaaacactcttcagaaaagaccatatgttaggccacaaaacaagtctcaaaaaaatttttaaatagtaattatatccagtattttctcacaccacaatggaa

SEQ ID NO: 24333 - DNA, 1098 bp, Homo sapiens
catggaaacatttccctagacaagcaatacttgaatctatgggcccttagaagcttgtattcttggcagttgaaagtaacataagaactaccacatttgggagctggaagccctggccattaaggcagacctcaatgaagctttggctgaaaaagagggatgtatgctctgatgcagtctttgtagacttggcagaatttagagcatttgtgccctgaagtatttctatgcagacatctaggctaagtgggcattgctgttcacttgcttcttttgcagttatattttataccatgttataaaatttcagaaagactctaatctctcctaggagaaacttctctttaagaccatacaatcacatcattcattattaatcccagctgacttccttggcactgatcatactttctttcagtttcacaacacttatttactaggtgtctagcagccaacctctcaataagcttacacctcctctacaagggagaacagatgtatccaagggtcactctggcagtaaatctctgtatcagttatcttgttatgcttgatcacaaatgagcctaacttaaagagacataacaaaagttctttctttcttacattgtatgtacattatgtgtcatctgtggctgtgctctaccttatcttcattctgggtcccagactggtagcattccctgtttgggacatggctagtctcatgggcaagggaaaaaagaagcataatgaaatcataagctgtttcatttttttctttttttttttttttttttttttgagatggagtcttgctctgtcgcccaagttggagtgcagtggcgcgatcttggctcactgcaagctccgcctcccaggttcacgccattctcctgcctcagcccccccgagtagctgggactacaggcgcctgccaccatgcctagctaatttttttgtatttttagtagagacagggtttcaccatgttagccaggataggatggtctcaatctcctgacctcgtgatccgcccaccccggcctcccaaagtgctgggattacaggcatgagccactgtgcccagcccataaactgtttcttaaagcttccttt

SEQ ID NO: 24334 - DNA, 1025 bp, Homo sapiens
tagctatcctctttaacacatagaccacctctttttttctgccaactacactatgcacaaaataatgtgaggaaaagctctgtctgctatagcccattattacattttccccagtaccattggctcccaattcactatacttcaggtatctcaaagacatttacaaaaacttggaactaattggtatacaaaagcatcatactgctagtgcacagagggaatatatgaatgtctgtcatctacttcactacataagtagacaaaaaagcaacttgagagaatgagcataactctaaatttgaacgttccagattttaaagctttgggttgaattatctcatcttcacaacaactctaagaaataatcagaacttttcattttcagatgtcttttcagaacttcagatgtctaattaatcattcatttcagaagcagcagagtaacttctagaccagtgttttttccactaatgacagtgccttattggattttattgactttgtgttgataaagaatttcagtagttgtgcttttatttcttcatgcctttaccacaagcagttcccttttttgtaagatccaaccccatcatttccttctcaacctggcctatcattcctcaaaattcactctcatatgttttcattgctatgttcccagaacatgtccatatttctatttcttttgtctcttttaccttaatcgctgtttgtcttctcactttgtgctatagtgcaagactataaaaatgaccatgcaagatgaaattgtgcaggatcttgatgattaataggaaaaattatggttgttcccatgacctttaaatttattgtcaaaacattaagaatttcctttactgtctcttataaaggtaaaaggaaatgaaaaaaatagtaaagctaatataggattttgtatcctgtaattcaaaacattagaaacactgagaatttaaatgttttattttcttgtgaaaactcattatgagtagtttaaacggtgcttgcctcctccccgtggtaca

SEQ ID NO: 24335 - DNA, 1041 bp, Homo sapiens
ccagcctgggcgtgagcgagattccgtctcaaaaaaaaaaaagatatatttgagtttaaaatattgttgtcttttgtgcattcgttgatggtttattattgtcattctatcattttgcattttaaggagttgctccagtaagcttctattccttgttcagattttaaaaacttaaatttaactcctttaaaatagtatttttccaactaacgtggtagatggaagatacagaacaagtaattgagtcagtgcattttttttctgttttcaaaatattctgtatttggcttactacttttataattaaaatattaaaatgatattgttcttctgtgttataattcagttttatgcacaaaagccacaagtagtttaacagaatagtatcggtaagatcttgcctatatttgtcttttttagtgctggaatcggaagaactggggttcttattactatggaaacagccatgtgtctcattgaatgcaatcagccagtttatccactagatattgtaagaacaatgagagatcagcgagccatgatgatccaaacacctgtgagtactgtactttatatacaagtgtatattcttaacatgatgatttttgttgccaatgcatattctaaatcatatttttatccttttttatcttttcaattccttgccatggtcaaataacctctagcacaggggtaagcaaactactgcccactagtcaaatctggcctgccacttgtttttgtaaataaaattttagtggaacacagccatgctcatttatctatgcctgctttgatattatagctgcagagtttagaagttgcaacagtaccatatggactgctatttctaaaatatatttaatatctggccttttacagaaaaagttttgctaacatgcaagttgcctggcatattaaatcttgagtgcttaaacaggcacagaggaacttgctttgtattatttagtcaagctgaatgctgagaatgatagtatccctgaactggagagtcttgatagacctgctttctgtgaaata

SEQ ID NO: 24336 - DNA, 1055 bp, Homo sapiens
ctccgcttgaattactctttctccattgcaattcccctgtcttgataaattggttctgtctaggcagtgggcaaggtgaacccattgggtggtaacaataccttgatgaacttaatcattgcaaagaggaggtgaagtgagggctggatctgaaagaggtggtgacctgaaataaatttgttaggtggggataaagaacatgagtagcaggtactggtgtagatacagatgactaatgaatttgtagtgggccagagctttgtgggtctgttttcactttcctgtttccagtttgttcattttcaatagctacaaggtgagaaaaacattttatttttaatttatgaaaataaacaagacattgaacctgtaatcaagatctcacatccatattctacacactctgaccatcctggaccttcttactgttgcctaaacatgatagacccattacaagtctatgctggctttacactaattagaattatgggtacaagatagtacagaggaagcaggatttattctctgtgggattattggaaggcaacactgatatactgattcttgagaaaccagaatcaagagttcattagaagggcgcagtgtggtaactcacatctgttatcccagcaccttgggaggttggggtaggaggattgcttgaggccaggagtttgagaccagcctgtccaatgtagccagacctccatctctacaaaaaaaattttttttaaagttcattagaggcataaaggacgttctaagcagaaagaaatgcattttgcaagggttcagaggcatgacttattggggagattataagcagataaaaatgctgaaatgggccaggcgcggtggctcacacctgtaatcccagcactttgggaggctgaggtgggcgtatcatgagttaaggcgttccagaccagcctggccaacaaggcgaaactccgtctctactaaaaatagaaaaattagctcagcctggtgggcgcctgtaatcccagctactcaggaggctgaggcaggagaattgcttgaaactggaagatgga

SEQ ID NO: 24337 - DNA, 1057 bp, Homo sapiens
taatgtctaataacctgccttttaaaatttaacaatgtaagtaatttttcaaattcttaagtatttgctttcattatttttcgtggatatatagtgctctattatattaaaatgctttaaccagttcactcttgttagatacataggctgtcctaattttctttgatgaaatttcttgtaggtaaatctacacacatccataatgatttctaggtgtagaattgctgggttgaaggcacatagttatttttgagacattatctactgtctagtcagattgcttcctggaagggttgtgctcatttgcactcactatggtggatgagaggctacatgaaatagtgcccaggtgaccagccatggaatataggacaactcccagttccatggttttggggagaaaatctggggcatgaaaactagttttttctcttactcagtatgtgatttgcatcaggctgtagtaggtatttgtgtcagttaagtctggaatatttggatattggatttctgggctggacagtgatggatgaactgtttactgctgtaggttgaagaattttctactgaaagaaaattgaattgttttttgctactggcaggcctagtgttctgttaatggaaggatgcagaccggagctgttcctattcggccatcttgccagcctagattgaaagattaaagattgctagattgaaataggcttaaaagtagatgtccaactgaatttattaaaagatgagagatggcacagtagcccgcgcacttgaaatctcaagaaaatattgcatagcatttaaaaaatatttgctgaacattttatttaaacatggaaaggtattttgctgccacactgatagttcagtgaattgcacttttggatcttggagaatggagagaagcagctaggcaaataattggcaagaaaagtaaacagttacagtgcagctttgtttacccactctgcctatctgcgtttctgaaattggattccttggctctgtgaactagttagccttcctttagagtgcttggaattgaaagcatgtcagagag

SEQ ID NO: 24338 - DNA, 1025 bp, Homo sapiens
caggaaatggtttgttaattccttaaactaaaataaaatattgcctagttaattgtatttggaattccaagtcataatcttaaagtactttaaatatgattgaaagcaaattattcatatttgtgagctggaaagcttattattaaataatcatattgagatggggaaaataaggatgttggtgataaagggagtgcagttgtctaaatgaagaccatcagacagctgtccttacttattatttatttgaaacaaaacgttaatacatttaaaataaatctgcccttattagcttgatgtggtagtggtggatgattctctgctgaaaaagacagtagaatattttcccaggtccgtaaggaaagtatatccactacgtgttattccacacaacatgatgctactttgaatgtgtttttctcattaaagacgaagggtaaagtcagaagcaaaacatgattaaaatctgataaagcatgagataccctaaggagactgagagagaatctgatgacaggaaaaagatactttaattatttagacttccaggttctttttttagattaatagtaaatatacaaatatggatactttgtgtcttattggagttaatcacttgagtttatcctttcccaaataaatatatgtggcttggtgggggctccttggggattatttgattcagtggtcatgttgggtgtatcacctgttcaagttatttgtctgtttgtgaaatgaattttgataattcataggatttttctctttttctcttgctcttagtttgtttagtacctgaaatctaatgcatttctgtggtgatctcaaggttttggtcagctttctgtgcagccagttcttccttcatggtggtggctcaacagtggttggtgattgttttcagtctttgctatgtaattatttttcactgttattttggcttaactaactgcagggtgccttgctcttgatacttgggtgtatttttatttcagttccaaataacttgtgattagtttataaga

SEQ ID NO: 24339 - DNA, 1034 bp, Homo sapiens
taaagaattgatttgcgaattcctgatgagagaaactggattggaggggtgttagggatggaggcagcgataggggtgaggaaagtaaagggctaaggctggatggtagtaaaattaaacttgtctattttatagaagttcccatatgcttcagaatttcatatcaaatattgcaaatacttgttctttttactgatatttgcaagatggatatatatgttgtttccagagctctcaggtatttataagtagctcaacctaaattaaataaattgtcaccaacctatttacactctacattttattatgcctaaagagtcagtgatgataaattcggaattagagaagtaataacctccagaagcaccttactgggtcaccatccttttgatcaaagggtgtcatcagtacagaacttaagtattatgtcatttaatttacagtgctttggctaattttatttaacttaattaatttaacatcttgaattaggttggttacattttgactgtttttacagtcaaggaaacttgtagaaacacagcaaagctagtgaccttcacactttcacgcatgaacataaatgagctcataagatcatcgtctctttttgttgcgtttcaaaggcgtttacctatcttggagtaagatctaacatttctgaccttgataggataatcatagataacatacttttaaatgaatttacagagaaaaataaattttatttgtcctactatgtgtataatatgtctgttttgaaaagcacctagtatacaaacactaatattgtaataccagtataattcaaatcatctttttttttttggaggggagtttatttaaagtgttggccaaaaaatgttatttataacacttggttggatctttttttaaaaatttcttttcattgttgttcactgttcaaaaggtacatcgccaggttggatctttttatttactaatgtaaactgaacaagtttgaaggtggttgtcccctattagttcatcgtgccccagtggtgggagctata

SEQ ID NO: 24340 - DNA, 2026 bp, Homo sapiens
ttttaatttaaaacaatctagtttggattatttggacattaaataccaatttaatgtcagtagtacatgtaaactttgcttctatagagctttgtctcccactttgtgctgtttttctcttacagaatatgtctctgtgcattgtatgcccatcaacatagatttaaaatttagaaaaaacatttttccagtattctcatcatttcatccagctttcacaatgattctgcagtgcgctttccttttcctatatgattgaaggaggtaattgagtcttctgcaccaatctggttcttaacctcaaatttaggaagattaggaaaagccttatactggaaacttaaacatgaaaataatgtttcttgccaaaagaaggaaaattttcttaaaagtaatgatgaatggcgttttgttttttgagatagggtcttgctctctcttccagtctggagtgcagtggtttgatcatggctcactgcagcctcaatctcctagactcaagtaatctcacttcagcctcccaagtagctaggactataggcacatgctaccacacctggctaatttttttatttttttttattttttgtagagatacagtctcctctgttgctcaggctagtcttgaactcctgagctcaagtgatcctcccacctcagcctcccaaagtgttgggattataggcatgagccactatatctacctaaatgtagtaagtctttatgctactactgaaaaaaagaatgaatgtcaaaatacactagtgtgtttgtgaaaacagtaccaactgggaatttgcgtaatataaaaatccaaaaggatttttccatttaaagcttctactagaaaataataaaaacatcttggatgttacccttgaaaatatttttcatttgcccttaattttaaaaatttattgtgaaataaatatatagagaaaagtttataaaaaatacagttccagtttgagtatctttcttcaggttaagaaatagaaattaccacttctttagaagttcttctggtctcttaatccaaattcatgccaacactctaactcccaagtgagttgccagggttcattgccttccccaatgccttattcctatctcccttcttccctgcgagaaacctggcttctatttggttaatatgtgctaaacagtttcagaattgctatacccatgccactgtcaacaacaaatctaagtgacatttagtatttcttcatggttctcctttttagacagagtatatagttgaagtattgcacttcaaatttacttggattagtaccctttcctcctcagtgtgattatggtatttatttggtcgtagatgaattttaatttttctagatattgcctgactctccttcattgaggattctgcatttgaccagcagagtatgagagtgcttctacctctcatagcctcactgacaaaggatcaagaaagactgggatttttgccaatctgaaaaacaatatatggtatctaagtgtgtgtttttttccttagagctttatcgaggtacacttggtgcaataaagtgcatctttaaagtgttttgagtttggacacagacccgtgaaaccaacaccataatcaagattcatgatgaatatgttccacgtagttttcatttaaatccctctcagtagcatatttgtatgtttaagagccatttgcattttttccataaattgcttgttcctctccccctgccccctccccatttttaaacaaggctgttggcctttttcttctctacttttaagaagcttttttgtggataattgggatattaactctgtgtatttaagctgcaaaaatatattttcagtttttcactgtttacttttagtatttttctgtgcgaaagttttaaaagtttttatataagcagattgatccgttttttctttaatagtttctggaatttaatagagttttcctcactgctacattttagaggaattcagctatccttgcctccagcactgtatgggttaattttcttac

SEQ ID NO: 24341 - DNA, 1056 bp, Homo sapiens
ttaattaggtcacatttgtcagttttggcttttgttgccattgcttttggtgttttagtcatggattccttgcccatgcctatattctgaatggtattgcctaggttttcttctatggtttttatggttttaggtctaacgtttaagtctttaatccatcataaattaatttttgtataaggtgtaaggaaggggtccagtttcagctttctacatatggctagccagttttcccagcaccgtttattaaacagggaatcctttccccatttcttgtttttgtcaggtttgtcaaagatcagatggttgtagatgtgtggtgttatttctgaggcctctgttctgttccattgatctatatctctgttttggtaccagtaccatgctgttttggttactgtagccttgtagtatagtttgaagtcaggtagcatgatgcctccagctttgttctttttgcttaggattgtcttggcaatgtgggctcttttttggttccatatgaactttaaagtagttttttccaattctgggtagaaagtcattgttagcttgatggggacggcattgaatctataaattaccttgggcagtatggccattttcacgatattgattcttcctatccatgagcatggaatgttcttccagttgtttgtgtcctcttttatttctgagcagtggtttgtagttctccttgaagaggtccttcacatgcctttacccaggtattttattctctttgaagcaattgtgaatgggagttcactcatgatttggctctctgtctgttattggtttataggaatgcttgtgatttttacacattgatttttgtatcctgagactttgctgaagttgcttatcagcttaggtgattttgggctcagcagtccttgagcccaggatatggtggtctgattgttggttgcacagatatttctaattcttcccttcattgcagacaaagttttgtttttttttcacttgaaactttaaaactctaaacttgtaaatagaactttttcagcctctgttcctgtctagaaaacctgg

SEQ ID NO: 24342 - DNA, 1048 bp, Homo sapiens
cttatattccataatatagactctcaattctgttgttgatttacatgtctgtctttgtgccagtatcagcctgtcttgattactgtggctttctagtaagttttcaaattcaatagtgtacattcatttttgaaattgttttggctattctagctgctttggctttcataaatcttaggattggctggtcaattctacaaaaaaaatcctgctgggatttcgatagtgaatacattgaatttacacatcagtttggggagaagccatcttcaatattaagtgttccaatctgtgaacattaaaagtctatttatttagatctcctttataaatgattttcagtgtacaagtcatacatagcctttattaaatttattcctaagtttctatcccttttgatgttactgtgaatgaaattgtctacatcaatttcctcatgagtttactcatttttcatgtatagatatacaattgatttttcttatattgatcttgtattctgcaactttgtggaacttatttatttaggttatttatttaaccttacttattaaggttatttttttcccttaggttttcaggtgggagggcagaccagtccctttcactccattttggctgggaggagaagtctactcaaagggttgtgagaaatgaataaaaccatttgagataaaaacttttccatgaatcttattccaacaaagaccttgttagtatagtccctcagtatccatggaggatagattccaggacctccctgagataccaaaatccgcagacgcgcaagtgccttatatgaaatggtgtcgtgtttgcatgtaacctacatgcatcttcccatatactttaaatcatctgtagattacatagaaaacctaatacaatataaatgctatgtaaatagttgttaaactgtatttttaaatgtttttttaatttttatttttgttttatttttgattcatggttgcttgaattcacagatgtggtggaaattgcagatacagagggtgagtagtgttttaatttttcaagttaaatttct

SEQ ID NO: 24343 - DNA, 2109 bp, Homo sapiens
taccctgataacaaaaccagacaaagatacctcaaaaaaggaaaactgtagaccagtatctctgatgaatactgatgcaaaaatcttcaataaaatactagcaaactgaattcaacaacatattaaaaagataagtcatcacgtccaagtgggatttatcccaggatgtaataaggatgggttagcacatgtaaatcaatcaagggtgatacattatatcagcagaatgaaggacaaaaaccatatgatcatttcaattgatgctgaaaaaacatttgataaagttcaatatccctttgtgattaagaaaaaaaaactaaaaaaactgggtatagatggaacatacctcagcacactaaaagccatgttatgacagacccacagctagtatcatgcctgaaagcctcctttaagatctggaaaaaggcaaggatgcccactttcactgctgttattcagtgtagtactggaagacctagctagagcaatcagacaagagaatgaaataaagggcatctaaattggaaaggaagaattcaaattatcatcagatgatactattttatatttggaaaaaactaaagaaaaagaaaaacaattagaactaataaattcagtaaagtggcaggatacagatcaacatacaaaaatcagtagcatttctacatgccaacagcaaacaaactgaagaaaaaatcaggaaagtaatcccatttacaatagccacaaataaaatgaaatacctaagaataaaaataatcaaagaagtgaaagatttctgcaatgaaaactacaaaataatggtatgagatatcgaagaggacacaaaatttgaaagatattccatgttcatggattagaagactcagtattgattcaatgtccatacttcccaaagcagtttgccaattcaatttaatccctatcaaaataccaatgatattcttcaaagaaatagaaaaaaataatctaaaatttatatggaaccacaaaagactcagaatagccaaagccgtcctgagaagaaaaaacgaaactttagaactcatagtacctgacttcaaattatactacagagctatagtaaccaaaactcatggtattagcataaaaacagacacatagaccaatgtaacagaatagagaagccagaaataaatccatacatctgcagtgagcttacttttgacaaaggtgccaagaacatacactggggaaaggacagtctcttcaataaatggtgctaggaaaactggatttccatatgcagaagaatgaaacttctatctctgccatatacaaaaatcaaatgaaaatggattaaagacttaaatctaaggtctcaaactatgaaaccactaaaagaaaatattggagcaactctctaaaacatcagtctatgcaaagatttcttgaataatatcccaaaagcataggcaaccaaagcaaaaatagacaaatgagatcacatcaagttaaaaagttcctgcacagcaaaggaaacaatcaacaaagtgaagagatgacccacagaatggtagaaaatatctgcaaattacccatctgacaatggactaataaccagaatatataaagagctcagacaactcaataggaaaaaaatctgataatctgattttaaaatgggcaaaaaatctgaatagacatttcccaaaagaagacatacaaatggcaaacaagtttatgaaaaggtgctcaacatcactgatcatcagagaaatgccaatcaaaactccagtgagatatcatctcaccccagttataatggcttttatccaaaagacaggcaataatgaatgctgacgaggatgtggagagaaaggaacccttgtacactgttggtgggaatgtaaattagtacagaagtacagagtgcctcaaaaacccaaaaatggaacgatcatatgatccagcaatcctactgctagataatatgcccaaaagaaaggaaatcagtatatcgaagagatatctgcactcccatgtttattgtggcactgttcacagtagccaagatttggaatcaacctaaatatctatcaacagatgaatagataaagaaaatctggtacatatacacaatgaagt

SEQ ID NO: 24344 - DNA, 1054 bp, Homo sapiens
tttggaaggcttcctcaaagagagggccagactgggtcttccaggaggaggactttgccagcagaggggttggggaaggaagggcaatctgggcagaggacctcatagggcaagtgctggacagggtgtggcatttctggggcctctggtatgtgggagagtcagcgtggggttgcctccaaggggtggctttgtggtccccccggatgactcctctgcctatccatggtttagcttcaggtcatgggacataaatgtgcagaggcccaggttctttccgaggctggaacatttgggatcctgatgtgcagcaatgagattgatcatcagctttgccttctcattctccccgtcttgggtttgggctcagtttctaaagttatatctttctgtctggtgggtggtggttctcagaatgctctctactatgatccccagtcaagattataggttgagattaagattatagtgatcttgcattctccatccatccatccatccatccatccatccatccatcctcaatccatcatcatccaactatccaaccacccattcatccatccatctacccatccatccatccatccatccttccacccatccatccatcatacattcattgactgcaaggattttaaaggcctttgctgttggtctttggtgtacccttcctccccatccatgaagccaagggtcatgtcctctgtaaagtatttcctaccacagccctaggctctcacttgtctctgggatttcccttgcttataacactcattaatactgccttgccattgtctgtttatttgtgcttaacacgtgtttgtttataaatgaattttgggaaatgtttcaagggaagaaaatggcattttcccattttctttgacatctctcttaaaaaatataagttaaccaggtagtctccagattgacctccttggtttgagaaagcaagcacaattattaattagtgattagttttaatatagtagagctgtattttaaaaaaaaaatctaagcatgtggtatagttcatttggaccccacacat

SEQ ID NO: 24345 - DNA, 1033 bp, Homo sapiens
ttttggaaagcctgccagagtgaacctgaaaggcagccatggataccaccctggggtacgttggtgggctctgcctgtgtcctggctttgcaggatctcagccctcttcactgtgctctgcatgaggaggcgggccggcacagagagtggtggcagcagctcaggcaggacccttccctgtgtcgctcagcccattggcaggtgtccagcacgtgccgcttgggttcagcactcttctgggcccaaggaatgagagctatgctgtgcgattggggcggacacttgccttgctcctcaccagctctgtgacctcgggcaaatggcttcaggtttctgaggcttggcctccgcatctgtaaaatgactggtgaggctggctgttttccaagcgtccttcctttcaacttagagttcttgattctaaggggtcgatcaaaggccttccttctcaaagacttttgccatcttctgtgaagacagaagatgtttctgttgaaagccagtgctctgggagagtagtgtgacttagtgcggctctgactgcccttccagtcgggaggctgtgagtcattgggctggagcccagagctgtcttagggggccttctgcctgtcccagccttaggctgtctgatgcagaccttgtggccacagggtctgtgactagcagcattcagatgctcagccaagcactgagtcttctgccttccagaggggccactgggcttgctggaccaggactcctcaaagttagaaggggagtggaagccagcaaccaagtaggtggtgtggccctccccacttcctccatggccaacgcccacggtgcttgcagactgcacagtcgtattttatgcctccagtgcttggatttgtataactctctcctgactggcctccctgctgtcaggccatccttgttttcggagtgacccctgtcaaatgctatgaggtcatgctactccctgacttaaactcccattgcctaacgcacacagatggagggggatgcagggtgatggaggctgggtttt

SEQ ID NO: 24346 - DNA, 1042 bp, Homo sapiens
ttgaaaacctatgtgcacacaaaactttgtatatgggtgtttatagcaatgttagttacgatagtcccaaaatggaaatgacccaagcatccatccgctaatgaatggatgagcagaacgtggtatgtatgtacaatggaatattactgagtcataaaaaggagtgaagtgctaatcaatggtatacacaaatgaacctcgcaaacatatgctaagagaaagaagccgggcataaaagcacaaatattgtaggattccattcccatgaattgtctagaatgacaaatccatagagacagaagggagatgaggaggtgccaggggctgggagaagagggaatggggaatgattgctatgggcttggggtttctttttggagggatgaaaatgttctgtaattagatagtggtgatggttgcaacagctctgtgaatgtactaaaaaccactgaattgtggactttacaagggtgcattttatggtatgtgaattacatctctgtttaaaaaagaagggagggaggagaaagaaaggatagaaggaaggaaaagaggaaggaagtgcgggggagggagggcgcctgtggcggcatgggggcctggtcgtgctgctgctcacagcccctgggatctccaagtgccttgtgcaccgctacccctcagggaggaccctgcttcccctggccaatgagcagccttcccatctaatctataggccccagaagctctaaaaataactgaagtggaagggggatgtttaatgacaaagtaaataattacattaagggtgcgagtttggaggggagctgagtaaatcaccgagaaagagcaccagcctccagctaacttccactcctttatcaccagattacatcctccttggaacctgaatcattgactgtggctggtggcaggctctgcagtggtgggggctgcggtcaggcaggtgctgagagagatgccctgtgagcatttcagggtgaccctgctggccccaactccaggtggatgagccccaggggcgggggccctgtgctgctgg

SEQ ID NO: 24347 - DNA, 1032 bp, Homo sapiens
gggaagtgcgtaatgtcagcttggcgaagtggcctcggtatgaagccacccccactgcctccgtggggtctctcccccagctcccagccccgcagtctggctgcgcttgtgccctgaaggagcaggccatgctcactgcccacctgtcaccccttccatcacatgcccatcatgacaggccccctcacttcaccccattggccccgctgatgagctcgctgtggaccatcgggggatctcctgcctcctcctcttacagtctcatcaccgctccgcctcagccctttccttccctggcttctaagctccccttgtgttctcctgcctgccccttttccctcaggtgaaggtcccaggctttgtcctgagtgctcttctcttgtcactggaaactcatcgcgggggcacctgggtagcaagaccctctcagctgtctctgcccagacccctatatctgtctcatcagctccaactgctcatccactggcctgcctggtgctggatgtcccaggctgtgtacacagtgcccctccccacccatcccacatcacctggccccgctccagactcctttgcgggcgtagcgtcctcacccactcgctcgtatggagcaaacctaagagacccggccggcctgagaaccatgtggcagggctgaggggatggatccgcacgggaccttctgaggacagcttcctgaggcctccatgtcctgccattacacatgaggcccagaagggtcccctggtttgcccagggcctcacatgggatttgatgggatcctgtttctaaaccccgtgctccactcttgcctgtgcttttccagggcccttggttcaagggccctgtggccctgtgcctgcatctggttgaggttcacagctgcctgaacactggggccttgcagagaggtggtgggaggagctggagagctccaaggagccccgctttcatccccgaggggtggcagtgcctcttccaagcctgcagggcaggggtgtggagggtgaagtctaacaccaggacagcca

SEQ ID NO: 24348 - DNA, 1087 bp, Homo sapiens
ccttccaggaaagctgccttgatgacagccctccctccatgtccccctcctggtgcttcctgcagacatcagatccctgtgggtgtcttctgacaagtcttacccctgcccctagggctaagccccaaggccaggagatgtttggataatctggccagggatcacaggagcgctccttcctgtggctgctggttcgcagatggccttgcacaagccttggctgctcagagctttgcactccagctgtggcccagcagtgtcccagggagggataggatgctgggtgagaacaccacaggcccttactgctgggcacgatgggaggctgcctggtgacggccgcctttgttatgacagagcagagcgttgggccgtggccaggctctgtccagagacagctgcgaggcttccaacccggctgggtggggtgggagggagctgtggctggcatgcatctgcatgcacccaacttagcaagttcagcatggaggagagagggagagaggggagaagctgagacagagaggggctgagtgcatgcagctgaagcagtgccctcgtcccagtctgaatgtgccagagccaggttgggcgtgagggtctgccgtcctgtttacatttactcgtgcctcctgtactgcaggctccagagctggagtttttattcagcttctgatgtttatatacacagttttcatgcacaggcccagaacccagccagccccctccctctgctgctgttcgatctgggaggcagtgtgcgtctccacacagaggagaccgctggactgcactctggaggaagtggggtcccctccgtgtgggaccttgcttgaggtgggcagaggtgctttggagtggtggagatttttatctcatgtatggtctttcgtgtctaatcttggcaaaagatgggattccctgcattgccgttttacagattagggacctgagtttcagagagcatgtactctgcgtcacacaggttggggaagtggctttgaacccaggcccatgggattccaatgcctatggcctcttgaccccaggcctttcgggaatgatttgagaagcaggcagttcagtc

SEQ ID NO: 24349 - DNA, 1073 bp, Homo sapiens
ggagaagattgccatctttgtcattttgagttttcccgcccatgatcacggcctttctccctatacttattggttattttatgtctttttgttttatcatttgtatcataagggtcttacacattttttgttacatttattcataagtattctgaagttttctttgctgctgtaaatgttatatatataaaatatacacacacatatatatatgtttaaaaattacagtttctagttcattattgctggcatctaggcatgtagttaaattttatatattgattgtatttctagcaatcttgctgatcttttactagttttaaatgtgtccctacaaattttatagacattttatttaatcttgtcatttacaaatggtgatagctttttcctttctttccaatttttctctctttagttattttcttgcctcttactgtgctgtctagattagcactgtctaataaaaatataatgtgaaccacatttaattttaaaatttctgatagccacattgtcttagtccactttgtgttgctataacagaatatcagactgggaaatttataaagaaaagtcatttacactcatgcaccccataacaatattttggacaatcatgaaccgcatataggacagtggtcccataagattataatcccatgtttttactgtaccttttctaggtttagacatgtttagatatacaaatccttaccattgtgttacagttgcctacaatattccctatagtaacctgctgtaggccagggtcaataggttccaggaagaacctatatcatatagcctgggtgtgtggtaggctatacatttagtgatgcacctagtgatgcatatctcagcacatatccctgtcattaagtggtgcaggactgtatttctcacagttctggaggctgggaagtccaaggttgaggaacctgcatctggcaagggccttcttgctgtgtcattccatcagcagtgagactgacccataaatttccattcttctccttatttagttgaattttcaactaaattaacctcataacatgtcctaaggaatgctt

SEQ ID NO: 24350 - DNA, 1029 bp, Homo sapiens
aaaaaaaaaaaacagacttctttgcttaaagttgatgagattgaaaccaaaaaaaattcaggagttactaaaggttatatggtgaaaaatctccctctcagccagccccctggttcccctccctggagacgaccaatgttccctgcctctcacatatcctttgcaagagattctagatgtatacacataaataaaacattatttgtttatatttatatatgtgtgcttacctataaatttacacacatacatacatatatatgttttttaatgcaattgtcagcatcttgttttttttgcatgacaatgtatcttggaaattggtccatatcagacctggagcgcttcttcatttgtttttatggctgtttggtattccattatgtggacagactgtaatttatttaacgagtctccctctgatggatatttagatttccaatcttccgctattttcaaacaatgccatgagaaatcatcttgccaaggtgcgtcccacatttgagagcatgtttgtgggatgcaggatgtagcttacagggagctcctggcatgccgatgtgagaaccgaccctccatagcaaggctgccccacatggcgtgggctggcctggcctctgagcttcctaagggctaaacctatagttacaagaattttcctaagcccctcagccacagatatataatgtgtagtttctgaatgagtgaatgaaaatacttacacttcagagaaattgtccttagcagaaggcataggacatagttttatttgttagacttacagaccatctgcctgtgaattcaaataatagttttcttgttgtttttgaaatgaatacattccatgagagctgcttactcagaccttcagtggcccagctggaagtctggttggggaatcattccctgggttgtacaagttggtgcaccagattaaagataaagtcatttatgatgacactaaaataatatgagcatcacatttggtagagactttgtttttgacgtaacccaagataagaccttatc

SEQ ID NO: 24351 - DNA, 1029 bp, Homo sapiens
gagaacgtgtggcatcttctgagagggaaagaggagctcaaggaagaggggaaaggtcattgcccttggaccttgcaggaagcaaggtgcaggggcgggcacatcgtattggaggtcatgagatttgggatcctctcagtgcactgggaaggacatgaccaggtggttgtgtggggacatggctctagctgctttctggagacaggactgggccaagagttctctattctgttccattggtctatgtgcctgtttttgtaccaatgcttttttggcagggaggtcacagaggagaccatttctgggcctggaattcctgagagtggcctggccccagtggggacagggaggggagagaagcaacctggggcacacttccctagccagtcctatgtttgtgagacctgggagggctgtggtcagggggctgggccctgggggcaacagtgcctttgcatttgaacacaaagtgccacttggtataatgggcacagctcagtcttggctgttcttgagttttaaacaaatcatgatccccaccttccaaacaatttagtttttttcccctagctagccccatcacaaacttttgaagcatgaaatgaattttgctggccctcaccaataggatcctttccctagataatggattttatgaaatggccataatcctcctaggtaatgagcaaaagctacactctccacttgggtccagcattcctcttcctgatttatgatagattggttaaaatagtaaactgatagcagttgcaaaatagtcatcaatcaccaggcagtgtcgcttaaactacagaaaggtttccagaagtgagatgctggaagccagagagagaacaatttggcaataccaaaggcataaagcaccaatgaaatcaaatctctgtatttgtattctgaagacagaggagtagagtggctcagggtactaaggaaggaaggaaatgcaagcaaacccgttccccaaggtcaaaggacaccccctcctgagctccaggctgcagggggccc

SEQ ID NO: 24352 - DNA, 1036 bp, Homo sapiens
gaaacactcagcatagtactagcccatggtaagggctcagatatgtcacttgttcaattactattcagtaggcttctctgaacgtgacaggctaaactcgaaacattaattagtcacttcatttgatggcaatagtaataaatgtgagtgacagacacgaaagaggctaccctcagtgtaccacccagggagagccagagttaagattttggaatatatgcttgcagtcttctgtgttgtatatagtgtgtgcacaattattcacacacacatacctgcctgctttttacaaaatgggattatattgtgcttgctacctcgtaacctttccacctgagaatggatactgtcattactgatgcctttccgttcaagtttttctgcagttgcagtctcaaactttttggtctcaggacccctttataccctcaaaaattattggtagcttcaaagagcttttgtttttgtagtgtgtatttattggtatttactgttctagaaattaaaactgagaaatttaaaagatattttaaacttatttaaacctaatagtaatagacccatttcatgttaatgaaaacaaccaatttttatggaaaatatttcccagaacaacaacaaaaatgtgaaagatggcattacttttcaatttgacagacctctttgctgtctggcctagtggaaggatgcattctcctagcttttccgccttgggtctgttgcatagcagcctctggacacccacagtgtctattcaagagagaagaagagtgaaaaacacaaataatgtattagtatagagatagttttgactttgcagaccccttgaggcagtcttggggatccccagggctctgcagtctacattttggtccgcttttgaatgcctacagaatgtttttgaccttcccacctgaggctgggctgggaacatccctccagcaaccacaggctccccgagcctcctcatctgaccgaacctgtgtccacagagcatctgagctctcctctctatcattgtgaaatggaccgacat

SEQ ID NO: 24353 - DNA, 1023 bp, Homo sapiens
tggtactagtggaggcacttagtggctgcagctgagtgttgggaagggctggagagtcagttgcagccaggtctggaggggctgtgtgcccagcttcagagcttgggttttgatcaggtttttgtgttagaatcctcattctggtggattggagggagccccagagtgaacatagagagacctcctagccaggcaggagataacctgagatcagtgcagtagttcctcacccgtgcgtggggaggcagcatgagcagttaggaggaggatggtgtccacagtggtcggatggcaccccagccaggccacggcgggctggacagcactctcaggtgacacgtggccacctgcctgcctctggctgcggccccaccacgggctggatgcctggatgaatctcaggctggagtcacttaacggctgggctgtcaccctgcagtaacccataattactacttaggagtttgtggacgaaaagcagtagattccaattgagtgtgttaaactctgcacgcgcctgttctaatgaggagcttgtaacctatgagagcccgtctgccgcgggaggcgggctcttgagccagagaagccagccagtcattttctccagcctctagctgagcctccacggccagccatatttcagcatttaggattttaagtgctggttaaaatgctcatatagggaagtgtgtatattttcatatttctgcacatcatgctagagacgagggtaggaataaatcggtgtggccagaggtgccgcttcaagctgctttattccctctctgtgcacagtgttaaactgggctgtgtctgacttcccaaccttcatcctgtagggggctgttactggggaaagaaagttgtcttaaaggaccctggagtgtgagggatggaaaagcgaaaggtttgtctctgcaaacaggtagtgctgagtggtcgccagcttagagcccgtcgtccagatgctttgttttctctctgttttacatgaatttccactgcacagccattggagtt

SEQ ID NO: 24354 - DNA, 1872 bp, Homo sapiens
aatgtctgcaaactgcggcctcagctcccgtacacagagcctccccatgaggacagactgccaccagacacacaggagagtgcagattgataaaagacatggactgcgcttcagtttgaggaagggacagttctccattgttttccaaaagaatttgctgtatggctcttaaaaaatgcaaatccccttagtacattttggaaaggacttgatttctagaactttttaaaacaaatgtatgggaaacatggtaagcaagcttgccagtgtacagtttcacctacaaaaccaaacaacaaaactcaaaccaacaaacgaaaaccctggggaggagattgaattccatccagaggagcgttctggagctctgtttctatttgtcggtagagccgagggtggcaggagctggccttgctctccagggaggccctgggagagcagacacatgcacgccctgtcctggcagtaagaagttccagtttggggaggaagagatgcagggcaagctttggggactccagcttcctttccagcaggtcagtgggcccagaggacgcctgcccagcatttctgaggaagtgggcacctggtcctgagcagctccgcaacagcaaaaaggtcccagtgtctccactctggagctccgtggacccacccatggccctgtgatcctggtgggtggtaggcatcttggcccaaaggcagggctggtgtacacaagccagcggttccgaggcaggaggaaatggcatgctggggctgtgtgctgggtggattctggctatggggagtcagtgaccatgaaatccaggcggcaggggggaaagcccgctccacagccctgtgcacatggggatgggaacgcaggactcagacaccttcctccacccagcacaggagttcccctaccctgccagcctgcctcaaagggagcatctactggaacctggttattccgagcaataaataggagccctgctaagagtttagtctcagaagaacgatggcactagtgacggtgatgtctgccacctccctagggccaactctaggccaatgcaacatgctttccatgacgagttcatttcctggggctgctgtaacacggtaccacgaactcagtggcttcaaacaatagaaatatgttctctcggtttcagaggtcagaagtccaaaatcagtatcactggaacaagatcgaggtgtcaccagggctgtgcaccctcagagacccccaggggagactctgtccttgcctttcccagcttctggtgctgccaactttccttggctcctggccatttccctgtagtctctgtctccctgtcgcatggccatctcatcttctgtgtctcagatcttactctgctgtctaaagaccccatgatggcatgtagggcccactcaggtaacccataatctcctcatctccaaatccttgtcttaatcacatctgtcaaatcccttttcccagtaagttcttgttcacaggttccggggatagaacatggacatatctctgggagatctcatgagccccccacgtgccttccctctgctcctcacaacagatttgtaagatcactgtcgtaactgttcagagacggcacatacgtgctcccaggcaggagtgagctgaggtgagccgggacccatgtcttctgcagtagtgtctgtgctcttccctggacacgctccctgctttattcattcattcattcactcattcgttcacgccctcactcattcattcattcattcgttcacgccctctttcattcattcattcattcattcattcactcattcgttcacaccctcactcactcattcattcattcgttcacaccctcactcactcattcattcatt

SEQ ID NO: 24355 - DNA, 1058 bp, Homo sapiens
tgtgacttattccacagtctccctcccattgagctcagtggctggcacacagacatgtggctgtcactgattctgaaggtacctctgagcacctgcatgacgccagttccatgccaagtgctgagcatgcagaagagcctcggacatgccctgctcccaggcagagcctgggaacctggcagatgcacctgtcagcttgagcctggaacagtgcacccttggggagcagagagaagggatcctgagccaagagaaggggcttcagggagggtgccacctgctgggctgacagggatgagaaggagtttgccaccacagtatagggtgcaggaaggcattggaggccaaggattggtgtaggcaaaaaggcagaagcaggttcgtgggatctacatgagcagggcagtcacgtctgctgaagctagacaaccaaactgcggaagactccctccaggcctggcacagcggcctcccaggggggtgtttgtgaaacccagatgtgaggacatctggatgtcacctgtttgggtcctggtttgtactgtactgtaagcccagttttcatgcactattgagcatgatcagtaattatctctggtttgctcagccaacagacaaatcatttcctccctgaaataaccagttccagcagtggcctttcacacgtccagcatcaatccagtgtgaagattgggagggcctcccgggcaatgctaggttagccctcaaagtgtggttctaaccctctaacagcagttctcctttcatgactgcctgccatgtctctggcacagttttggggactttcatcctcacgacaaccctatgaaacagacactattatgatccccattccacagatgaggaaactgaggctcggagaggttacagtgtgatgtggctgggattctaacccaggtttgtctgattctaacacactctcttttctttgcacaatgtcaaattatagactaaagaataaaaatgaaatcttggtaaatgtggttcctggtgacttagctgtggttttgcagctgcttcaccataaagtctgattc

SEQ ID NO: 24356 - DNA, 1035 bp, Homo sapiens
ttatgagtccaggactgaggttcggaaatcctgggttttttcaccccattactggatgacttggaacctgttcctttgcctccctgatcctgcctttcttcatcagagaaatcaggggtgctagtgctgtcagagggtacactgagctcgtacacttgctactagtactaaaaaccccactgccctgttcattgagaggcagcattgtgattacacgaggcacatgtgtccccagcttcttgtggcaggaccccccgtggccgtgtgcttaactgcatgaacaggtgcagacaagccaggctatggccaggctcctgcatggtgccatccacagagcactggctgcaaatttgacacagcacctactgacgttgccagctgggctctgctgaggggcgtgggtagcttcaggagaacagggagagcgccccttcagagttgatcctcgtacccctatccatgacacaggcctgcttctctccccagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccggggtaagcggagctgggcagcccagccacgcaaggcgactccatagccgtgcccagggccaccccttgccacggttgcgggctctgccctaaggcccccctctaggggcacagcgatatccctcctctctccaacttggctttcccccttcaccaccttgggcctcacatggaacctatcttgtccaggtcccattctgctctgaccaggctcctgctgggtgtgtggcagcacgctgggtgacagggatgccgccctgtacggtgggcctgcacagg

SEQ ID NO: 24357 - DNA, 1096 bp, Homo sapiens
ggcccagacgcagtccgagagtccagacgcatgccgactggaggaccaaagagattagcacgaagaaggatgatcttccacaaaaagagctatgtacagctataatggaaaatactcggtgaggagaaacgaaataaaaggcaatacagcgtagccaaacccgggttagctgcgggtggagttcaagagcgcgccgcggtcccgcccccgccagccccgccccggcgagaaaagcgtatgcaaattttcgagcggccgacgcgcggtcttctgggtaaaaccgagccgccgcttttgcgacccttcgggagcctcagaaaacaaagaattggggtgtcgtcgaaagctgtggaggctggaggtaagctagctaccagaccgactagggcgaggctcacgaattaattaccacaaccctaccaggtattggcgcttcctgcttgcagcccagggactttctattataaccatccttttcttggggttgcgctactgtccaatgagcgcatagtgagggcagtactgctaacgcctgaacaacacacccgcatcaactagagcttttgctttattttggtgcaatttttggaaaaatgaaaacctgttttcatagacttatcagttcaaacagcagtaattcgtaaataaactagtactttgtggttaaaccagtagagggtgcacaagacgcgtggttttagtgtcgcaagtaaagttctttcagtttttgcggtgattaaacgggaaggatttcaacagaacttcacccctttaactttacgccgatcatcaactgttctgtaacttccttatgctgagtcagcccagtagtctaggtcaagtttcaataggagacgaagtttcagtaggtctttgcacctcacataaaatgtaatccaggtcgggcgcggtggctcacgcctgcaatcccagcactttgggaggccgaggggggcggatcacgaggtcaggagatcgagaccatcctggctaacacagtgaaactccgtctctcctaaaaatacaaaaaattagccgggcgaggtggccggcgcctgtagtcccagctgctcgggaggctgaggcaggagaatgg

SEQ ID NO: 24358 - DNA, 1038 bp, Homo sapiens
agcctcccgagtagctggaattacaggcgtgcaccacccccccccaactactttttgtatttttttgtagagatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgcaaattatagggctgccttcaaggatcccgaaggacccacagatttgccgcatcaggctcctatgcacgccggtaatttgatgtgttgagatgcactgcccagtgcgttgtttttactggaggagcttgtgtgcggagctccttgctagtgtatgtgttgggatgggagagaagtgcgggagaactatgagataatgccccctgatcctcagggtcttaggaggtatggtcggagaggctaagctaaagtatgaaagccgtgtgtaggcccttctgtgtagtgcagaaaaggtagaggtatgtgatttgaaagagtagggatgacatggaggatgcgactcctggttggatctataaactaatgtctttggaacgaaagcacatgcaaccttttgaaaatggatgggtgataatgaaagaccattccagagaagaaacaccatggtgcaaaggctcaagaggcatactggaagtacaatgaagagagcaatctaactgaaatgggaaaaaaagaaacaaagagtaaaaagtaagatttgatgagaaagatggaatcgatttttaaatttttttatctacacaacaaaatttattatcttaaccatttttgagtgaataattcgttagtattaagtatatttacctcgtgcggccagtctccagaattcttttcatcttgcaaaacaaaccccgaacccattaaacaatttctcattcgccattttccagctagccttggtaacctccattctagttctgtctctgtgaatttgactgtgtaccccgtgtaagtggtatcatacagtatttgtatttttgtgactg

SEQ ID NO: 24359 - DNA, 1025 bp, Homo sapiens
ttccttcagactgcttttatgggctgtcattgagtgtctgcggcttttccaagtgcacagtacaagccatcaatggatctaccattgtggggtctggaggatggtggccctcttctcagctccactatgcagtaccccagtggggactctgtgtgggggctcccaccccacgttttcctttcacactgccctagcagaagttctccataagggccccaccactgtagcaaacttcttcctggacatccaagcatttccacgcattctctgaaatctagtcagaggttcccaaacctcagttcttgacttctgtgctctcacaggcttaacaccatgtggaagctgccaaggcttggggcgtgaaccttctgaagccgcagcccaagctctaccttggcctcttttaaccatggcttaagcagctgggacacagggcaccaagtctctaggcttcacaaatcagaggggccctgagcccagcccaaaaaaacattttttttttctcctaggccttctgagcctgtgattggaagggctaccacaaaggtctctgatatgccctggaaacattttcccattgtcttggagattaacacttggctgcttgttactcatgttaatttctgcagcaggcttggatttctccccagaaaatggggttttcttttctatcacatcatcaggctgcaaattttctgaacttttatgttgtgtttcccttttaaaactgaatgcttttaacagcactgaagtcacctcttgaattatttgctgcttagaaatttcttcatccagataccgtaaatcatctccctcaagttcaaagtttcataaatctctaggataggggcaaaatgccaccagtctctttgccaaaacatagcacgagtcaccttcactccagttccgaacaagttcctcatctccatctgagaccaccacagcctggatttcattgtccatgtcattatcagcattttggtcaaagccatccaacaagtctgtaggaaattccaaactttccc

SEQ ID NO: 24360 - DNA, 1050 bp, Homo sapiens
agtatatggttaacaagataaagatgtgcagatgagccggggaagtggctgatgcctgtactcctaacactttgggaggacaaggcgggcggttcacttgaggtcaagagttcgaaaccagcctggccaacatggggaaccctcatctctactaaaaatacaaaaaattagcctggtgtggtggtggacgcctgtaatcccagctacttgggggctgagacaggagaatcgcttgaacctgggaggtggagtttgcagtgagccgagattgtgccattgcactccagtccagcctgggcaacagagcaagactccatctaaaaaaaaaaaaagtgcagatgagagcagcaattaaccaaaagtcaatagaaactgctgaaagaaaacacctcaaagagttgctgagagctaaattagctgaatgtggctggaattgtaaaagtaatcagaaagaaaggactggagcacattactgttgatgacttggtggttgaaattactccaaaaggcagagccctggtacctgacagtgtaaagaaggagctcctggccaggcgcagtggctcatgcctgtaacgtccgcactttgggaggccgagttacgtggatggcttgagcccagcagatcaagaccagcctgagcagcatggcaaaaccttgtctctatgaaaaaaaaaaaaattagcttgacatggtggcacaagcctacagtcccatctacttgggaggctgagatagcaggatcacttgagcccaagagtttgaggctgcagtgagctatgatcactgcactcagcctgggtgatagggcaagaccctgtctcaaaaaaacacacatgtaaaacaaaaaaggcaactgtggttttgactgctgctagttagtttccagagtgtcagaggccaagtacaggccaagcatcattagaaacagggtcatcttgctggtccaagtgcagtggtgtttacaaccaattgatcacagccagttacagatttatttgttccttctccacttccactgcatctcttgactagccaaaaaaagaaaaa

SEQ ID NO: 24361 - DNA, 1476 bp, Homo sapiens
ggtacggtggctcatgcctgtaaatcccagctctttgggaggctgaggtgggtggattgcttgagtccaggaatttgagaccagcctgggcaacatggggaaaccccgtctctccagaaaaaaatagctgagtgtggtggttcgtgcctatagtcccagctacttgggaggctgaccgggaggatcacttgagcccaggaggcggaggttgcagtgagcccagatcacgccattgcagtccagcctgggcagcagagcaagactccgtctcaaaaaaaaaaaaaaagggaaagaagttatcttacgattaaaatgggtagaatttttcataaaacaatagttgtcttaaaattagtgaaacatagtaatttcatgagaaattttgtattccaagtgtgctttttagctagtgtttgtaaataaatataatgagatacctgtctgtataggtagggcttaaatgcttatggatggaaggttatttgattgtatctcaagtgatgtagaggtggaactagcagagactttccaaaggataaatgtgggtagattgagcagcaagcacttggtaagtcttagtgtttgaacgtgctagaaatttggactgtcacatcactccaatcagccttgtggtctgtcttcttcatcttcaatttatatatatatatttttttgagagtttttgagacaaggcctgtctctgttgttcaggctagagtgtagtggtgtgatctcagctccctgtaacctctgcctcctggactcaagccatcctcccacctaggcctccctagtagctgggactacaggtgtgagccactacccctggcttatttttgtatgttttatagagatgggctttcaccatcttggccaggctggtctggaactcctgagctcaagtgatctacctgccttggcctcccaaagtggtggaattacaggtgtgagccaccatgcctggcctctagaattttgtattctaacattttccccttaattcctagaaaaatgtggatgaagaattttgccatgttgattgtgtgaacgaatggttgcacctcttaaggaaaaagcctcatttgatactgctaaaaggaccagtgggagggggcatgtggcagccggtcttggctagctcaggagcctagcagactttctgctaaatagacttccttccatcgcctctctctgcctttctttctcagcatagaagtggcaaaacaaagacaaaaccattgtatgtatttcatggtgataactaacttgataaatgggtcaagcttgtcaaatgtcagaactttatttgatacagcatagttgtaaaagtgaagtggctcttttttaagagttcttattatgggggaaaaaagcccaacaaagcaaataacaaacaaaaaagcagtgactgaagatattttgagactgcctgagctggactgcctgagctggactctaaaaactaaagtttttctt

SEQ ID NO: 24362 - DNA, 1031 bp, Homo sapiens
tctcaccacactggtgagtgtgtcaccttgcccctctctgcttatcttgtgaatgtgcctttaattaattaatttagtgtttatttgcacatcctgatgtatctgtcttaggacttgttttcttagactataagctatgccaagcttggtgtggtgtctatgtcagttactagaaagcctagaaaaatactactttcaaggaggcattgagaaatttaatatattatgataatgggtattttcagaaacctatttttagagaagctgtgcattaccaggaaatgtttcttatttttcccatatttctgtgtctagctgtggagtagagtgagattgtacaccccagtgttcacaagtaatgggaaagtcttcctttggctaggtaagctgagatccagatctgtagtttgctttaagacagtgaaagatcaccactgcattagtattatggctcagaggagaagataagcaattgacatgaatcattcaattactacatgcatttcctcgtaggggttttagactcttgaatgaagggaaatttagactggccattattttagtaggataaagtcgaaaaaaattaagatggcattaagttcttggatctgattttgttagatcagtgctaattttaaactaagtttggtgatcttgaaaatttggatttaagagtgttaaaagattacaacatgctgcctttattctcagaaatttttctacggttcatattttactgtgggagaactttaggcaaaacatattttttgttctttgtaaggcctttcagaaaataagtaagcagaactagtactagaatcatcagttcctaattcttcttccactactcatagtatttttgtcaatggggtttcataagctttctttatattgagacttcccttttatgtttttattattccaggtttcttaagaaatagctattaagtgaaaaaattcataggctaagttattaataactaataagataggacttgattatcattaaaaatatatatattatacataaa

SEQ ID NO: 24363 - DNA, 1915 bp, Homo sapiens
gaaaacaaacaaaaaataaaacaggtcagtaaacactgcaggtatagccgaagtctcctttgttcctttctttctttctttttttctttttttttttaagagacaaggtcttgctgtgttgcacaggctgacctggaactcctgggctcaagtgatcctcctgccttggcctcctcagtggctgggattacaggcgtgagccaccacacctggcctgaaaagtctcctttgttaaccactctcagtctccttatctacctcatagggaatcactattctagcaatttttctataaattttatgagttttaaactagcttctaattttctattttttttaaagaggaataattatacttcattttttccccctatgtcgtagaaaatttcctagggttgggagaggaaaaccatgaagataaagttggtttacttcttcttatgctccgggaaagaaaaaataatgaaaaggactgatttttatgtttcttttagagatctgcaccccgacctggagggacagttgaaagaactcagaaagcatcttgtagagagcaccaatgaaatggcacctttaaaggtttggcagttgcaaggtaatgaaaacagggagaggtcattggcctactttttggctaagttttatggctttaaaaaatgcaaaatttgaatttaattgtatgtagtacgtgattctgaaggtgcctcagattttaaagataagagtgattaattacgattaatcagggaagaaaggaagtccttttgtaaacagataacactaggtagaagtaatatatataaacaaatggcaagtctttctgtgtgaccatacataaacttgtaatacgagaagcaggtcatagtcctaagttcctatatatatacatttcttcaactgtttatctatagagtgtttaagacatgtcattgtggcaggatgtatgtgtttttctctgttccaaagaactatttttcaagtttttttccccaacgtcatttactaaaagtcttcatgctgtattttgtgatgtattgtaaatttagaaaagggaaaaggacttgggcctgatttagcctgtgctacatgcgttagtgtagcgttagtgtgtgccctagtgttttctgcagatatatcagaaacggctcaactgaatactccagagatctttgaagtgaataaaacctgaaattaaatcatgggcactctctggaatggttgcattcgaagatattcttaattaccatgaaaagagtgggaagtaaatttggattttgttttctgcttctcattgcattagattaatccacttttaattatatttgacattgttgcagatctcagtttccagactgctgctcgaatcttggcttctcctgttgagttggctttggttgtcatgaaggatcttagtcagaattttcctaccaaagccaggtaatgtagaataatgctcttctccttaacatcatacccagtcatcgtcatgttcacttgccaaatgaggtaataacaatatgaaaattcctagaaaattaagattctttttttttttttttttgagatggagtctcactcttgttgccgaggctagagtgcagtggtgcaatctcggcttaccacaacctccgcctcccaggttcaagcgattctcctgcctcagcctcccaagtagctggtactacagacgtgcgtcaccatgcccagctaagtttttgtatttttagtagagacagggtttcactgtgttggccaggctagtcttgaatgcctgacctcaagtgatctgcccgccttggcctcccaaagtgctgagattacaggcgtgagccaccacgcctggcgaaaattaagattctttatgaccaccaccactactattgcagatggtgctctgtgtcttgaagatggcaag

SEQ ID NO: 24364 - DNA, 1050 bp, Homo sapiens
agtcatttcaaaatttgaaacaaggcatcgcctcttggaattttagtttccattgtggctgttgagaaatctgaagcctttgtatgagatctcttaaggatcttttctttgactctagctatctgaaatttcataattatgtgtgtttttaaaaaaatctctgtactgttaggtggttcgtgggcccttaaaatcttgaaaatcatttcctttagctttgggaaattttcttaaattctttgtttgtgtttcttctctctggtttctctttcctcttttcctagaaatatgtatttatttattttttaaatgttgcacctctgactagtttggccttttaaaagtctcttctttcctattcttttctctttttcaaaaaaaaaaaacactttctggtaagagtttttaacctgtgtgtatcttttttcctttagttgtcaaatatttaattttcaggggttttttttgttctttttatggtgttcccgtgtatctctgaagataatggtgcttgtgttttctgtctgcaaagtctgtttcctcttaagctgcgtttttgggttttggtcttttcagtggtggaggccttccttaggtgtctggtgatcacactcagagtgaggcactaaggacctggttggaagtcctaatgatgtggctttgtgactgtaaggtgttctgttgtgaccatttcctagggaaccccagttacagtatctttgttccttttcttttgggttggtcagtccttgtcagtctccagaaaaggatccgtcagtcttctggctggtgggtgaaatctgtttgctagagctgtagaagcacagtagggaagagcgtttggtgacttgccttcgattccccattatgtgtgtggggtccctgtcctccttgtgcttgatttgccattgtccacagatgttctgttttgttcttttccagggaatgagccttcattttgctggagtagggggtagcaccgacctcaggcacctggctgtgggaaatcagttggggggctggggggttttgtcttaaagggctttatat

SEQ ID NO: 24365 - DNA, 1033 bp, Homo sapiens
ttgaactcctgacctcaagtgatccaccctcctgaacctcccaaagtgctaggattacaggcgtgagccactgcacccggccaatgtagataaattttgtataaacatttgtaaagaattagtttcagaaaattacaaattagtatgattaaaaatgacaatatgttacccacatgttcaaaggctgtttttcattttacatgctaacagatgcccagaccagtgcattaatcagtagaattaatcagtgcatgttcctagtctgtaactaaactctgtggaagattcccctgctttcctatagtaaaggtttacgactttttcttctatctttattaagcttgtcattttcttctttttgcatggttcttacaaattatttggtcaatttcattttcagaatgttgaaacacagaatgtgcttctctcctctgactcaattagctgtttttgtttttctacagatgattcttttattaggccagtaactttttggattgttggggattttgatagcccttctggacggcagttactgtatgatgccatcaaacatcaggcaagtatctatgacttcattttatatttttgtttgtggctgtagttgtcttcatgggcttcgctgtgcggctaggattgttcagtgggagttgggagtcctgctttcttaatgctcgagggaacggagaattgtatctctagagatctgccagctctcaagaaaagagatctaagactacagtatccaggctttgttgaacgggatagattcttatagagaaaaaaataaatagcgagatcctcatcatagacaagttttattgcatacctgttcatgttcttggagcagagttgctccaacaattgtgttgtgtactgtatcggggagatggggtccttaccacgacagaggtctggacatgggggcagtagcacacaggaatggtagtgtgtgtgtttagtagaagtagatccagatgcactgagggatacacacataggtgttctgaaaagatatgctgccattaatagt

SEQ ID NO: 24366 - DNA, 1021 bp, Homo sapiens
tactttgtgcagctacatctcacacttatatttggcatagatgagtattttccactcgattgatccaaaagaggttcatgtctcctagtggggaagttacttctgctccatactttgtgactctcattgcctgtacctgctctttggaaatttgactgctccctgctcagtttacttcccgttgtgtaagttgcattctggtgcagcctgtgttcagtctcttcctaaaacaacactgtcggagagtgaacattctttttgtaggttggttttgtcagtcttgtggtctctccagggtgtgagggaagcttcataaccactcctgctgcagctcacccgctagggaaggatgggaagcgcagtctctttcctcttactttcaaaggccgtgtgtctgtatgagtgtttcaagtggtcttttttttacccttattgttataggggctttacaggacagaagactgaggaagtgaagcaagataaagatgacataattaatattttctccgttgcatctggtcatctctacgaaagatttcttcggtcagtcttgttgattatttcattatatatgatgaatgaattggtcagtgttcttatttagagaggaaaggttttgtgggattctgctcattatactcctgtgtctttgaagcactctgagcattgtgactggcttgccatttatcattggatttgttttgatcccgccgtctctgtgaagttgaactatgtagtgagtgcttctggatattacaaggctgcagccctttaacgtcactgtacacattcatagactgtactgtttactgcctgccaaacattgcttaacccagagattaggaggttgacatagagaatagaatcagaacagaaccatggaatacttcactgccttgtaaagattcacaggattttagagccaggagagagcttagttcttacatgtgaacacttctgttttataaacaggctgaggccccgagtgtgaagggacttgtctaaggtcacacagctacag

SEQ ID NO: 24367 - DNA, 1054 bp, Homo sapiens
tgaaaaacagcgtatcatctggggttacaagatcctcttcctggatgtacttttcccactagttgttgacaagttcctgtttgtggatgctgatcaggtaggcccttaaaggccaagttttgacagtttgtattaaaagcaacaaattgcttctttttaaatgctattttttccacttatggaaaaggacatgcttattttacatttagaaaatatgaaaatatgtatcacatagatgtcatcactttttaaatttgcatttagcttatctcctttacatctttttctctgtctttttaacatcattgtgatgacataatgtgtgcagttttgtatctgacttaattcatttaacatgaaaactaaaaattagaaaattaacatttagcagtgcttgccatcatctctaattatctgcccaaaagataggagttattgtcatgggtaatagacgaagcttaagtggatacatggctttggcagtagggaacctccggatattcttccggccgtcagggtttgacttagtgaaagggaacatgtgattttagagcatacaaactcaaacagcataagtgtacgtctgcccacagccttccacttcagcccgagcgggcggaaacccaagtcagccacctgagtggaaggatgtaatgtgtgtgaaagtcactgggacagagacttcactcacctctttggaattctcttccactggcttagcctgaagtgtgccttcctgattgtaacatagccacatttaatccttgttgagtacttacgatgggcaaggcattattctacatctgtccatccatatgttaacttacataatcctcccagcaaccctgtgagataggtactgtcattatcattatctccattttacagatgaagaaactgaggcacagaaaggctaagcagttgaaatttgttttattcctactcccacacaccttgctaagaagtgtcttacatgttagtgagtcaaccaggtaataagtggagcaatcaaagtgcatctgcccctagtgcctgtgccactaaccacggagca

SEQ ID NO: 24368 - DNA, 1030 bp, Homo sapiens
gtggaggttgcagtgagccgagatcatgccactgcactccagcctggcaatagagcgagactccgtctcaaaaaaaaaaaaaaaaaaaaaaaaaaaattaaaacagtttccataaatggagcttaatttgctctgctgtccttaagccctcgtgggtttttttttaagagagtctcattctgtcacccaggctggagtgcagtggtgcgatcttggctcacttcaacctctgcctcccaagttcaaacaattctcctgcctcagcctcctgagtagctgggattacaggcgcctgccaccatgcctggttaatttttgtatttttagtagagatggggttttaccatgttggttggccaggctgatctcaaactcctgacctcaggtggtgatctgcccacctcggcctcccaaagtgctgggattacaggcgtgagccactatgtccggtcaagccctcgtgttctgaaccttgtcaaggctctgcctgaatgagttttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgccctccggaagtatatttagatacttgaaagcagtccttttctaaaatggccttacctatgtggcctgaacgattaaaagaaagaactcagagttacaagggaaaaagaaaaagagttacaagggaattgtagtctttttctgaatagaatattagtactgtggtattgcatttcatgggaatggaaatgtattggtaaagctacctgatggaagctttctcttggtaacaaaaatggagggtgtattatgtgcagttatttaaatatatgtattccattgttgcgtggtttttttcccccctcaagacagagatttgctcttgttgccca

SEQ ID NO: 24369 - DNA, 1099 bp, Homo sapiens
agtgggaacatatgacgtgatcaagaaaaaaaatcaggctgggtgcggtggtgcacacctgtaaccccaggactttgggaagccgaggcggttggattgttggagcccaggagtttgagaccagcctcggcaacatggtgaaaccccatctctacaaaaaatacaaaaaattagccaggcatggtggtatgtgcctgtagtcccagctactcagaaggctgcggtgggaagatcatttgagcctgggaggttgaggctgtggtgagctgtgatagtgccattgcactccagcctgggtgacagagtgagaccctgtctcaaaaaaacaaaatcaaaacaacccataaaccaaggtgttgaaatcattcaataaaaatgttaaaataattataaacgtttttctcagacataagtggatgcttttttattgccttttgatacgtcctgagtttgtgtgtgtgtgtaggtatatgtgtatatatatatttattaatttaattgacaaagattgtgtatattccaggtgtcccgtgtgatgatttgctacacatgtgcattgtgtgattatcaccactgaattaggacacccatccccacctgtgctgcacattagatccccagaacttatctttttttctttttttgagacggagcctcggtctgtcgcccaggctgaagtgcagtggtgtgatcttagctcactgcaaccgccgcctcccagattcaagcaattctcctgcctcagcctcctgagtagcagggattataggcgtgcgccaccatgcccggctaatttttgtatttttagtagagacggggtttcaccatgttgttcaggctggtctcaaattcctgacctcatgatccgcccgccttggcctcccaaagtgctagggttagaggcgtgagcccccacacctggcctatcgcgcaggcttaagtgcaatgttgcgatctggcctcactgcaacctccacttcctgggttcaagcaattctcctgcctcagcctcctgagtagctgggattacaggcaactgccactgcacctggctaatttttgtatttttattagagatggagtttcaccatgttggtca

SEQ ID NO: 24370 - DNA, 1163 bp, Homo sapiens
accagcctggccaacattgtgaaaccctgtctctactaaaaatacaaaaattagccgggtgtggtggcaggaacctgtaatctcagctactcgggaggctgaggcaggacaatcgcttgaacccggcaggcagaggttgcaatgagccgagatcatgccattgcactgcgcctgggtgaccgaggaagactgtctcaaaaaaaaaaaagaagttggaataaaaacattttggggtaactgaatgctgacagcattcattgtaggagacaagtactacaaaattgctttaaaaaaaaaggctcccaggggggtggccccaagagttggggttcagtgtcctccaagccctggtcctctccaataggcctgggatctgccccacctgacccgttctcccgaccctgaggttggcttcaatgctaaggaagcccacaatattgtcaaagagtgtgtgctggtgaagattataatcacatcatcaaccaagcatagtggaacaatccttaacacatctggttaagttgggaaaagcttatacatatattgtgacctgtgcagtggtccagaagagcgcatatggctttcatacagccagctcctgtttttgggataccacatctgatggaacctgtaccataagatgggagaactggaccatgaaccgtattgtcaacgtttttgccattgctagtgttctttaacttactaaaaatgttgggctaaagccattaacttaaagaatttgtcagtgtatcttttcaaaaaatgagtaatatttattagtgtgctagatgacaagcgtgcattatataagcaaaatgctgtaatcccagcactctgggaggccgagacgggcggatcacaaggtcaggagatcgagaccatcctggctaacatggtgaaaccccgtctgtactaaaaaatacaaaaaaattaacttggcctggtggcgggcgcctgtagtcccagctacttgggaggctgaggcaggagaatggcgtgaacccaggaggtggagcttgcagtgagccgagatcgcgccactgcactccagcctgggccacagagcaagactccgtctcaaaaaaaaaaaaaaaaaaaaaaagtaagcaaaatgaaaagcacttagtgctttctgacagaattatagatgtaattttaag

SEQ ID NO: 24371 - DNA, 1114 bp, Homo sapiens
acctatttcccgtgcccaaagatgacagccaccgggtcatcaccttcgcaaaccaggacgactacatatcattccggtgggtccacgggccatgccccaggaaagcatccccaccctgtgtacctcgtgctgcttgccgttgacccacagctgttccctcccaggcaccatgtgtataagaagacagaccaccgcaacgtggagctcactgaggtcgggccccgctttgagctgaagcgtgagtttgaggctgaatcccgtgtctggggtggggaggggaggctggctgtgccggggctgatgccatccctgcctgcagtgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggccccgcctgcctctgagtggtcaggccaagtctgcagggcaaagcccatgggatccctttgggtggggacctgatggctgtgggacgtgcttgggcctggagtcagtgtgggggttaacagagagagagatttgatgctaacgtcccctcaagagtgagggtcatatgagctcttcagcaggcagatgtgggtagcagggccagcctgtgtcaggggcagcccaccaagttaactcactgagtggaagccgccagtgtgccaacgcggaggggacaggccacacccagtgctcagcagctgattcctcatgtaagtggcatcatgtggtatttgttttgtgtctggcttatttctattaacataatgttctccaggttcctccatgttattgcaaatgataggatttctttccttgtaaaaaataacatgccacattttcttaccaatccgtccaccaatagacacttaggtcgttttcatagtttggcagttgtggaaatgctgcagtaaacatgggagtatagct

SEQ ID NO: 24372 - DNA, 1010 bp, Homo sapiens
gctcatgcctgtaatcccagcactttgggaggccaaggtaggtgtatcacttgaggtcaggagttcgagaccagcccggccaacctggtgaaaccctgtctctactaaaaatacaaaaaaaggttggacatggtggtgtgtgtctgtaatcccagctactcaggagcctgaggcaggagaatcgcttgaacctgggagttgcaggttgcagtgagccgagattgagccactgcacgccaagcctgggtgacagagcaagggtctcaaaaaaaaatttttttttctcttcttcattctttttcagtaatttgatcatgatctgccttggcgtgactttctttaggtttaggtttattctccctctggttcattgactttcttggatttgtgggttcatagtttcatcgaatttgggaaaattttcacctattatttctttacataaagtttctgttatccccctttctcctttccttctggactccacgtgcacatacactagactggtatatttctacagagaactgattctttttcatttttttcatttcattttgaattatttatattgctatgttttcatgtctattgatcctttcttctagtgtctaccctgctattagtggatttttcatttcatatattttatttttcctctttataaattccattcaggttattttttgtatctttcattccactctgcatcatgttcatgttttccttttcatctttgagtgtatttgtaatagccattttaagatttttgcttctttcctgaactgttatttctgggccctttcctattgactaatttttctcctggttatgggtcacactttcctgcttctttgtatgtccagcaaaattttattggatgcttgatattttgaattttgcacaggtaagtgttggattgttttctttagagtgttttgccttttcaggaacttttggatggttgatcaagtagcctttgttctagaattaatttagccgtacttctaatg

SEQ ID NO: 24373 - DNA, 1035 bp, Homo sapiens
taccagaacatcaaagaggtacagaggctcctttcccactctcctgtccaccatcagcaccctcagagaccaggaccccgagcagggtccagcccccgggactactgggagcaggcactgactatgacatccacctgtgccctcctccaggcatccttatcaggctctcccatcttaagctttctcccagagccccttgagaggcctggccagcttcctccctcaggagcctcccctcctgtttttcttcagaattgtgccccactctacgacgatgccctcttcctccggactccccaggcacttctcgccataccccgcccaccaggaggggtcctcaggtacccggctccatccccggattcttccctgcccaatttctcaggctaaccccttcttcatccttggaacaccagtccgttccttgttcacttcgccaagtgttcgctggccctttcttcgaattgagctctgggaacccaccccaagatgattcaattatcccaagatgattcatttaccccttgcctctgcctctaaggcttgccctgccttctgagttaggcctttcctggatcctctaatcaaaccttaattcaggtggctcacccctgtaatcccagcacttcgggaggccaaggagggcggatcacttgagcccagctggagaccagcctggttaacatggtgaaaccctgtctctactaaaaatacaaaaattagccaggcgtgctggtgagagcctgtaatcccagctactccggaggctgaggcaggagagtcgcttgagcccgggaggtggaggttgcagtaagccgagatcgcaccacggcagtccagcctgggcgacagagcgagatcctgtctcaaaaaaacaacaaaaaaaattcagcaaataattctagacgccgccttcttgtcaggccgcacgttgggtgctgcggacatgggattgagccgccttcgcagcggagacttaaggcccttgtccttgcggccatcccttcctgtcttctatgccacttccgcattctt

SEQ ID NO: 24374 - DNA, 1074 bp, Homo sapiens
tgatgagtaaaagtactgggagactcatgttgaaactcgcttttcttttctcccaggctgcaaatttgctagatgaacaatcattttgtgaactgctgagaccccagctgggactactgaaaagccaagaaaagtagtgactcctacaagaaatctgttttattcccctcgagagaccattgcttttaaaataccccagaaaagaaagtgtagcagcaagacagagagggagagcaagggaaagagatgccttgccttttaagacatatactatgctattcacggatcaaattatgtgatgtctgggacttgtttaaaatagcagagaactgaaagaaatcaaagaggatctaaatatggagagagattctgtgttcatggatgggagggctcaacagagtaaagatttcagttgtctccgagttgatacataggtttaatgtaattcctatcaaaatctcagcaggatttttttctagctatagacaagattattctaaaatttatatggaaaggcaaaggaacaggaatagctaaaacaggaggccaggggaggaaacaaaaaagaatagctaaaacatttctgaaaagaggaattaagtaagatgaaccactctaccaaatttcaagaattattttatacccacagaaaacaagactatttggtatgagaggtggatgaacacattgatcaatgggacagaatagaaaatccagaaatagtgccaaacaagtacagccaaccagttgtttaaacaattgtggtataatccacatgccattgttattttcatattttgttattcttgttgtttttgtaatgaccatactaaggatgaactggcataccgctgtgatttttatttgcatttccctaatgattagtgatgtcgtatgtccttatttatatgctattgaccattcgtatgtcttctttgaagaaatgtctattcaaatcctttgcctatttttgagttgggctagtttttgagttttttgtttgttttgttttttgagttgtgggagtttttcaaaaatgtattctggatgttattcccttatcagatatatgat

SEQ ID NO: 24375 - DNA, 1681 bp, Homo sapiens
gccctgggacggaccccatgctgtccccaacagctggggtggcactctgccctgggcacccatgaccctctgctgtctctccctgttcagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgctagcccgttttctgtgggtgtgcgtgcattttcctgtggccagcagcctctaaaggtggggtgggggctcacctgtcgcagatcacaccctcggggatttagtggagatgataggctgaggcggggctggctgcagttgttcgcctaaggcgagcagggccaggccatgctggttgctgatggggaatacaggtagctctgccctcccttgcactcaagacccagaaaccagtgcttccctgtgtttgtttgactggagctggcccacgtgagtttggtgggtgagtagtcagtaatctttctgggcctcagcatccctggtgaaatgaggaagaacgtgtcttcccagggtcttctgaccctggc

SEQ ID NO: 24376 - DNA, 1049 bp, Homo sapiens
ttttgctgccttgtaaaactcttcaatccaccagtgagtcaaaaacttgtaggaaatttgtcagttactttttttcctcccctgtagtactcggtcctgctccagtctggactgtttttttttttttttttcctccccagtccttctgcacagctgcctttctgggaatttcctcccctgccagttgaagaccgaatcctactctgtcgcccaggctggagtgcagtgacatgatcattcatggcttactgtgcttctaccttctgggctcaagcgatcttcctacctcagtctcccgagtaggtgggactacaggcgtgcaccactatgtgcagctaacttcttatttttttgttgagaatgtctcactgtgttgctgggttggtctcaaactcctgggctgaagcgattctcccaccttggcttcccaaagtgttgggattatgctcaagagccaccatgcctggccttgattaatgatttgactgggtgtggaattctggcttggaaataattttccgttagcattttgaaggtattgctctagatgtcctgtgtcttgctgattgttgatcctttatatatgcttttttctttgggaagtttttaggttctcttctttgtccttgatgttatgaaatttcagtcatcctacctatggagaatcttttaaaattcatcatgctggacagtcattggatcttttgaatctagaaatgtgttatcctgttgcaggaaatggttttatagtattatttctctgctcttttctctgtggtttatttatgaaattctcctataagcagaatttttttttttgagacggagtctcgctgtgatgcccaggctggaatgcagtggtgggatctcagctcactgcaacctccgtctcccgggttcaagtgattctcctgcctcagcctgctcagtagctgggactacaagtgcgtgccaccatgcctggctaatttttgtatttttagtagagatggggtttcaccatactggccaggctcgtcttgaactcctgaccccaagtgatctaccca

SEQ ID NO: 24377 - DNA, 1034 bp, Homo sapiens
gaggtggaggctgcagcgagcggagatcattgcactccagcctgggcgatggcacaaacaaagaaacaaacaaacccattagaaatgtaaagaaattgaccacagaagttcaggagactcctgttactccacgtttttatattcactgtgtcctgtaaccgcctgcgaagttgcatggctgtgtttcagtcaggttttgtatttgtcatgactacgtagttctcagtaccttttctagtaatttttagcctgttctcatttttttttgtatgaaatatactgggaattcacattatggatgcaggaagctgtagtatgaatataaatatctaggatttgacgtgaatgcgtacgtgctttgccctctcatttttttgtgttctgggttaataaccccactgcacagatgtgatactgtctacaacattccttcctttttgtttcgcctgtttcttctgctgtactaagctacatgagagtagcattttggcttggtcactgctgtatccttagtgtctaggacaaggctggacacaagtaaggtgttctaagaatatttaatgaaaatatgatgctggtagttctctgcttcaaatccttttggaagtaaaatgattgttttaggatattttaggctgtaagttgcaggaaaccaaattcaaccatcttaagtgataaacccatcatgctgcttagtagaaagtcttgggtaagggtgggtttgggggttggtgaagtaagtggctcagcagtgtgagctctgctgtctctgcgtcagctgcccccagccggttcctcatggtcagaaggtggctgccagcacagtgagcagcagtgtgcttccctgttaacatcatcttagagacagggagactggcttttgtttgctggggattgtatgtttgagaacctaaatgtggtagagaaagattggggaaaaatgaaaaacatttcgtttcttggtaaggacagatagcatgaattgaaaaaaactgcaaagagagcaagaagcttcagcgtgcatgattttggag

SEQ ID NO: 24378 - DNA, 1027 bp, Homo sapiens
gatggtaatttgtaaaagtaaccttcctttatttagtttttcctgtagtatcttagttgccatagaaactgtgtctgcctttttctcattcacattttgaccatttatgtaatattagttaaattaggcaattataataagtgtgacctggaagcatccacagctgactctggcaaggactgagctcaatgcaggagcagagctcagcaggagccacaagagagtggcctggtcctgcagccaggggacctcagcatgacttgcaggggcatcagaatgtagattttccatgggaccttttcattaggtcagctcacaagttctattgtgttacatttggctagttggagttaacattactgagcattttaaaatgtcagggctgtgaaagtaaatgccgtaattccctagttttgaaatttaaacattgcaaaaataatcacttgcttccagtactgttacctgtaccagatcagcccttagatttacgatggtttcattgtactactctgtgccttttgagttttgtcattcatcatcctctgttgtatttgaggcattagtgggtataaatgcatactgtagccagagtgcctgggtttgtgtgcccttactgtccttaactgctgtgtgcctcagtttgcccatctgcaaaatagggataaaagtgcactcagttgagtaagagcattccaatgtatgtagtgctgtaagtggctggaaatgttcacctttgttaccactgcgggtttcacttctgctcttcatccacatgtgcacatcactagtgactagttttttttcttttctttttttgtgtgtttgagacagagttgcactctgttgcccagactggattgcagtgacaggatctcaactcactgcagcccccgcctcccaggttcaagcaattttcatgcctcagtatgggattacaggcatgcgccactacccctggctaatttttttttggtaattttttaagagacagggtttcactgtgttggccaggctggtctaaaacttc

SEQ ID NO: 24379 - DNA, 1050 bp, Homo sapiens
tcttggtttcctcccagtgtgcggtttcagggatgtcggccacatgatgtgcctgttgtggaggagggctgggtcgccagtgtgacaggagacagcagatcccttttgtgaaaggagaactggtactttgcgtgatgttaaacttcacaaaccgctgctcagaaatctgctattttccttctcttttaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcc

SEQ ID NO: 24380 - DNA, 1034 bp, Homo sapiens
agaaaataggtgttggagagtcgcgacgaagtggactctaggtgcatggcacgcagagacctgtgacgggggagggtggccatggcagggtcagagaacaggggtgtgggagacacctcttgggagttctcgggtttgaatttcctctcttggaaagttcctagaaattcctctgggcctcattctttcagtcgctgcccatgaaagcttttactgagcagagatgctctccccttcatcatctctagagctccgcacttatccagcagtccacagtttaatgctgctttgatcattttgcagtagtgcagtgttttcttgaccaagtgcattaggactgaggcgtttttctttaacactgcaattgatagctaggttaagaattgaggccgggcgcggtggctcacgcctgtaatcccagcactttgggaggcccaggcgggtggatcacgaggtcacgagttcaagaccagcttggccaagatggtgaaacctcgtctctagtagaaaatacaaaaattagccgggcgtggtagcgggcgcgtgtaatcccagccacttgggaggctgaggcagagaattgcttgcacccgggaggcggaggttgcagtgagctgagatggcgccactgcactccagcctgtgcgacagagcgcagagcgagactccgtctcaaaaaaaaaaaaggaaaagagaaagctggccgggcgcggtggctcacgcctgtaatcccagcactttgggaggctgaggcgggcttatcacgaagtcaggatatctagaccatcctggctaacatgtgaaacccactctactaagtaaatacaaaagacaattagccgggcgtggtggccggcgcctgtagtcccagctactcgggaggctgaggcaggagaatggcgtgaacccaagcggagcttgcagtgagccaagatagcaccactggactccagcctgggcgacagagtgagactccgtctcaaaaaaaaaaaaaaaaaaaattgaaaaaacttgggagatgttcctattgccaa

SEQ ID NO: 24381 - DNA, 1024 bp, Homo sapiens
tcagttctcagagagccagtcatggaggggacattgatttgagttttagacacataggaatcaatcatgtcttataccaatttggtaaatttcttaagacaacccagggaaatccagtcaattccacatgtgtcttttctgggcagagtcttcctcctggaacatgctccgctggtttcttttctgagcctcaggatcttgaggtcttggtggctggcagcgtgtcccagtgagggccctgggctcttggagggctctgggttgcatgtgccacacatagtgtgacttcagagtcactggggagagtgggtcccatcttgaagggcagtgagttgggcccttccaaggagctagagaggcctttaggccccagcaatactgaggggccacccaggtgacctggaggcccctctgcccgggcctccaaagcgaggacagtatggccacagccctggcctggctgcggaggcgggtgctgcgctggcccgcggctgctgggactgcaattgtttggattttcactgaccgtgctttgtttttgtttttttctcctcactcctgggctcgttctcattgctttctttctctctccgcttccccctcccgtgtctggtcctatctctccccttccccacccggccctcttgtcctctgctcttctgtctcttctgacatctctctgttccttttctcagctggaggttctgcactaccgactcagtgtctccagcgccctctacagccccgcccaacccagcctccaggccctccacgcctaccaagtactggctcattcgttcccttccccctgcccagagtgcatgtccatgcctggcaaagcaaggggccgccggggccggctgctggtgactcagaggctagttccaagcagagcgtagcccctgtgtcggggggaggcaggggtcagcctccagcctggcttggcccctggctttgtagactagtttggttgggggtgggggtggtggctttgtggcagaacgaggcatgtgggcatgtggcc

SEQ ID NO: 24382 - DNA, 1074 bp, Homo sapiens
tcagggctccccagacacctcagagacaccccagaatcctaagggcagcagtcgggtactctgccccggggaagtgggtgccagttcgtctcctgccttctaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccaatgtttgggcccgaggcccgcaccctggtgagtggattggcggtgcctgtcctcagggcccctggagccatggggctgagcagaacccgggaagtgctgtgatctggcaggaaggagggaggctgggtgtagatttgacgccatatctccttcccccattttagtaaagtctaattttttcctgataacgaaggcagtgtttgttgggaaatttcaaatgtagaagatcatcctttagtctttaaaagtcctctggcagaagccactcctcctgacgctcagcagtctggctgtgcattgctcttggggctgcctgggtggcagcacaggcctatcctgctggtgacctgcccacgcctcccttgcaggtcctgcgcctcgctcagctcatcacagaggccaaacacacagccaagtccatctccgaccagtgtgcggagagcccggctggccactccttcctctcatggctgggctttagctccatggacaccagtggctcctacacagccaacgacctggacgagatggggcaagacagtgtccggaagacagatgaatacctggagaaggccctggagtacctgcgccagatattccgggtacgagctatggggcctgccccaccgccatcagggtccccttccctgaaggatccactccacccagcctgtggtcagccacctaccagtcccaggccccacacatatggacccagtgttgtgggaggcaggcccacaccccaagcgtcatatctgggtccccttgttgccactgttgtaggctggtggg

SEQ ID NO: 24383 - DNA, 1111 bp, Homo sapiens
ggtgcttctcagtgtaagatggagctcagagaagatgatgctcagagtaagattgagctcggtgattggcactccaaacattgctctgagcccattggagctctgagcaagaaggtgggaagtgagcaagaaggtgaagaagtgatacaatcccacagaacattacaagtttagtgggagccattattaaatgtaaagagaagaatgccccagaattctatgtggattgtcaggggacaatactcatttctgtaatcaggcatactttctttgaaaaagtttatcatatcaaacctcacaaggacaaccagaactctgtgatatccactctacaaacctcagatccctacagtgtagtaaaggtgatagccgagatagaaagacagaaacacactgtttgacgaccaatctttggaagttgagatggcaaatgtggatttactcagattattttcctgttagcacctccaggtgtaattttgacagtactttgcattgggctaatgacacaatggggaaacataaactgctgacactggacttcagcagtacagtaacagccatgtgcaaggccattgaaaaagtaaagactggtggttacattgccacatgtttttctgcatggcatcatcatcttaactatggactttatgtgctttcacagcaagatgtttctagtatttagaaatggaccttatgcatcgtatacttcataagagcttgaaaagctctcacccaggtattaccaaatgccagacatctctctatgtaggccattttctgccacagccagaattcattctgggtgacatgctgttcttggctgctaaggaagtgatatgggggagccaggtgtctctcgctgtctgtgagtctatgggaaaaaggagaacactgaaaggcactaagtttactgccacgtttagaggaacttgtgaaggcaacacaagagtgttgtagtcctatgtggccaacaccaacctgagtttttacaacagttattgcataatgatcacaatcacattcaagttcacattctaaatcttagattctacaaaaactctgtctgataatatcctatagaccttttggtagctaaaatcaatgagtt

SEQ ID NO: 24384 - DNA, 1045 bp, Homo sapiens
ttgacccagccatcccgttactgggtatatacccaaaggactataaatcatgctgctataaagacacatgcacacgtatttttattgctgcactattcacaatagcaaagacttggaaccaacccaaatgtccaacaatgatagcctggattaagaaaatgtggcacatatacaccatggaatactatgcagccataaaattgatgagttcatgtcctttgtagggacatggatgaagctagaaaccatcattctcagcaaactatcacaaggacaaaaaaccaaacaccacatgttctcactcataggtgggaattgaacaaagagaacacctggacacaggaaggggaacatcacaaattgggtctgttgtagggtggggggaggggggagggatagcattatgagacatacctaatgtaaatgacgagttaatggatgcagcacaccaacatggcacatgtatacatatgtaacaaaccagcacgttgtgcacatgtaccctggaacttaaagtgtaataaaaaaatatatatatatatatatataagtaaatggctgatcaggaaaaaaaatttaggaagtagaattcaacaacacatcaaaaagattatacatcatgactaagtgggaattatctctggcatgcaaggttggtttaacatatgtaaatcaatcaatgtgatatatcacattaacaaaatgaaagataaaaccacatggtcacctgaattgatgcagaaaaagcatttaacaaaatttagcaacctttcttgataaaacctcttaatagtttatgtatagaaggaaagttcctcaacataataaagaccatttatcagaaacccatggcctacatcatagtcagtggggaacaactaaaagcttttctactaagattgagtacaagatagggatgcccagtctcatcacttttattcaacatagtacttgcaagagcaatctgatgagaaaaaaaaagcaactaaattaaagaagtaaaattatctctgtttgcagatgacaagaattcattaattccttt

SEQ ID NO: 24385 - DNA, 1063 bp, Homo sapiens
atttgccataatgctgaagtcaaatgtgttgctgttaaatcagctttctttacccaattcacatttgtgcttaaaaaaaaaagcattacaagaccttgcatatttctgttcaacttatttttaacattcatttcattattgcaacatttattgtaagttgtatcagtttcatatttcttcatcttctatatatggagattatgccccagttacatctctttatctgtaagactagtaatatcaaaaaagaaaatgaatttcgtgtcttaaaatttatccttagtaaattctacattttctgttgattatcacttttaaaggccaaaccctctttttaggaatttttcctgaatcgcacccaggaatcacatgctgtagtttgctctgttttactagacttgaaatcaccctttcccatttatgtgaaaattagatttctgtttgtagggaaaagaaagagagatcagactgttactgtgtctatgtagaaagggaagacataggaaattccattgtgacctgtaccttgaacaattgcttcgctgagatgctgttaatttgtaactttgccccagccactttgccccagccactttgccccaacattcagctcacaaaaacatgtgttgtatggaatcaaggtttaagggatctaggactgtgcaggacgtgccttgttaacaaaatgtttacaagcagtatgcttggtaaaagtcatcgccattctcgagtctcgataaaccaggggcacagtgcactgtggaaagccacagggacctctgccctggaaagccgggtattgtccaaggtttctccccatgtgatagtctgaaatatggcctcatgggataagaaagacctgaccatcccccagcctgacacccgtgtagggtctgtgctgaggtggattagtaaaacaggaaagcttcttgcagttgagatagaggaaggccactgtctcctgcctgcccctgggaactgaatgtctcggtataaaacccgattgtacatttgctcagttctgagataggagaaaaaccgccctatggcgggaggcgagaca

SEQ ID NO: 24386 - DNA, 1050 bp, Homo sapiens
gtccttggtatgctgagtgctggtctcctgggcctactgttgtttctctatgctttgtctctgtgtcttatttcttttctcagtctctcatcccacctgatgagatatcccacaggtgtggaggggcaggccaccccttcagtgttcgctactttcagtgcttacaatgcctgtcatttatctgtagctcttatactttttataaaaaataattttataccaaaagccttgaaacttttttagagtagtagctttgaattgttgttattattttattctactgttatcggtaacctcccatgttaacactattgtttctttctgtttactttcagttggttggcagagaatttgaactggagatgaactttattatccaggatgctgagagtataacatgcatgacagagcttttagagcactgtgatgtaacatgtcaagcagaaatagggagcatgtttacagccattctatgaaaaagtgttcggaatgtacagactagcacagaagctggactaattgaacaagtattgctgaaaatgagtgctgtagatgacatgatagcaggtatggggttgtctgtcaggaaagtataacttaaatgtttataaagtttcacatacttctctttatattctataggtaatgtagatttgttgacactgctttgatttaaaataaatggaaatgtatagaaattttactttttatattaatggaaaacctgaaaagtgaaagaagaaaaacataattattatagtagacaaacataattactaacgttgttttctaaattttagaaaatctcagtaccacggagtgctatgaagtctatcagaaaaataaacagtatctttttatgtagtatttcattcagcttttacataattaaaatgccacaataggtattacagttctgtataatgagcatttcaccaaattcccctagttctgtgcccctcaatctggcatatatgcaactatgacaggaagtactaaaagccttagataagcatggtgtatcttttttttttccccacgtatattttt

SEQ ID NO: 24387 - DNA, 1026 bp, Homo sapiens
ggcattctttcaatagatacttattatttactgagtattggacaccattgtaggcactagggagttataaatctttgcctcttttttaaaaaagttaaatgttaaacccccagattaagcaatgcacagatacttttcttgtgggagattcacctaatcctggtagttctgaatcttgtttcctaagattggaggttttgttaatttctgatgctttagtaatgctggcttcaaggaatggaatgttgctgtactgttagttttggctcatgaaatgtgtctttacttaatatcccaaataatagcaaaaacaaggtcaaaacacattttaaaaactgctgtaaagagaaaatgcagagaaatgtgcaactgtataattagaattataagagataattcattcataatcaggtggcattttctagagagattttcctgcctgtgtaccggactccatctttgtgtcagagtaacaagccaactgaaagtcgagatgaaagaaaacaaggacagagtgcgtaggagttcccgtcacacacgtttaaggcttttttccccttccaggttcagggttctttcttgggtatatgacaatgagattgtcaatgctttttagggcacactgcctcctcctaacagaaatatcaccttaccctttgtgattaatggtacaatcataatagatatgatgaatccaaatgtggtgagggggaggtctttatatctttttcatatcttttttgttttcttgttgcttatgatctgatgtgtgtcttgtcatatacagaaaaaaaatattttgggtggtattttcaaaaatttgtttagattttgcatgattctaatgaaaatatttgttttatatttaatgtcagtaattgtagtttctattaaagaatatcaatttaacaataattcatcaatatatacttagaaaatagcttaaaaagcagtgacctgaataaatatattcattcattataatggtgtattctttcttttttaatgcaaattgattactttaat

SEQ ID NO: 24388 - DNA, 1022 bp, Homo sapiens
caagactatgcttctctgtgctctcactgtaccctggattttttacctctttcacagcacgatttgtgcagtcataatttattcatttaccatgagctccttaaagacgggcacaatgtcttcttgttcactgttgtttcttctttatctaacactgtacctagcccagtgaataactgttgaataggaaaaccgaattaaaagattggaaggcttgaagatggctgactacaggcatccagcactcaccttctccgcaaagaataaccaaaatagtgaatagataatcacaataatcacactttgaataaagcacttaagagagaacactggaattcaacagagaagggacaggaaacccctgaggcagggaaggagagggaagtaagtgaggtagttggctcagctgcaactggctgggagcggagagaggctcaccagtgcagggaaagggtaagagagaaatccccagtggtccccattcccactgcagaatcctgcaaccatacccacaggagaaccctctaccctcgtggccccagagactagcataggcagctgcctggagaccacatgatggcattgctccagacaggaaactcaccctggttcccatatacactgaagacctaagcagctatagcaaggtgccatatggagaggccagccctgaccagactgaatactgcctggggacccaatatcccctgcatctccacaccctggagccccagtgacagcccctgaatctacttggagggctttagcagtgtgacatcagttggacccagcaaagcagcagggtccccagcactctagcatacacagcgtcatgcaccccgggaatgggcagtgcagtgccctggagaggctgcctccaggacaaagagagccaaagtgaatgctccccagagcctgaaatccacctgcatatggctgctgccactgacaatgaccccatccccctcgagcagcagggccatcacacccttgcatgcaccctgaagacaggctttccctgc

SEQ ID NO: 24389 - DNA, 1033 bp, Homo sapiens
caacctaagccgagagggcttcatagatacccaggggcactgcagggagggccctcctctttctagctgaggtcaccgaggtgcagagaggtggagggactttctcaaagtctcaccagcaggcagcagtggcaaagctggacctcacatctcctctgtggtcccacaggaacaattggtaacagttgataacgggtgcctgcctgctttgtttatagcaatgatacaggaagagaattgatggccactgggcatctgttcctcactggagcccactgtgtgctcacacccagcttcaccttggaatgtggtagggagcaggttggtgtggcccagttccctcctaccatccccagctgggagaatctaagtgacgtatatcctttggaatgaggggttccctttctcatgtcaccttttaagtttgacatgataagaatccagtctgggctggattttacatttcactcttattaattctctgtgttttagggctcctggctcctctcagcattgatttcctttctttaggagcatggggtaggtgaggagtgacctggaagaggtatcaggaccattccttaacatttctgataatcggtgcctgtgaagacattcccgcagtgtctgcggagtcctagaaagagagcagaggccacacaaaatgcttttctgaacccaagatcgccatactttgtggaatcttcccattggacatagcagtgagcacccgtttcctttcctgccctcacctgttcctgattcggaatgcttctgccaaataaatagtcactggctacccaaggagtttaaagtctaagcctggtcaatgcacacccagaagagttaagttcagtgataaagggaaatgtagatgaacatactaattcagcccatgtgaccactttgggcctcagctgttaggttgagaagtaagaggggattgaatgcgctccaaagatccgttcagttcctaatgttgcttaattctatacatgtggcaaaaggcttgtaacataaattaaatgaaatt

SEQ ID NO: 24390 - DNA, 1044 bp, Homo sapiens
cgccccgccccacaccgccccacaccgccccacaccgccccacaccgccccacaccgccccacaccgccccacaccctggcggtgggctcccgagtggcctgagcctccccagtagccccagcctcccctacgggcaccaccccttgctctgctgcgccgggtcccattgactgcccaagggctgaggaatgcaggcgcggggcgtgggattggtgggcagctctgcctgcggccctggcacagatccactaggcgaagctagctgggcttctgagtcaagtgaggacttggagaacttttatgtctagctggaggattgtgtatgcaccaatcagcactctgtgtctggctccggggtttgtggatgcaccaatcagcactttgtatctagctgatctggtggggacttggagaacttttatgtctagctagagggttgtaaatgcaccaatcagcactctgtgtctagctaaaggtttgtaaatgcaccaatcaatgccctgtgtctagctaatctagtggggacttggagaacttttgtgtctagctaaaggattgtaaaaatgcaccaatcagcactctgtgtctaactcaaggtttgtaaacgcaccaagcagtgctctgtgtctagctaatctagtggggacttggagaacttttgtgtctagctaaaggattgtaaatgcaccaatcagcactctgtcaaaatggaccaatcagccctctgtaaaatgggccaatcagcaggatgtgggtggggccagataagggaataaaagcaggctgcctgagctggcactggcaaccccctggggtccccttccatagtgtggaagctttgttcttttgctctttgcaataaattttgctgctggtcactctttgggtccacactgcctttatgtgctgtaacactcactgggaaggtctgcagcttcactcctgaggccagcgagctcacaaacccaccagaaggaagagactccgaacatgtccgaacatcagaaggaacaaactccggtcacgctgcctttaagaaccgt

SEQ ID NO: 24391 - DNA, 1027 bp, Homo sapiens
attagagatgattaacaggtgtgttgaaataccagtattcatcaccactttgaaattacggtggttgttgcacctgttgctagatagtattatttaatgtgttaagatacaagctgcaggtattgccatttaccaattaaaaaaaaaattggggggccagacgcggtggctcatgcctgtaataccagcactttgggaggccgaggtgggcggaccacttgaggccaggagtttgagaccagcatggccaacatggcaaaatcctgtctcttaccaaaaataaaaaattagctgagcgtggtggcgggtgcctgtaatcccagctactagggtggctgaggcaggagaatcacttgaatcccagaggcaaaggttgcagtgagctgagattgcaccactgcactccagcctgggcaacagggtgagactctgtctcaaaatacatgaataaataaaataaataaataaatataaaaaatattttggtaacagtatttcaatatcattgatttcctctgcagtcctgtgtattttattttatgcattaaaaaagtctttctgagaaggagtccataggctgcccctagtttgccaaggggtacagtagaattgtggtgtgttctagaccctgcacacccactgctcccctttccctcctcttcatcaagagttgacctcctcctgacttgggctttctccaaggctgtcaggtgcgtttgtagagtgggtgtgggcttatctccaactttttatcttagacctggtcaaagaattgagctctattcttggctcactggtttatcatatccagggaggcaagtttgtcagaacgttcctctagcaaggccatatctgtcactacaaggtatgtgattcatttaaagccaaatgtcctaattatctgaatcctaaacagaagtctgatttcagcttcagtttcagtttttcaagtggagaaaacccacagacattctgcaggaaaatgccctaaatacacattaaccccctgttttcctcttggtatgct

SEQ ID NO: 24392 - DNA, 1012 bp, Homo sapiens
tggtccatcttctggtcagatggatgacagaattaattgtgcagctgctggacacggatagatcccattaccattttatagaccatatcacagtagaaagtggaaaatataggtcctgtcttcaacttgacaaccaaaaggtgaggacctcacacatgcagatgaatactttctctctgagaacagaccttttgggcatggtagctggtgtactgggaatactgggtcctcctgttaccgtgtcttgtgcacactgtctaatgtcatgcttgggataaccatgtatattagcttcccttattttcaccggacaaacgtgaaacttatgagggaaagtgaagtatgttgtctggggtgactcacataataagcaaggtggtcatataatttatcatccaaatcaggatgcttttgagagtgaagaggggtgctattgatgattatgctgggataacaggcataaaaggggatatatggtccccctactgataaggtacagattgggggttaaatgcaggtctctgatcttaaattgtgcctactttccattacatgctgttagatcaggccactctgtctgcaaatgaattggtaaggcacagatggaagaaccttctgaagatgagttctgctctaagaatacagccgaagagaaattctctaaggctaggcgaaaggtttttttggccagagaaatgtctactagagatcttctttcatgtaaaaacatggaaagggttttgttggaaagacagtttcttccttcataaaaatggttttccattgtttgtttaaaagaatgggtctgctttagcatttataagaaagacggagtaagagtcacagaatctcatatccagggcaaacatcttcatagcctgtggctgttaagatccagaatggtagatgaattctttaatagtaaggtgtgtagatacaaatttactactcttgtttttagcactctggccgtggctgctatcaatgaggcaattttgtgtatggtataatc

SEQ ID NO: 24393 - DNA, 1031 bp, Homo sapiens
gttgggatgagcaagtcctatgactgtgttcactgatggcatcctgtcctcctccttccacgtctatgcctggcagtccgtaagcttggatgggaaaaaaatagacgctgagttctaactgaaatttggcattttcttccattgtgaatatagggaacaaaccaaagtaatattagaaataccttgacctttgtcattaataaatccatatcgcactacagttgttgcagagatctctaaatattttttacactcatcactacttaaaaatggtggtacagaataaaaccatttttagatcttgttacttggtgtaacttaatgaagaagcactcataccgtatcacaatggaaaaatattgtgataactaaatctaatttgtttgccttgtaatctttggtgttttatttcatgcatttaaaaatgttattttgaggaaacatccacgggcttcatcagattgctgggggagtccagagcatgcaaaagttaagacacctgctctgtcgcctctggtctaaattttatcctgactgataatgcagtggtcctcaacccttgctgcccattggaatcacctgggggagttttaagaattctagcactctggccataccccagactaattaactgcagatctcaggattcccctggtgattgcccttggttccaggggattccagtgtgcagtgaaagttgagaaccattggtctaagtgttcatacaaactaaccttcttccctctcttcttcctttctgattctttaaataagaaattaagtttcatgcttatgatagaaaattcaaactgtgcaggagagcatggctctctcacctttccagaaaaaactattgctgacaagttttgtgcataaacaatcattgtagacatcacacatccatacattatccacgatgagattatactatacatgttatacacatggacacactgtatgcagtttttcacttctatcgtagagaactttctgagctagctgttgttccttgaaattaagttctctttctt

SEQ ID NO: 24394 - DNA, 1045 bp, Homo sapiens
acaccaagcaaggagatattattaataattgggaggccccctcccttgcttcttctgacaccagtgcctggagatttcctctcatcccctgtggtagatagaggaccacgcttgtgctgggtttgctccatcagccactctgcaggttgggcctctcagagattaagagaagagtggctacctccataatttgagcctttcagtgtatttaaaaagtgaaaaagtacatagggttagaaacaccatagacagttttaaatatttacattgaagacctggatgctttttaacacaaggaaacataatagaatacagttatgcttttcacaagataataataggagtcacaaaaatatggagacatagcacattataggtgtggcctggtaatgaatatatgttcaaagttatgtgacgaatgtcttctgctttcaatcccattgtttggatctctgtgaggctccaggactccattgggagagaggatcagaagtctgaatctgaggctgttgtgacttgggctggtgccaaatctgcaccccacccctgcatgttctgtacacttggattccccttgcctctaggccttctcagtcccaggtttggaaagattcaaggttggggcatgcctgcattttgcataattatgcagcccatagaggtgagtgagtgacatcccactcaccgccatgggacctcactcacgccctgtgggacccactcactgccatgggacctcactcacgccctatgggacccgcttaccgccatgggacctcactcacgccctatgggagccgcccactgccatgggacctcactcactcatgccctgtgggacccactcactgccatgggacctcactcacccatgccctgtgggacccactcaccgccatgggacctcactcacccatgccctgtgggacccactcaccgccatgggacctcactcacccatgccctgtgggacccactcaccgccatgggacctcactcactcacgccctatgggagccgcccactgccatgggacctcactcac

SEQ ID NO: 24395 - DNA, 1038 bp, Homo sapiens
tgtgggacccactcactgccatgggacctcactcacccatgccctgtgggacccactcaccgccatgggacctcactcactcatccactgtgggacccgcccaccaccttgggacctcactcactcatgccctatgggagcctcccactgccatgggacctcactcacgccctatgggacccgcttaccgccatgggacctcactcacgccctgtgggacccgcccaccgccatgggacctcactcacgccctgtgggacccgcccaccgccatgggacctcactcactcaagccctatgggacccgcccactgccatgagacctcactcactcatgccctatgggacctggttactgccgtgggacctcactcatgccctatgggacccgcccactgccatgggacctcactcactcatcccctctgggacccgcccaccgccatgggacctcactcactcatcccctctgggacccacccaccaccatgggacctcattcactcacaccctatgggacctgcccaccgccatgggaactcactcacaccctatgggacccgcttaccaccatgggacccgcttaccaccatgggacctcacgccctatgggacctgcttaccaccatgggacccgcttatcactcacgccctatgggacccgcccaccgccatgggacctcactcacgccctatgggacccgcccaccgccatgggacctcactcacgccctatgggacccgcccaccgccatgggacctcactcacgccctatgggacccgtccactgccatgggacctcactcactcatcccctgtgggacccactcactgccatgggacctcagtcactcacagctcttctttctgttgccaaatgttgcactgccaatcttccccaaaggaaataaaggaagtaaatgtaaaatcaatgtctttttaattttttacaaaataatgaactatctgttgaaaaaattgggaagccagagacttcactaatgaacgtggtaactatgtttgtctccaagttatgt

SEQ ID NO: 24396 - DNA, 1035 bp, Homo sapiens
tgcctgttcccgtctcccgctggctgccctgtcccacctgtgcctcccctgctacagcagcggctgctccatatgggcccccactgccatcactactactgtctccccaaatggatccccccaaagagcttttagagttttattcttaccccttctcttcccctttatctgcccttcactgtctgaatctgggctgtctcacatgataaccactaggcacatgtggctattgagctcttgaaatgctgcgaatctgaattgaggtagactataaatgtaaaatacacaccaaattctaaatatgaagaaaagaatgtaaactatttcatacatgtttcaatgttgattacatgttttacatggtgatattttgtgtatattacgttacataaaatacattttaaaaattaagtttacctgtttctatttatcttttatgtggctaccagaacatttaaaattacatctgtggcttgcattacatttcttctggagaacactggtctaaattcgtgtgtgtgtgtgtgtgtgtgtgtgtgtgtgtgtgtggtccctgtattcccaacatagtgtcctgtaaaaggccccaggattcatccatcccttcccttctcgcttcccttcctctttttttttcttcccttctctttgcttgcaatgtgtctgctaagtgaatctctggaggagagaatgttaaagcatttgaacggtgacaagattgctcagacagaaggtttctagtgctttataccagtccaaagagttaagacggttgtgttttctctgattacaagtgaacagcaaacatctgtcgaggagtttttacagggtatttgtactttcacatgatctaattttactatcttcataagtagtatgaggctgggcatggtggctaacgcctgcaatcccagtaccttgggaggcttttgggaggctgaggcaggtggattacttgaggccaggagtttgagaccagcctggccaacatggggaaaccctgtatctactaaaaattagttgagcatggtggca

SEQ ID NO: 24397 - DNA, 1035 bp, Homo sapiens
gttgggcctgggagcaacgggaaggaagtgaagtcatttttcagctttgtgttatcagaccattgcctagaagacatatttctggtgggagccttgttacctggtaactcattcaacttctgaatgctggcctcttgccctcatcttgtctcccctcctgcaggatctcccagggccctggactctggctggcaggaggcagaagcctgggccgctaggaagaggggagtaggagcctcaggattgtcttctgctctgacttcccttcagttttcaaaaaatcctggtgtggtctggaagaatagagtttatttttccttctagtaagggtgtgatcttggctgggggcttttcatggggttgtcatattttatctacttgtttgcatatcgagttcaatctggatttttctctcagcacttccggctctccttttgttagaatagtttcatagatttatttttttttaaatgagtaatagtaccagtgtatttttctttctagaaggaccttgctaaacatgtgtaaaataggagtagatatgaatatttggagattggtgaagtgataagaatgagaatacacatgtttggccgggcgcagtggctcatgactgtaatccctgcactttgggaggctgaggcgggcagatcacatgaggttaggagtttgagaccagcctggccaacatggtgaaaccctggctgtcctttaaaaaaaaaattagctggtcatggtggtgcacgcctgtaactccaactgcttgggaggctgaggcaggagaattacttgaatccaggaagtggaggttgcagtgagtcgagatcacgccactgcagtgcagcctgggtgacagagcaggactccatgtcaaaaaaaaacaaaaacaaaatacacctgctctccttaaagaaatggttctccttgcagctcaccatgtaattttcttgtactcatggtgttaggaccttttgctgaagactggcgggttgtcagctgaaactctgggcctgatttagggacttcccttaaaga

SEQ ID NO: 24398 - DNA, 1052 bp, Homo sapiens
gcaaaacaaaacaacaacaacaaaaaaacaaaacaaacgtgagtatggccacatttagcctgacagtcccttaattctgtggtaaggaggctgtgtcctccagcacggtgttggtagggtataagatgaaaagatgctgccctgagataactctccaccagggctgtgtggtagaactttctgtggtgatggaagtgttctgtatctgtgctatccagtatggtagccattagtcaactggcttttgagcacttaaaatatggctagagcatctgaggaatgaaatcttaaaattttctttaggttgaaataaccacacgtcataagtggcttccttggtgggcatcgctgctctagctgatggccagagatgactgattgctctatttagccacagagctaggatgtaagtcctagtggggctggctcatttgtgagtggagatttaagacatggatactctaatgcacattagaaaatttaatatattgcatgggattgtgaggttgtttcatgttggaattcaaagaagactttggtgagttggagctggaagtgggaagggaagttttttttagaggaagatggcatgctcatagcattcaggtcttctaaaaaaattatccagggccgggcgcggtggctcatgcctgtaatctcagcactttgggaagctgaggcaggtggatcatgaggtcaggagatcgacaccatcctggctaacagggtgaaaccccatctctcctaaaaatacaaaaaattagccagtcatggtggcgggcgcctgtagtcccagctactcgggaggctgaggcaggagaatggcgtgaacccgggaggcggagcttgcagtgagctgagatggtgccactgcactccagcctgggcgacagagcgaaactctgtctcaaaaaaaaaaaattctagggagccagcaatgttctgtaactcatgttctagggaagcagtgtgatatggaagactccaggcttgggagcctggcagatgtgtgttaagatggggatcaactatgcaagatagttagctttctg

SEQ ID NO: 24399 - DNA, 1030 bp, Homo sapiens
gagtttgggagagattctaggcaggaaacttttaggctgtaaaaacatctaaaactaaaacttctaaaaattgcttctagagccagtgtttcatagggcatgaatcaggaaaactagactaggcatttctaacagattctaatacagataattgcatatttaggtgatgaaagaggagagttaccagactgttacagcaacctagagatttgtaacctcaggaagatgtccacccccaggactgtggaggcagggtggtgggggtggcagctgatggaaagggcattgggtcctttggagagagctgtctccctagagaaggttatcccacccagcaaatggagttgggagagagacccaggcaccttcccctcccagcttctgatggtacctcccacaggccagcactactagaaaccaggtggcaagggagcttgggaaatgtagtttcctgtgatatttgtaaaaggacaaagtatgcagagaatggatttgagagcaaaaaggcagatggctgtggcacaaggattataacgttggtgcaaaggaagataagtcgaggagtaagagattgctctagggaaagaacttgaattcttgattcccttcccccgtgccacattcctttgtggctttgttaacacctgtgtcctctcttcatgtttctgtcatgctctttacactgcatgatatttacatatttgactccctgttaataactaacatttactgaatgtttcctgtgtgctttatctgcattaattcattgactcatcaaagccatctgtgaaggcaggtatagtccatcttcattattctcagatttctgtatttgtgaatttgtgtcctcattaatacttatttgtaaccctgaaatcaatactctgcactttcctggtcattcatggacatacagagtagaagatttgagttgcctggtgtccatgttcccagctgcggatgaacaaggccttcttgcttcagctcttatattgcaaataagtgttcttcttctacctggttagtaccg

SEQ ID NO: 24400 - DNA, 1104 bp, Homo sapiens
ctcggcctcccaaagtgctgggattacaggcgtgagccaccgcacctggccataagattaatttttaaccaatttcttggttttgattctaactgttgatatttgaaatattcccaaatgtggcaattaaacaaactgggcaattttcagtggtagagtcacaaaaattccttgttccatgcatgggttcactaatcataatattgttcttcaaggtagtaaaattaatacggttgctttcataatgaagaaaacaacataattacgtcactcgttgggctttagaactttatttggaaggaagataatatagaaattagatttgtgttcatgtatggattgacgcaatcaagttcatttgaagctagagtaacttacaagcttaagatgtgaccagtgagctgggtacactgtatagaaacttatcattggatttgagttggaaacaatagcattgcagtgcaatcttactacatcagtatattatattctgaataccattttctgagtagtagtagtcttgtctatagaaactgaatggatagcctgtttaatagttgaagtttgggccaggaggagctgaaattgcccttcatgccatggggaaatggagcactcagtttgaaggccctttgtaatgtggaactgttaaattcactttaaactattatttttaaaaaataggctgtctgcagccatcatccatggtgaggatttgtattctccttcttggatctgtcacgggctggctcgctcatgttgagcaaggcggccaagtttggagcttgatgtggcttccattgaggtgttacgtgggcagcaggccatgcgggacatgaaaaacgtttgccatgcagtttctgttggtcccagccgagacgaaaatgaacagttctagcaaaattgctaagtcagggatgtttgtctctgtaaagttgcttttttagctcacttaattttttttgtctgtgaaagcctttctcttttttaattctccccttcagtggtttctagccatcgtctctaattaaaataaagaatcttagctttattttttgaaacttatttgtacccactttctaaatctgcctttattttttgcat

SEQ ID NO: 24401 - DNA, 1054 bp, Homo sapiens
ctggtgtgcgtgagcctgtgttttaggaagaacttggaaaaacttcttaatggctgggtaatcttattttccgtagtggattttatttgtgacaattgtattaagaaatggactttattctgtgtgctgtgctggagaatgtactggaagaccagaggggtctaggctttgcagtgcctataactggcttgtgatctccagcaagtcacttaatatatctgagtgtctagaacaaatggtctagaaaaccccattccaaaaattccagggtaaaaagtcaggatgatcctcatgaaactaaaagcaactttttccccaacatattattcaaggtgtagttccctggaggctcctctgtagcactctggacatggtgctcttcggaagttgaatttgctcattgcctctgttgtttcttaaccattagttagacatttagtctctatgccaagctgtaaacaagttagcagaagtggaaatttttgtggagcatagaattaattggtttggatatgcctgtgcttgggaatttacctattgttggtgtttgaaagtatatttttcccctttctttgaaacgattttaggccgttgcttctggtactcaagtaccagtatggagggtctgaatgtgtggtatatggccttttctttcagatcttaaggcttaaaaaaaaaaaaaactatggatccaagggagctttttaaaacactctttaaaatacgtgttttgttttctatttaatgtaggattcattttcaaagcaaagtgatcatttaaaaatatgacagcccagatttgttaatgagctagcaaatggttgctgttaagtgcaaaattgttttcccataaggttcaactcctaatgatagtcgatgcttgtaagtgacatggatctttagctccgcttttatagtttagagcaagcttgtccagactgcgggccacctgtggcccaggacggctttgaatgcggcccaacacaaatttgtaaagtttcttaaaaaatggaatttttttttagctcatcaggtttccttactgttagtgtat

SEQ ID NO: 24402 - DNA, 1043 bp, Homo sapiens
tgggatttgagattaaagagagatttcttgaacctcctggtataacttgctatcctttggagtcaaagacgatgatgtcggccatcttgttaggctaaggaggaaaaggaaagtatgaaggatttgcttcttgatcagtagttcttagtcatgttccatgtaggacggaaaatctttgtattaaggaacatgttcagctgctgtaacagaaacctcaaacaatactgatttaaacaagacagtttagtttccttttactttaaagtcagctagaatggcatttctgcctgctaaagttatagggggctgggctccttccttctggttgccctgccacccccagtgttgctctcctttgtatgccctgaaataaaggagaaaaaaagggtaggaggaagggcaaggaggaatgataacccagaggttgggtagatttttttctactcctgttccacttggcaaaatataatcactctgccactcagctgcaagagataattatactctgtagtgagatactctgcaaaattcctgctcctatggaagaaagggagaatagctttgggggagcaataaggatccagtatatcccatttgggccttgtcatctgtaccagaagctactggtaactagaaatgaatttttaagcctgtatagccaagaagggtagcaatagtccttcttcttctggttcttcatattgaaaaatgaaactgattttataagctgtgtctgcctctgctagctcagtgagcctgttcaccagccctcagttgccctccctgaactttgccatcataggcaacccatgtgcactgtggaaggtgcactttccttgctgtcaagctctgtgtagctctgaagatcaccagcattctgatccagtgttcttcagactagcaagcagcttcagaattaccaagcaaggagcaggaagttggctgggagatgccttttacccttgagtctagctgggtgtgtgaggcttggctgttttggcccatctggtctccatccaaggtggctgagttaagatcttttg

SEQ ID NO: 24403 - DNA, 1038 bp, Homo sapiens
ttccaaaagttttcacatttgtcacactgtcctaaccctatcagctttgttgctatcattgtagtgaggcctgcctagggatgataagtgaaggatccccaaggacacattaagacagcacatagaatcagagttttcagactcttggccgaactttttttttttttaagcagaccagtattttccaaactttggacttagtttccaccatattcacgttaccacctatacttgttacttaacatattttcttcagtttatcctgcatcaactcatttattttaatttggtctcattctaattgacagcatatagcagcttatgaatttgatgtgcgtatgcatgttgcaacaaatacttaactattagtatgtatgctacggtgtaaatgtaccacactcagaaaaaaccttattagaccatcctgactgtttaggaagcttggtgcccaagggaaatagtctttgaccatcagccagaatttggttagtttcagcagataagagagtagctggtaagctacttaggaacattttaagtagaatatgtgagaaatgaggataggatatgcctttattcccagcaggcaaaaacatgcatttatttactatagttgttataatataaataacatagatgcatatgtataccagaaacatggtctttatcccatttgtggataaaagctaaggaagaacttgtattacttatgtatgaaatgcccaagggaacagagcctagacaagttctgaaacttaatatctagggaatgtaaacatttaataaaacattaccttacccacctatgtggcctttcttggctggacttctaaaaaattttgtttttataccatattctttgttttaggaaagcattatcttactcccagcctctggggaaaataaataaccgagagaatcaataaggagatgccccagtgttgtggtcagtgtctgtttttccccagtgttctgggagcagggtttcctggtgttctgttacatcagcatgaaggaggccttgtgcatgggaagacc

SEQ ID NO: 24404 - DNA, 1044 bp, Homo sapiens
aggcaccgcatcaggctctgtcctctgtgacaagagctctgctaactcaaggaatgtggtgtccactgcaaggaacaaaggtggttatgggttcccactggtgctcctagatcctttgttctcaagggtgggccaaaaactggcagtttcagcaacacctgggagcttgttagaaatgcagtctccttaggcctgctgattcagaatctggatgaccagatcctcacacgagtcacacaagagtgatgttcaaggagcagttataggctcagcctgtttcatgggcagcagtggtggccacatcttagagggattgtgttgtgggcatggtcttgccgtgttttagtttaagttctgattttctatcatttttttgataaattctaatacaaagtgatctagttatatatccatatgtcagtatgtgatttggttttttacctttctgtgggtattcacgttcaagtgtatagatcaggaaaagaattctttattatcttccatgaggtctcaggatgggaagataacagtgcctgttgtatacagtcattataggacatgctggagatagaagcagtaagacactgcttctacatttgataagtctggtccagggagataaatatgtaaagggaaaactttatctcaataaactacatctcgtgatagcataagggaccagagagaatagcctgtagttctttatcccactgctggggtgtcactaacagtgtactaggatagatggacaactttatatgataaagacagttttagagctttacgagacttttgacctcttctgggagctgtcctgattcctcttcaaaccgaatgatagcaccttttgtgtgttaagtagcctaaacagtcatttgtttagttaccacctgctggtgtgtagccttaggagaagagtgtttactgttgagtggttgttctgctctgccccttggctaaggattcctgctttccattaaatggaatgactaccctctctttttgtctttgaactcaaatggaagtcatgttatctttacatct

SEQ ID NO: 24405 - DNA, 1087 bp, Homo sapiens
agagtgtgtcctctctggtgaccttcttttatgatgtgtggtggccagcagcttcctctggcacccccttggggtgtcttgtagcggagtgttgccagtgtgctacctccctgtgatcagctttcctgcaccatagagggcaccacagtgacttttctgccatctagtgagttgtagttgtgtcttctccaacaaagtcagggtctcagtcccccacctggttattttcatggatgtttcatcttcttcatgggtgttttctcagtctgagggatagtggttactccttatatctggcctttctgtatgatctagagttccttgcattacttcttactagtcaacatcttgttagcagaatcccaggttgtagttaataattgtttatgttaagcttttcctgttcaaattagtatgttttccatctgctcattgaaccctaactgatagaacaaaccttacaaaaaaaatatcaggaaaaattgtggaagactcagaaatgggcaaaacagattaaaatctaatgcaaccttctaggttatctgtgtctttcattttctttggactgatttacattttggcaagttataggaaagtgatagtaatggaaatggttcttgttcatagaatggcacatgaattttgcccagtagaggtattattgatccctcccaaaaagcattttatatattaacagatcggcattcctgattgcctacacacatgtgtgtttcgttttctttggacctgttttaacatctttctggttcctgtattaattaatcagctaaataagatctttgccgtgtttattttatatttgtaaaagtcatagttttatgttttaaaatattctataactgataaggagcttacaggatatgcccatatatgttaaaaatgccacagaaaatggagatatgatttgttagaaagatgatttaaatgcattttaatgctttataactggacagacatggatgaaatcatcttatgaactaaaaagaaaaagtatcactattatgtatcgaaaacagaacattcataacatacccacagaatgggagaaaatatttgcaaataatat

SEQ ID NO: 24406 - DNA, 1051 bp, Homo sapiens
tggatggattgtgtatcccttaagtcatcattcagatacaatttctttcaaccaaactttgaaagactttcaggggctatgaagtcactgaagtaccctggaaaatatcggaattagaatcatttccagaaacttttaactattggttgaaatactcttatgcagaatgaagggacctaatgagcatgcttatctcagttgaaggctatttcactttgaagtcaactgggaaagtacttgtgattgcaaagcacttgttctaaagagagcactttggattataaaacaacaaaaactcaaacccccatgatgttgaactttgagcagtgcaaggtgtgtgttgggtagctgcataaggcgctttgctgtgtggaattactgctttatcagagttagatgtttggaaaacatgtatccaaactgtgtcttcatttttaacctgatggatcaaaatgtttgctttttgtcagcaactagaaagtaggaccagttgtcctataaggactcctagttcacagtgattaaactatgccatttatgtatataatgctcatctcagctggatatgtgtcagtaggatgtacatccagcttattcaaaagtaatataagttctgtacgtgttatgaaaaggagaattgtgccatgttctctgttatcctccactggaaattaggatctgatctgcccctgctcttactatcctagataaggtaaaaagcagtgcttctcatgtgaaaacaagtaaccttgcagtctggttataaacaccaattgattctattgttttgggattgggcctaagattctgcatttttaacaacctgccagatcatttcagtgctacctttccacagatgagagttcgagtagcaatgttatagaggtgctagttgctaaaagcattgtagacatcgaggcttttgggctagcctcaaatcatttctcatctttggagccaaatgcccaggagaggttaataaaagctgtattagttcagcattattctctacaagtccttccatagtgtgggatgatctaacaaggctctg

SEQ ID NO: 24407 - DNA, 1052 bp, Homo sapiens
ccttggccttgaaatggccctagaagctcccagatatggtcttgtcatggactgaatgtcctttgccactgccttcataagcagtgaattgcacacagagaggcatctttaggaaattaaagcaatgccattttgggggttctgagctggtgtatgcagacacactttcccctggagtcagtgggttagtatagttagggctctattggttgtgtttgcagctagctccttctccctgaacacatttcaggaaccatgtgatctcatgtgggagtgagttcagggaatgctgaaaaatattctcatctttccctaaacaaaacttaattaaggctggtgggggtgaggtgaagaggatggggaggaatgttctatggaagccagtaaacttagagccaattgtgttcctccctccagccaataaatatgacactggcacttgcatgctggtgagttttaacctttggcttcttgaggttatgttgctcttcttcttgcccttgtctctaactgccctcactttgaaaggaatctttgtgtacttgttgctttttctttaaagaatttttttcagaattctttttgaaatcagaaagagtaaaaaaatacacatatgggatgtaacttatttttcttttatgtttaatatagaaaaagttggaagctgtagacaagcaaaaaaagaaaaaaattacacataagtctactactccaggcaataaccacaattaacatttcagtgtgtatttttctgatactttgcatacacacacaaatatatatatacatatatatacatatatacatatatatacacatatatacacatatatatatacacacacatatatatatacatacacatacacacacaaatacttggaaaaaaattgcaaatggaatttagatcatgctgtgttttgcagagcagacttggtctgtagaagatgacctgttgttgagtgacaagagtctgatcattgaattgaggtttcagtggtctcactgaagtggtctccctgatagtatagatgagatgcaagaatggggtt

SEQ ID NO: 24408 - DNA, 1116 bp, Homo sapiens
aaaaaaattcaggccacctccactacctgagaggttgctttgaatgaatagttcttgcagaaaagaaacagggacccagaatttctaattctgttggactaattactgacccttcaaggaatacatggcttgtttcatttcgaaaagtgagactatatatatccctgtcgggaataatgttcctccccagccacttgatgggggaactcagtaacatacactgcagggctgtcctggggaccttgaaagtgcgtctactcagggttgttctttgtattggtgataggacatgctgaaattagacttgtttgttttaatcagaaggtgacagatcccacttgcttaatttggcttaatgaggtatgtgtatacagttgtgatatcagcttacatatggtattgattcaatagacattccacagctacagcatagcatatgcttcctcagatagtcccttgtctgtgctgtttcatcctttacctgttttcactgacaagtatttcaacaaactcactgtagagcctgagatcttaaaatttaaaaaaatacttggaataaagctgatttggtgagacatggaagagaggtatctgactccatgtttttgaaaaggttttgtaggtttgaagatttctggggttttgagagattttcctttaagctgtgcttttggctttgcatatccacagcttctaaaattaggcagcctaaataaaaatcagttgctagtttttgtttttcctttctcgcttacatcccagaaaaaggagagaaagcaatgcggggtgaagatggtttgaaattctttgggtttagaaatgacagaaagagggattcaattaggggtgtgactgaactgccctacagttcaggacagcagaaataatcttcatctcacagcctccttcttctgtacttcttttacccttgaacattcagcaagtctcacgtgtgggatcacaaaccccaaatctgcttatgtcaagcagagggcccatggcgtggacagagtcacccgaggacgacatgtctgggattgacagagcattataaactgcattttgatttgcattgtcagagttggacagctgcactcttagctggttttaagctgt

SEQ ID NO: 24409 - DNA, 1026 bp, Homo sapiens
ctacaatttttatttgggaggtggaaattagaggtaaaattctttggaagggaagaggatttcatctaggagtgtttggcagcctcatgcaaacatgtttgttcttatttgaattttgactcttgaaatactgtgatcttggcggtttaggccaagaggtggggtaaagaggaggatgggaaacagactaaactcatggaatttcatgtagctgggtaggccaagtcgactctagtttagttaccatgttttctttgtggctgtgtcagagaattggggatggacacatggaatttaaaaaataacacacaattttaaaagttattaccaccatataaaactagctggacctgggagtcagtttctggaatttatgggcattaaagaaatgccgaatattaaattacttggtttggtatcgagggagtggctgcctggctcttaacagtttttgtgaatttcctgttctttttatccttggcttcaagtttttattgatggaaggttaaatattctttttttttcctttgtagcatatgactaaacctatggttcttttgcttcctctttttttccccttgtcttgtttttccctttcaccccaggaattaattatagtacttgaaagaaaaccactttccttagtcttataaagtacataagagacagtaaaaaatagaaaatctttttatacaactgaccttgtttctgcagacattgtaatctattccacttaacctctctttcttctgttattttactttgttaagatagacttgacatttgattaggaaaaaaaatatgcattcaaatgttatgagatatagaatccaaaaaagggaagattgcagaaatttaaaataaatgtaaaagattacaaggtaatacaatgaataagttcatactatgaaatgacacaactttgatgacatggaaaaattcctagacacaatctgtactgactcaaaatcatctgaaggtggggtggagtggctcatacctgtaattctagcactttgggaggca

SEQ ID NO: 24410 - DNA, 1026 bp, Homo sapiens
ggatatgctatagagtgtctgggttcggtaaacttcctctgaagagtactgattttttttctagtaggcagttaaattactgacttactgccttgaacttaagaagacttgcttttatgatttgttagggtgtgtctgtttccatttttttccctagtcttggaccatctgaagtcctgggcctgatgtgaggcccttctggggtttcatggaaagcctgaaatgttgaccctttgactttttggggtttaaactgtggctgccctgcagtgagcagcagctgaagtcttgtgaatactttgaacttttattggagcctccctcacaaatgcttagttttagggtcgctcaagaagtttaaggtagtttatatacagactttggggttctcctctttgggctccctctttttgggaatatgctaccttaatttttcactactatgcaaaacttcattctatgaaacctcaagccagtgagactgtagccttttgtttgctaccttccagacttgatagtcccctctggggcacagccatataaatgtgagtcttattcagtgtagtttccagaaagaatttaaggatcaaatcccttctagtttctgctcactttccctcactctttagtgtcatattgtaagtgttatctgtgggaagattgttccaatacaagcttctctgctattgccaatgcatagtttctctgctttgtttttaaagaatcctaggttaactgttatgtggatcttacacaggtagtgtagtttagcagcgtgctctgggctgggaagctgtctgaattatctgttaccacagtgctgccttccccctggttttggtatgcatgctagctcttttctgttaggtacaatatacaataaccaccatttctaggttggcaaggaccgtatgtatttaacagttgctctcctatccggatgccatggctggagggtaagcaagggactgcactttattctggatactgggatggtgaatgggttttcaggtagtaatcccacca

SEQ ID NO: 24411 - DNA, 1025 bp, Homo sapiens
atatataaacaagtattttcaaagatcccagtatacacctctgggggtccatgagtgagtcttgcctgtttcccatgtcttgacttctcaattgctttgttggggagggaacttcctattgctgtggggccctggttctggaattcatgtacatgacttagttacagaaatcaaattactttttttatggtgcaaaagtaaagcattcctaaatgaatatttgccaagctgagtgactggtgaggtcattttcaatgggagactatattccatcatggctggcttcagtctgatttattgccatccactcctgaagccaagccagctgatggaggtgctggcaagagctgtgtctccaagcccattgtggagattgagtcggttcccagccatggctgagcagccaggccagtggcacgctcatttggctgcactttgcaggggccatctgataagcatggccacatgttcatatcaggtgtgccaagagaaatgctaccttgtctgacacaaaatagaattgctggagaactttatcttttgagagaaaatatctttagagtgtcattgccctgaatggagcccttgctcgtgaagttgataatcttagggtcggcaaaacaactgggtaaggagattgaatcagtttcctgtaacttcctggggtcaacagatactcatgttctttgaggtttctgagagtttttataaacctactttttcttctatttttttctttcctttttttaacctttaaaatggcaatggcgatggatttagatgcccttaatctatcagatgcctgtccagaactagataaaaagttaatggacctgtgttctacaggttgttaaaaacaagtgtcatctcaaacaacacctgtcatctttgctatatagaattagtgtatggaaaagtgagccttaataaaggctcacttcctaatatggtcagccattgctctgaaagaactgtcttctgtgtgagctcgcatgcaaactcctgtctctctctctctcttgcat

SEQ ID NO: 24412 - DNA, 1024 bp, Homo sapiens
tcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggagtaaggagattacttttcaattttaaaatcagaatacaaaaaagaaattgtaaactcttaaagtattacctctattagtgtataattttttgtcgaggaaaatgaaagtgataattcactaaacaggagataagaagattattttcaggagctaaatacatacactgtgaaaaggataatatgttttcattgtcgctgaaggctccagaggcttcataaatgaatgccagaaaattcaaactaaggagcttattctttgctattacaggtgcttccaacatctggagcacaaaacattattgactttcctaattccctgtctcttgctgaaattcataccactgcctactcaacatcaatcttgctaaatcttgaaacagggcaggttcctgtttgtaattcaatttggatagaataaatttcctgaaagccctgagctgatcctttttcaattagccaactttcagctgagtctgttaactctacttgggtttttcatttcactgaaatttgcttctagctccagccctcctgtaatcccttctatattggcatagctggctgagcagggacgcttccatcccctgcagtcacttaggattactgcccatggagacttcccacccaacagtcaagttgccatgttgctatatgtcgtatatttccagaaggaataccttgaatgaacattctagagctcattgagatgagagacatgttaaaacaatatatggtggctcccagcacttcgggaggccaaggtaggtagatcacttgaggccaggggttcaagaacaacctggccaacatggtgagaccctgtctgtactaaaaatacaagaattaaccgggtgtggt

SEQ ID NO: 24413 - DNA, 1057 bp, Homo sapiens
cccagggtcctcaaaaccctgtcgcttactacgcggctttttgctcatttctctctacttccttgctgtttcttgagtagaataggcacactccccctcaggacctttgcattggttgtcccatctcctggaacattcttcttttagacttccccatctcctccttcaggtttttaattcaaatatcatttcagtgagactgactgtgacctcctcttttaaaatgcaactccttccttccccaactttctcctccccttccctgctttattttcctccatgactttattgctacccagtatttatgtttcacttatttttattttctttttccttccctggaatctgagacatataatggcaggaattttagctgctttgtttattgctggaactctaacatcctgaagagtggctggcacatagtaggcattcagaaagtcttttattgatagaattaaactagaatgaacaatattgcctattatgtttttaatccatgcaacaatgtagggaaggagactgttgtacaaatttaagattgtagaaacttctttaggccagtggcctcatcttactttcttgtgtcttcccagggaacttactcacatttttgggctttcaagtggcattcagaccataatgattgtcagtatcattgatattccaaccctgaatttctcccaggatttggggctcacagccatttttatttgcatgatcaaattgaatgatggcttgcagatcaaaaattttgcctggcaaaacaggaattttagaaccaagtcaattcccattcatgcagataataagcctgttggctgtagcaaaggatcagttaacttccatgtacaattttatttttaggacatgataaccaaaggagttatttgtgattgaaacttccattttggcctttaacttgaatcaggagggctcttgcctttaagttctgtgcagaccactgaggattaggatcagcctcgtggttccttcagtctgagtctcagctttcaggagtgttactcttctaaggagtccattccctcttaaattg

SEQ ID NO: 24414 - DNA, 1023 bp, Homo sapiens
tcggatataggctaacctcacctacaaatacagaccaaatacaggtcactgtcacggatccttcagttgctcattgttgccttacagcagtgaccatgcattcattcaacagatgtttgctaatttcctatatgtgccacactgtgctcatcactagaatgtaaagatgacccaacagcatggactctgccctgtggaaattacctgctagcaagtgataacttccatcttttgttgaatgcccactatgtgctagtcactaaactaagcaccttttttctcccagataatctttgcagcttaaaagaggtgagtttttcttatcacccttttacatatgaggaacctgagacttagagatggcaagtcatttgctcagagtcccacacctagtaaggatcagcttgagatcacgacttgcaagtccatagtcaaccctcatgaggccgactcctggtgttagcacccgtgtattgagtgagtcggaggactgaggaggtgctacatgttctctgtccttctccttcatggtatcatgctctgtttccacagattgagccatacatgccatatgaatttacgtgcgaggggatgctacagagaatcaatgctttcattgaaaaacaggtaaggcttatcagaagtcagtctgtctttgctgtgtactgcttcctgtgacgccatagggctctcaagaacatttaagagctcactgtgtttctgtggctattttcctgctttgggagactctagaagctggataatagtagcactgtcatggtcacccaagagaaccagtattcccttggagtaggtatgttcttgatgacagtgtaaggtgaaatggaaacttataacaagagagatgggatgattactgtgaagatgcccctgaccatcagggtctgtgccctgagtgggttctgaggcccattctcaccttaagaaaggcaagaattgaaaccagctttttctaagcattattttaataatacatgttcagcaattctaaatgttaggact

SEQ ID NO: 24415 - DNA, 1045 bp, Homo sapiens
aagagcacacccttttctaagtatttttgttggtcatggtctgttctcatagcacatctccaatttatttgatcttttccatcttctcttacttccattgcctctttcttgagctctagcaatcagaactccatgtataatatgcaagatttaaagctattgtagggcctggcatggtagctaatgcctgtaatcccggcactttgggatgctgaagtgggcggatcccttgaggtcaggagttcaagaccagcctggccaatatgatgaaaccccatctctactaaaaatataaaaattagctgggtgtggtggcacgtgcctgtaatcccagctactggggaggctgaggcaggagaatcacttgaacctgagaggtggaggttgcagtgagccgagatcacatcactgcactccaacctgggcaacagaacgagactctatctcaaaaaacaataataataataataaaaataaataaattttgctttttctcctgttcatttcaattcattgttatactctggtcatgttttacagaagtcaaatcagcatatgtttcattgtgaagtctaagcaggtgtttatagcttacttctctttctgccttttagtttaataaagcaataattaatccaacaataatcttatgcccaagatccattagcattacttggaaatactgcagtgctgtccagtagaactttctgcatagcgcaagttttgtgtatctgtgctcttcaatgtagtaggtactaacctgtaaatttgagacgattagcctagatgatttttaaattccttttaaactataaattacctggttgaaattttattaagatctcactatgccaggcactttatatttgtcttgttttctcaggtaaagtattctcctaaggaagcagacgcagttaccaagtgacttgtccgaaattaaaactattacgtggctgggatttgaacccaagtcctttgcttaatcccaaactgtagttctcactttttcctgttctagtatatttcagaagtagagcacagtagc

SEQ ID NO: 24416 - DNA, 1034 bp, Homo sapiens
tcacctgagctcaagagttcgagaccagcctggccaacatggtgaaaccctgtctttactaaaaatacaaaaattagccagtgtggtggtgcatgcctgtaatcccaccttctcagggaggctgaggcaggagaatcgcttgaacctgggaggtggagctttcagtgagccgagatcacaccactgcactccagcctgggcaacaggagcgaaactccacctcaaaaaaaaaacagaaaagaaaagaaaatagagggttttttgaaatgtatttgttcttaaatgaccagagttttatcttttctgcagataatatcgtctactgcattatttttggctgcaaaagtggaagaacaggctcgaaaacttgaacatgttatcaaagtagcacatgcttgtcttcatcctctagagccactgctggatactaaatgtgatgtatgtaaatactgggttttttatttttctttgtaaatttgaaactttttcataatgtaggcctaacaaaaatacacagttcaattagtggtgccttccaaatgctgcttgttttattacctcttaggaatgcaatgccaggaagcagtctggcagaaaaacatataatgtatgttcatgaatttggatgtcattctgaattatagaaggctttgattccaggtgctttgttgattcaaagatacttttgtttcatattttgttgttcagagttatgatatatgtagagggtaagtcctatcacctccgctggaagctgtatttgagaccagaatataaataactccttaaattgtcaacagatgaaggaacagaaaatcttctgaatttacccctagatgagtagtctttttaaagtattgttccttttttaatgcatgtactactgcttatctctctgatacataaagctgcattttattttgctttcatgagcagcatttttttagtattttaattttcctagagtaatgttcctttccagacaactttatcatcaacattgtaatagaccttatttgaaagaactgttttaa

SEQ ID NO: 24417 - DNA, 1064 bp, Homo sapiens
tattttatttatttatttatttatttatttttaagacggagtctcgctctgtcgcccaggctggagtgcagtggtgccatctcggctcactgcaacctctgcctcctgggttcaagcaattctcctgcctcagcctcccgagtagctgggactacaggtgcatactgccacacctggttatttttttgtaatttagtagagacggggtttcaccgtgttgcccaggctggacatgaactcctgagctcagggaatctgcccactttggcctcccaaagtgctgggattacaggtgtgcgtcaccacgcccggcctatcatatgatttttaatgtgacatagtaattatttaaatgttggtcatccttttctaaaggttatatctttgtatgcaagttcatttactgtcaccattcaccttactcaatttactgaaattgaggcctaagaaagtgatggcttatctaaagtcatatgttagttctggaagaacctactaggatgtggtaggaagaacatgggctttggggagatccaagttaaaatctgtaggcctctgacttgctttgtaaacttgggcaaaagttcctttacctgttgtacctccattctgtagaggtggaatagtatctgagtcatatcgtgaatttgtcatttttttaatttcattactccattcccagatgttgaatagaagtgcgataaatcagtcacaatttcccattgtgacagactcttcgttacaaaactagtttgtgtgaaatacatatgcagttgaccctcaaacagcacgggtttgaactccatgggtctacatggatttttttcaataaataatattggaaaattgggaatttgcaacaatttgaaaaaacttgtaggtgagctgtagcctagaaatattgaaaaaattggatatgtcatgaatgcataaactatatatagatattagtctattttatcatttactgccataaaatatacataaatctatttttaaaagataaaaattttaaaaagttaggcacacaaacagacaatatgtggctctattcgcagttaaga

SEQ ID NO: 24418 - DNA, 1771 bp, Homo sapiens
ctttaaattaagagcctattgaagaaacattagttgaaggaagtactagtatatgtttaaaaatattacttgtgaatattaacttaggaaattggattttcaggttactgttgtgaaatttgagtcaactttaaattctttatcagagattaatattttttgtacaagttctcctacaactaaaaattctagagacatgaagtcagtttacttgaaaaatgaaatagtaacttttaaaacatttacaaaaactacaaatttgatatgtcatccaaaacaaatatttagaccagattatttgttgttgttaatgttaaaatgtgactgattctttgagtacaaaccatatatatgtttaatgtcattttgtctgactaacatttcaggtaactagaatatatctcactccattttaaaagtactgtttcatgttttagtgtctttttgttttctttgctcttttacaacttttagctaacagcatttcccctctattctctgttgcacagtgactgtttctggatcactgaatttagatacatgcctaggtgaaaactgctaatggcattttttaattattattttttccttctctacgtatttttattcggagggggaggggaaaataaatttgatttctgtgaagtctttttctcccctctggagatgagaaagttggtattatgctactttgctgcagaattggctaatgtcattttacagggaccttcacttctgtgatttctccttccctccccaccaggaaagtcacactgcctccaagacatctgatgctttgacactcttccttagcacaactctgctaaaccccaatcccttttgtaaaacctttatgttgatgatccacatggggcagcagggattacaggtgccatgaataaaaaataggggagggggaaagaaatttgaggacggttagaggggtggagttgagataaactgatcctaggtgagcagaggggaaagatatgtcagtgcttgtggatgtaattgggaaaaagggaaactataacaagagcatccctgttgggaagactaagaggcagaataaggggagggaaaacttttcagtgtcttaagctaattaaaaattgcctttctgttgggtatcagtgttgaagcattctgatcctccctagaatacctgtatctttcctaagttagtctttaattagattctgtaatttgaactaaaatacagtggagcctcctgtatctgtacccgtatgctgtttctaggtttattctctgttgatgcttaatagcatgatgaaaaactgagcagtttgtgctctgtgttttgtggggtgggggtttgttttgttttgtttttgatggaagtatttaagccaacttaaatatgactgaggattaagtctggcaggcaactctttgtattttgtattagacttcaaaatcttttcttcttcttcttcttttttttttaaatccaggagaatgctttattgcaacttttagctgactagatgcttaacttagtaacaagtttagcccttgtaactggctagctaaaagcaaatcggcttgtttctcagatctttgggggatagcaagaaacatttgagtgaatgttgttgaagattttcagtagtatagaaaatgatggcgctcttgtgatatttgtaagtagtaagtaaaatttactttttgtgtacaaatctttgaagtttttgttgtgttgagaactttttgattgtagcacgttaaggctgatagtattgtcttcgtt

SEQ ID NO: 24419 - DNA, 1932 bp, Homo sapiens
tcattgttttagtttaatagtcactagattaagattaggtaggcaaaatttttttttcggggggggggtgggggacagagtctcagtcgcccaggctatagagtgcggtggcgcaatctcggctcgctgcaccctccgcctcccgggttcaagcagttctctgcctcagcctcctgagtagctgggattacaggtgcctgccaccacgcctggctaatttttgtatttttagtagagatagggttttcaccatgttggccaggctggtcttgaactcctgacctcatgatccacccaccttggcctcaaagtgttaggattacaggcgtgaaccaccacacccagccagtaggcataatcgtaataaaaatagtttatatacctggtgctgaagtaaaaagatcacagaaaagtaatctgccttttatcctgtctttaggtcagaggttaggttgtggtttatgtggggttttttgacacaggaggagctacctcatttccattctgaaaagtaaagtttgttaatttggagagcaattgaataggaatcttggagaactgatatgttaagactttcaccatgttttgcagcagcttttttttctgtgtcagtcacaaaaaggcaattcaaaattaaagacatgaaggtgtggccgggtgcagtcactcacatatcttgagcacaggagtttgagcccagcctgagcaacatggcaaaaccacgtttctactaaaaatacacacaaaccgggcatggtggcgcactcctatagacccaactactgtggaggctaaggtgggaggatcacctgagcctgagacgtcaaggttgtagtgagctgtgataatgctactgctctccagcctgggcaacagaggaaaccctgtctggggggaaaaaaaaagacatgaagatttatctgaattgtagagtgaagtgatactactattcttattacttactgaaataattcacttaatgattgtgttccagaaaagaacattggcttagacagtagctttgagagagaagggcctctattttaggcacatactgtgatttttgtgcatatagctaattaattatgttaatggattatttaacagattcttttgttgttctgctataaaatttaatacagtaggatacttaagaaaaacaaagcttacattttgtgtacgagattttggaccagaacttgaagtgtatttaatgttttacaaccaagttgttaacagaaattgagtcaaaacagttttgttaatgttggacccaaaagtagaaaaatagtctttttttttttctttttttttcaaatgaggaagtaaaggtctgggcattagggtttttttcatccaaactggatgaaaaagctcatgagactttagcagggactagtcatgacattgtcaaggaaattacatcttgaaagattaatggttaaattatagcttgtctgaagtgtcgatcttaacattggcttagaatagtttacaaaaaagcttgctattacaaaatgaacctgtagtctctattaatagaggttcccccagtattgaggtggaattggcattattaatattatataatattctgatgtatttgactgatgaatatttgagagtggctagtaactattaatgacattattagttcatcaaaaccacactactttggaaaagtgggtcatttgattgtaatcagaattttaagaaagttggtagaaatttacaatgaagatagtttgctaatatattaatagtgttgatagctaggaagtatatttggaggaattttcccctttaaaaaaaaagtctgggtgtggtggctcacacctgtaattccagcactttgggaggccaagataggaggatcacttgaggccaggagtttgagaccagcctggtcaacatagcgagaccctgtctctg

SEQ ID NO: 24420 - DNA, 1787 bp, Homo sapiens
agacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcat

SEQ ID NO: 24421 - DNA, 1047 bp, Homo sapiens
tgcacacaaatagggacagttttactttctttccaatttttatacctttatgactgttattgtactatcccagaccttcagtgacatgttgagtagaactgctgcaagtagacatccttgccctctttaaatgtgaagtggggggaaatgttcaatgcttcaaaacttaagttaactgtaggttttttaataggtgtccataagactgagtaaattatttttttagtttgctgaacgttttttgtttttattgtaaatgagtagtcaagttagtaaaatcttatttagcatctattgagataatcatatagtttttcttttttattttctgaatatggtaaattatgttgattaaaaatttttttgttgtaaaatgtaagatttaccattttaacgatttttaagtgtaaaatttagtggcatttagtactttcacattattgtgcaatcattactaccatccacatccagaacttttttcatcagctcaaactgaaactacccattaaacaagaactctttccccaccctcagtcccctggtaaccactcttctactttctgtccatgaatttgaccatcctaggtacctgatataaatggaatcatacagtatttgtttttttgtgtgtgtgtctggcttatttcacatagcataatgtcttcaaggttcatccagggttatagcacatgtcagaattttcttcgtttttaatgctgaatattaatattgtatgtatatatcacattttgtttatctgttcatctgttgatggacacttgggtcgcttctaccttttagctattataaataatgctgctatgaacgtgaatgtacaaatatctgtcaggttcctgctttcagttcttttaggtttatacccagaagtggaattgctgaattatttgatggtgctatttttaactttctggggaactgccatacttttggctggctacaaattttgtttttgttttcctgaaagattttgccgtatttttgaaggatagttttgctgaagagtgctggcttgatgcttattttttt

SEQ ID NO: 24422 - DNA, 1054 bp, Homo sapiens
cccacctgggaccccttccttgttgcttactaatcaggactccacactttgcatcatttagtcctcaagtttttaacgtttaaaaaaaaatgcttctggaatttcagtaaaatgtaagaaaagttaagtaaacactttaaaattatatggggaaatattttggggcaaggtatctgtctaagggcctagaaggctgtcctgtggagccagtccccactgtttcccttgttctttcttttctactttttgagtaacaaattctttcattaaaaaattttagagacctttaattacaaaaataatgtaaccacaccaaatgatgcatatgtataaaaaagtgatagtcccttcctcatcacttctccattcatctacttttcagaacaacttttaacagttccatgtgtgcacattataccttgaaaaaaagatgagtaactttttattacagttatctttttttaaaaactgtatcttggcatgtttgcaagatagaacataaacatctattgttactttaattcttgctttgtagtctgttgtatgattatcataatgtgtttatacatgttcctattgaagaatatttactttccagtttttgcagttaaggtactgtggtggtaagcattgttctacatactcttgcatgtttgcctttttttttttaaatttttttttatatttgcctttttttggggggggtcactatttccttcatatgggggttttcctcaaatatctgacgatctctatctactcatttgagagtgaggaactaaaattcgtgggagtcataggatcaaaaacttttttatttcattgtgtggtcacagagtgtcagtctctgtaggcattttcatttgagcccaccaatctccttgtgaatagtcttgcatatttgtatgaatatttctgtaacagatttctttttttttttttttttttgagacggggtctcactctgtcgccaggctgtagtgcagtggtgcaatctcagctcactgcagccttcgcctcctgcgttgaagtgattctcctgcctcagcctcct

SEQ ID NO: 24423 - DNA, 1055 bp, Homo sapiens
ttgttagatcacagtgtatatattactgaaatatatggatatccagtatgttactggttaacatactggttaggaaatattttctagtacctttggaagttacaggggttattattaatactgaacaaaggtaacaccctaaatacatattaagcatgtagatactgttaagtaccggggctgcaaagatgaatagaacaatagtctttgcttttcacaatctaggggagaaatagacatgtaaataaataattagaataaggtatcgttcttgtatttgaacaagatgctgagaaataatcactaactgtttgaaaataatcaaaggcagattttctataggaattaatatttaggttgagttttgaagaatgagttaaaagtatactgaaagaatgaagtagagaagagcagtaggaatagcctatgcacaggtgtataaagaaagcacacctctggggaaaaacaagttgttaggcataattgtaatacaaggaagatggaaggtagctgtaggggtaaaactggaaaggaaaagggtcagatctgtaagctttgtatttccaccaacgtgagaaacttggctatcttggaggtgctcgtgttgaaacatttgtatattataacttctaattatgttacatttttatatccttttaatgtcaggtttttaaaatttttatacaatatgtgtaatactataatacataattggaaataaaaatatatggaggtgtataatcagatttttactgatagaggtcactgttacagattatggaaagctgttgaatattttaagtggaggagggaacaatagcagatttgtattttaggaagataaccacgtggaagaaggatggaaggctattaaaacagtccaggaaacatattgtgaagggcttaattaaggcagtgatctttatcttactgaggtctttggccctccaaagttatggcttagactctatcttagttacctaatgtttattgagtaggttgaaagataagtggaaaggatggttggtgccaaattatgataattagtaccatgc

SEQ ID NO: 24424 - DNA, 1624 bp, Homo sapiens
ttagcaagtggacccccagatctgaggtgttgtttactgcatcagaaactacaggtaaagatttctcaatgacatggataaatgtggtcttgatttaatcagattattctaatactaaatgtaataatgggttacatgctgttctcatggtgctgctgtaggttgcctatagtcagtagtcactgcaattcacaaggtcctgagaagtggagagtgaaaattaaatattcaagcagtaggtagatttttatttttctgtaactaattcaactataaatgttatttctcttttcttaagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggtaggatgcactagttctttccattttaatttattttgtggtttatataacttcatcctagtagaagatagtgctttgagtaaggaaaattatccaaaaagtctatgtttaggccagatgcggtggcttacgcctgtaatcccagcactttgggaggctgaggtgggcagatcacctgaggtcaggagttcaagataagtctggccaacatggtgaaaccctgtctctactaaaagtacaaaaattagctgggcacagtggcgcacacctgtagttccagctactggggaggctgaggcaggagaatcatttgaacccagcagtgggaggttgcagtgagccgagattgcaccactgcactccagcctgggcaacagagcaagactcttgtctcaaaagaaaaaaaaagtgtttatgtttaaagataaagatatagactgtttaaagaaactaaaggtaaggatttcccaatgacatagataaatgtggtcttgatttaatcaaggacctttaaaagattggacaaagtctatgtttaaagattaaagaaatctaaataaacttttggggcttttaggtttgccatttctgtaattgagaaatgttttgaagtttaagtagatcacgtcatcatatataaggtgatttataaactgagcagtgaatgctcagatgtttaaaaaagaaaatccaactgcacttatgtatgtttttgtttaacttgtggacaaagacttatggataggtgcaaaaaataaatcctcttttgcaacccagaactcattgttcagtatgagttttgatacatataagaagggatattatgatacctgagacagttaactgatgggaatattgatagccataaaggttggtcccagaccaggcacaatggctcaagcctgcaagccccacaccaaggtgggagtattgcttgaagccaggagttcaagacca

SEQ ID NO: 24425 - DNA, 1023 bp, Homo sapiens
atgatgcttttctctatgctgctggacttcattcttactggtccacgcagatgcaggcggcctgaggccagtgctgtaccaagtagaagacggttcctaaggacagagtttgtctgttttctaacaaagaaaaattctacaaaggagaggttgggcgttacaaaggcattgtgaatctaataaaaggaaagtgtcgctttctgtggcgttttctttcattttctcccgctgaggcatttcagtctaatttcatgtggttttgtgctgtctcagctctaatgtttgcagcctgctgagcctaacaaggcagtggtctcaagaacattctttgtgcctttttaaagtactccattttatttttatgatagttatgtatttatttcacagatatatttaagtacccactttgtgtcaggtacagtacaagcaatgaagataaaacagaaaccaaaacacactcccttacagggaaaactgacaccacgttgccacaaaatgttgagtatagtcaactctgctgtgtggatcggagggcctgcatttatcctacaaataattgaatgtaatcctacattcatgtattcattggcagtacggagtaataaatgcagcaatgtcataaagtgttgtaggagtttcttcacccaggctttgaggatcaggaaaattaccccagagggtgtgattttgggattgagaccagaagctgagtaggcactggggaaagcatggggggcgtatgggaaatggcttgcagagaaccaggcattcctccagccctgtgtgcaatgaaatcatgattttcattgtgaagtgctttatttctccacctcttcaatctggtctcggccatgtctttctttggtcaacagacagagacttgacaagtccttgcacattggggcttgccctcccttcttgccaggagccttgaagccactgtgaagaaggccactctagggtgagagttggggcaaaaggtaactgacaggagggggcagaaagcgtattacaagcagagga

SEQ ID NO: 24426 - DNA, 1090 bp, Homo sapiens
aagtagctgggactatagtcacgagccatcatgccagctaatttttgtatttttagtagagacaggattttgccatattggccagggtggtcttgaactcccaacctcaagtgatctgcccacctcagcctcccaaagtgctgggattacaggcgtgagccaccatgcccagcctaggccttcattttagtgagcccttattttattttattttattttattttattttattttattttattttattttattttattttattttacttagagtctcactctgtcgcccagggtggagtgcagtggtgcagtctcggctcactgcaacctccgccttctgagctcaagcaattctcctgccttagcctccctagtagctaggattacaggcatgagccaccgcacccagtgggttctcattttaaaaacgttcttgggaaagatgcttccttcatacagaactactgagtatctgtttgttttttactgggaacaacccaaatgtccttcgctgcgtgaattattgaactgtgatacatccataccatggaatactatgctgccttaaaaaaggaacaaactgcagtcacaccttgtttaacattagggataaattctgagaaatgtgtcattagagagttttgttgtgccaacatcatggagtgtgcttacacaaaactacatggtatatagccttatagatatctaagttatatgatatgtatggcctgttgctcctgggctacaaacctatacagtatgctactatactaaatactatagacaattctaacaccatggttaagtatctgtatatgtaaataaagacaaggtatggtaaaaataaggtgtaaaatatttttaaatggtatacctaaggcacttaccatgaatgtggcttgcagcactggaaattatggtaggtgagccagtgagtgaatgcaaaggcctcagacataattgtacaccattgtaaactttataaatgctgtatacttgggttccactaaatttataaaatatttttctatctaaaaaattaacttgtttgcagtaactttttactttatgaattttaaaaaatttttaaa

SEQ ID NO: 24427 - DNA, 1053 bp, Homo sapiens
ttaaataagtagaaggaatacactctaaaataatgataagaagtgtagtaaatgcataaatcagtatcatagtcatttattaccattatcaagtattacgtgctgtacatatgtatgtgctatactttcatatagtcatatgcatatagcagtgcagtaggtttacaccagcatcaccataaacacgtgagtaatgtgttgtgttatgaaggctgtgataatccttaggtgctaggaatttttcaccaacatagtcttatgggaccactatcatttatgcagtccattgttgactgaaatgtcattatgcagtgcgtgattgtattgatacagcaactagaatggatcccaaaagaattgcaggcacacctaggagatactgcgagttcagttccagacaaccatgaaaaagcgagtcatatacatttttgggtaccctggtgcatttaaaagttaggtttactactgatgttatcatttgaaaaaaaaaagagttttatacaattctgtagtctatttaaagtgtgaagagcattatgtctaaaaaatgcacatatcttaatttttaaatattgctaaaaaattttaatcatctgagccttcagcaggttgtaatctttttgctggtggagagtcttgcttcagtgttggtggctgctgacccatcaagatggtggttgctgaaggttggagtggctgtggcaatatctgaaaataagacaacaatgaaaacaatgtccacgttgatggacacttcctttcatggaagatttctcgatagcatgtgctgctatttgaaagcattttacccccagtagaacttctttcaaaattgtagtgaatcctctccaattttcctactaatttacaactaagtttgtgtaatattctaaatcctttgttgctatttcaacaatgctaacagaaatagacttaccaggagtagagtccatctcaagaaaccacattctttgctcatccgtaatcatgaacaaataatgatatcatgagcagcaattcaagcacatcttcaggccccatttctgaatctag

SEQ ID NO: 24428 - DNA, 1036 bp, Homo sapiens
acttttatctagccaatgcatggcagtaggttagtaggagatgcaggcaaactgacaagtttgtttttcctcatagaaaattagaaacaaaattagaagtgggagaggctgcccgctgtagctgcactagcagcaggaactgataactaaaatcaaagaaggaaagagaattataaaaggtattaagtagtttaaaactattcgggaccatttagcacagaataaattgtccatgtacctagtagaatgaaaaactgccaaggttattctattgcactctggtattttgtttttaaaacaataatgaaaaaaaaacagtgcaacagtcatctagaaaatatacttattctttgactatgccaagtaattaagatattacgaaataattgagtgtacattaaaagttaaatcacgttgaattgcataggaacactgatagttatttcaaactcacattagtgaagtagtatataatttatagttttgtcgttttacattgtggggtattaggagaatcttttcaaatggaattcctagagtgattgctgtttgagatcggggggtgtatctttctggtttctttctagttctatagctttttaaattttttgagtgaaatgtcaaaaattattgtaaactgatttgagagttgttttcattatctgattcattaagcttcagattttaactcagtattaccttgaaggcaaatgtttattttaatatgaaaatgatagttcatttgttgatgctagtatttatgactgtatcataaattaacatgagctgcttagagtctaattgcaaaattgaaaagttagcataaattatccatcatataaatgaaaaataatttcagtttatttagtaaagaagtttttgtgtctaatgtgcaagggattttgctttcagcattgtaagatttaatagtaaaatatatgctgtaataattatgaaagcatacctacatctcttttaacttatggcatgacctaatccagaatttttttttcttttttggggggtgcggggaggg

SEQ ID NO: 24429 - DNA, 1070 bp, Homo sapiens
ttctccctcttccccagtcctcagcaaccactacttttctgtctctatagatttgcctattctggacatttcatatatgtgtaatcatatagtatgtggtcttttgcaactggatgctttatttagcataatgtttttggggttcatccatgttgtagcatgaatcagtacttcattccttttcatttctgaataatatgcgtttgaatggatatatgacgttttattcatcagttggtggatatttgggttgtttctgttttttggttattgtgagcatcactctgtaaacattcttggacaagtttttatgtagatgtatgttttcatatctcttggttatatgtctaggagcagaattgctgggtcatattggtaactatgtttaaccttttgagaaactgccaaacagttttctaaggtggctataccattttgcattctcatcaagctgtggattaggggtgggcccctatttcaatatattaataactggtgtctataaaaaggggaaatttggagaccgttattcatacaggaaaaatgccacatgaacatgaaaatggccatttacaagccaaggatagaggcctggaacagatcctacttgaccattttaaggaaccaaccctgccaacaccttgattttaccctcagaactgtgcaaagttaaatttttgttgtttaagctacccagtttgtcatactttgtcacagaagccctcgcaaactactacataagtggtccatgtccattctgtcctagcaaataggcaaacttcttttgttttgatgacacacactcctgctgtgacatacagtagtaaacttaaaagtaaaataagtcgggcgtggtggttcacgtctgtaatcccagcactttgggaggccaaggtgggcggatcacgaggtcaagagatggagactttcctggccaacatggtgaaactctgtctctactaaaaatacaaaaattagccaggcatggtggtgcgtgcctgtagtcctagctactcgggaggctgaggcagaattgcttgaacccaggaggtggagattgtagtgagccg

SEQ ID NO: 24430 - DNA, 1077 bp, Homo sapiens
ataattctctgacctttcatttgctacacaagttcagttatctcagtattaaatgtcatgtagggtagtaaagtatcttccatgtgtaatgatgtgtctgtatgctgtaggaatacataagcaaatattgccttctactttgtggcccatgtacttgcaaacaaaaaatctttcatttgatttctgttagtgattagatgactgtgttacagttaccttcagcctctcaagaatctattttgtataacttaattagcagctgaaaagaggagagaaaacttgtttatatactcaaagggaaagaagaacttttttggaaaaacaaattatggattgcattgtgcatcccacacctaatgctagaatcagttcccctttacaactgtctgaggacctaggataaaaattagttctcccaaagttgtagaaatgagcacaagaagatagaaattaagtaattcacagacttcgttgtagagattatgtgtaataaagcttcttgccagtattgacaaagtccttgttgctcttacatgccatcaaatgtacaattttattgttccaggtcctttgctcttttatttagctttgttgtcttaattttaaaactattttcgtttttaaaaaatcatctagcctgaagtgtcacaaaagtattttcaacgtgtgtgttgtagcctaatggtgggaagactcatttaggcaatgacttgatcaaaaattgcattttgacccctcagaaaagtcaatatacttattagcattttttatttacttttcttgaggccaaaaataactatacattgttttttaaaacatgcctatactgccagaaattcctggagttgcgacatatttttttagttaatgaggaatataaaatgtttgttgaaaaatgtttttcaagtatgtcagattcagataaattgggtttcatcaaattaaaaagttttatattttataggatgccatcaagaaagtgaaatattttcacagatggaaaaaaatattcacaaaccatgtatctgataaaagatttacaggatgtttactagcaaaattttattttattatttt

SEQ ID NO: 24431 - DNA, 1012 bp, Homo sapiens
tggtatgaagaataaattagaaggcagcagaaccattttaaaggctggagaccagtaagaagcctcttggggaaatctaagcaggaactaataatggttgcctatattaaggtagtagtgaggatggagcccagagatactgtatgaagaaagtggggtataagatccttgagagcattgtctgtcctgtttccctgtagatccacagtaggggaactctcatgcgtccttccttatactcataattccaattccatttcccacctgtggaacatttcactttacctttaacggtcttggtgccttatttctataattatctgtgtagtctttgaggctggaactttggatacctcatttcaccattggttgtggactgttgattgacctcacctgactgactaataccacaatctttcctcaccacttattaatagtatctcctctctatgacatgttaagttgaagaggatgatttaggattgtttatttgcttaatgcttgtttacttgcttttggtgagtggtgaacaagagtagaaattagtatttttgcccctatcccagttgaccatgccgaatttcctacttctagtggcatcaacattcttttatttatccaggttttcaagtttctgaatttttattagccttctaagttttactttgaagtatctctccactgtcttcatttttctttcccagttaactctctgaccttaactcatggtaccttatgtctaaattattgtaaaatctctcagtttatgttcttaatttctttgcatcattatcctcaacttagattcataagaagtatattgactctaagccttgacatcaaattatcttggtgaattgatttttcctcagaattttaaggactaaatgagataatagatgagtgctttgtaactgtatatcccatatctcttgatttattccctccttttaaaaatccttccatcttgctgggctcacacctgtaatcctagcactttgggaagcccaag

SEQ ID NO: 24432 - DNA, 1026 bp, Homo sapiens
tccttttcctgccacattcccttcagtatcttaggataatgtatacatttcaggcttattcaccagtttgtacttctgattacattttctcatttcatccactttcagattttccttcttattacctttcttccctcctaaacctctagcctctccccatctttccttactggcttctgtggcctacacactttttcattctgacaaccttcctctaacttcgcatctcctggtaactttattaccaaatcatgtatactcattgtgatcttccactttcctcctcaatccttaagggttcagtgttccctagggattctacaccccccccccttttcaatgaaggcttgtgggcaacttcattaacattgataactcaaaacttcaatctatatagtgattctccaccaaataaataacattagctgacttctttcctgagctccaagtctatatatccaattttctgttagatttctccacctgaatgtcctgaagataccttaaaattaactgtaggcaaaactgaaatcatcgttctgccatcaaatccattttcctcccagatatatttcctatatttagtggtagcaagcactacctgcaccttcagtgtgtcctctcataactcttccagctctcacagcccttaccttttccctgaccactcatgtattgaattggcttcccccagttagttacttgctattatattaatctattcatttctacatggagtacaggtagtggctgataccaagggctctggagccaacactacctgagttcatatcttaactctaccccttactagtcttgctactttgaaaaagctgcttaatcttcctctgcctcagctgcaaactatgtaatactgcttttatggggattaaatgaattaatacacttaaagcattgggagtagtgcttagtaaataataaataactctttaagggtttgctgttaatattaccagtttcacagcacatattgcaatcagttattatcttgtatattttgtctct

SEQ ID NO: 24433 - DNA, 1049 bp, Homo sapiens
tgtgcctacttttagatggttttggctcacctgctaaaagatcaatataccttgagaaaagtagtttacctgttagtttgagtctcatatgtagggcccctataaaggattagtaacctttaacttatgaccattataaaaatatctaacctcaattacagatttgaaaatttgaaagcttggataagctacaatgtggaataaaaggcagaaggtataaatcttaagaccttaggaaagttgtcattcttgtttttttaacaagtgctactaaaagcagggtatcttttttaaaataagtgacccagataatctaaaaatcctctgcaatctatagatgtacgtcttaaggggagagaaagcctaaatttctatcaattgctagtaaaattgttagattctgttatttcatgcagatagtggaaatttcagtggcagtgcatttcactgaagaacaattgaaatattcttatacctgctctttagctcaaacacagaaaatcaatttaaatgtactgttttatgaactccaaataagttgcctcctttcttgtttgtttgtttgtttgtttgtttttgagacggagtttcactcttgttgcccaggctggagtgcaatggcacaatctcggctcacagcaacctccgcctcccgggttcaagcaattctcctacctcagcctccaagtagctgggattacaggcatgcgccaccacgcccggctatttttgtatttttagtagagatgggggtttctccgtgttggtcaggctgctcttgaactccctacctcaggtgacctgcccacctcaacctcccaaagtactgggattacaggcgtgagccaccgcgcccagctagttgcctgcttttgattctcgtctttattttttttacagtaaggcaatatgtaaattataaaagttactgaaaatactgtctcacaataaccccaaaagcttggatgaggctgggcacagtggctcacgcctgtaatcccagcactttaggaggccgaggcgggtggatcaccttaggtcgggagttc

SEQ ID NO: 24434 - DNA, 1052 bp, Homo sapiens
gttggttaatgcaatatcattagtgctgtcttcttcctgggctatgtatgattctccggaggagctttttgttttaagaattgattgctttatagtgttacggaagtagatcatcattgctgttacttgggaacagaagacccaatgcagaggcacccaagttataaaacatacacagcacatccgttacatcttctgcctatttttaaggctaatcctaaaacaactagctgagttcagctgaaatttatattttgatggtgatttgcctatcgaaaggaatttcagtttgatatgaggcagcaacaagtctgtggtaatgagtagcagtcaacttcagatggcataaataatcctttttggtccattatttttctttctttcctgaagccagatttctcccaggttcttatctatgaatgatttaatttgcatggttatatttaattcatctatgccttttctgatttatggtcttttgtccttatagctgccatatcacttgctggaactattggttttctcccattttaaatagtctttttgtaaactaagtaaatactttagtatttttaaatgatcgttcctataattaaaagtaaattagtgaaaatagatgtgtttagaaagggatcttttcttcttatagggattaaatgttactaaaatgtgagtctgatttagttttcattaaaatttaaattttcatatcccttcgtctttaatattcttttcagttagtctttttccagtcagttatatcatgactaaagtaggatagtaaccattaagctatgagctgagctagaggtgaatagaactgttaattcatttaaccagtacctctcaacattactcagagctgctggatacacaagcacatatacattagcaggcattttgactaacattttgactggtgactctctaaggttttcaatacagtgtaacctcagttatttgaattatatgaatgatgtcaaaaagctttagagctgtctttatcaagataatcaaaagctaggctcagcagagatgcttataatatactt

SEQ ID NO: 24435 - DNA, 1065 bp, Homo sapiens
aaggtgacttatgaatggctaaccagaagcaaagatcaaaaccacctaacttggattgagaaccctagtctagggatgatattttgatctcttagtaggcatgcctttaaaagaaatgatgtacttagcatattttctgtgttttgcttttcagtttattgattgatagtgaaaagtatttttaaaccaaatacaatctaaggccacttaaatgaaatttattaaaactcagcattgtttttgttttagcactttgcagattttcttcaagcattcagtgaaaacaattttgatctcagtgtataaaactatcttattgattttttaatgaactcatttctctgtatgcttctcacctagatgtgtacttcccagatgtttaataaggtatttattcagccttttataactctaggagttgaagtggaattttatcattggtttctttagagctttcttaactgcttatcactattggaggctccctgactatgtgagtgtgactcactgaggaacccataacctccacctccactgaggctgtttactgctcttgatattgtgtgaaactcgtcagggttaccaccagtttaggagaagcatctctgcactggcccatctgatgaatagtagtcatacttctctttattgttgcagtcttcagtgatcatgattcactaactttctgtgctagatatagttcatgcttagcatagccatgcaggataacttccaggtccttaatctgttacccttaggagttgtctcgttgttagtttacaggttctcccctttttagtatgttactagccttgtattgtacatgtgacaaatgttcttccaaagaacattgaatacaaacattggtcattttagccaagttagaattttagttccaagctacctaaaatttaataacacagtccacgtcaaataatgtaaactagtatatgatataatttcaaaaggtatcaaaagttattctctattcgtgggaacattggttgtggtactgctcattagctttatatacactggtgttttattcagaaacaattttctgaa

SEQ ID NO: 24436 - DNA, 1025 bp, Homo sapiens
tttgtaactggtgttaggcatatcacttaaagccactgagtttcagttggactcatttgcaaagtatggaatttttactgtgttgtctgttgaagcctctgtgtactgtaaaactccataattctttgtgtctcatgtgagtcatttctagttctaaaaggtagaataatagagaattggtttgtaacagcttggcaaccaactgtcaataactggagtcaatgaaagcaactatttcaaaagatcagattacttaccagtttcactaataaagatttattactttaaacctttatcataaaatgtatgctttgaatactgtgaagtacactgcatataaggagtgtggtatagtataaagaaactttctgcaggtagtaattatagtgaagattttaggtttacaaagccctagctgttttctgtgtagcttttattattcttatgactcttgacaagtttgtagcttcaccatatacatttaatattttgcaataattggccttgttcctgagctgttggattcggggccgtagcactgtctgagaggtttacatttctcacagtgaaccggtctctttttcagctgcttcctggcttctttttactcaggtttccactgcttttttgctttttttaatgctgtatgaaggtgttaacatttgtttatatttttcattaattgtaatacctttaaatcatgcatcatactcagaaatagggattagaatttaagtgacatctttggcctaatataatttacctgttaaaaatttgtgaaagctattgcttatttcttttccaaagtagatttggatgacaaattcagtttggttttgagcttatctaaaaagcttaatgttttaagcataccaaactcattagcagaagtcaaatatgtctctccctattgctacacaactttttagggatattgttatatatgaaagcatgacatcaaacggacctaatacacctaaatgcatttgaagctacttggtctcggttcttaccaacgatataat

SEQ ID NO: 24437 - DNA, 1051 bp, Homo sapiens
aataattaatttaacatgagacaaaaaggaatgattctctaaatcttccctacctacttttgaattattcttcagtttagatttttacagcttttattcctcaagtaacttctaaacttttcccaattgtttttaaaaatccacagtgactatttttactgcctaaggttttgaatggctattgccaaacttgctgttttagatatttcttgaggccacaagcaacctatataacaagcagtcccctgagataggccaacccagtttacaaggtagaagaggtatgtgttggaagtgtccctctagcatatcctgtgtattttattttttgaataatttccaggtcttgggagtgtgctgactttggcatcttacgtggtatcagggacaatatgagggatattgaagaaaggatctttaaaacttgcatcctcctgacttctgtttttagccaaaatggagtaatatagactggatttaactcctaccttaaccaaaaagccagaaattatgtgaaacagtagtttctagatattggacatgggacattgaagaacagtaaaccctgagagggagaaacaaaagaagtgagtcttaggattgccccagcttagtgccacaagaatgtttcccagacacagctcagggagggggaacccaaccagagtctctgagttaggagatggagttgggacttaaggaagccaaggtagctagagtttacagggcagaatactgaagagaagagagctctagagatctctggagggacctccttgagtcttagttgaagagattggtgcatatgtttgcaaacactacttgaggccaggaaaagaaccactcaaaaggagcagacacaaacaatccctggaactcacccaaggacagtaatcatttgtagtcctaccagccactggcaaaacttcataatacaggaagcaacaagtagaggacttaaaaggacactatctcaatatggaggaaaattggtcctagattaaaggctgctctgtttggctctaagcttcctgttgcccgccccccaaaa

SEQ ID NO: 24438 - DNA, 1061 bp, Homo sapiens
aaatgaatgatcatccatagaataaaataagaattcatgagtccatactgataaaaatcaataaatggaaaatgaaactgtcttaccttagtgtaatataaagtgataaatgtagaatcgtgaaattaaaagatcaccaccaagaaaaccatcaggcaagagtcaccactagaggctacaaaactagtgggtgaaattctgaggaaaagcataatttttttttaaagtatctccctacaagatacttaaaactacaaaggaaaaaaattgtaatttacagtggagaaacctgataggcaccatgttaacaaagcagtcgaagtaaatatcaccaatactgtgatgagagatagacgtcaggttccttctgatgtgatccattgagaaggacacattacttctctggtgttcctttcccaaatatataacatgaactttttaatgaggagacagcagacaaacccaaattgagggacagtctacaaaataactgatcttccaaaacaaatcttcagaaatgtcaaagtcatgaaagaaagaagagactgtgctgttctgcttcagattaaagaagattaaagagccatgacaacaaaatgcagcccttgattctagtctggattctggacttgaagggaaacatttttcttatcttttgctataagggacattagtgggacacttggcaaaatttaaattaactgtagattagataatactattgtattgttaattttctggcttttattctactttgattatattataaaagtccttgttgttaggaaatagacactaattattttgggttaaaggaatatcatgtgaaattcactttcaaacagttccaaaaaacacagtgatatatatgtatatatatgggtgtatacacacacacacacacacacacacacagagaaagcagtgtaataaaagttaagatcatttgggaaatctgggaattcttttacaatcttaggaactattctctaatgaaattatttaaatatgaaatgttacagtatttaatatgaaaaaagagtgagttcgctgtatgtatt

SEQ ID NO: 24439 - DNA, 1031 bp, Homo sapiens
gtccaaacattcctagaaggcactcttgaggtaaatcagttaatttaaaaaaagaaacgagagatttttattaacaaatattaatatttggaaactctagtacaaattattggaatagttaaataaagttataggtcttgcctttcggggttttgtgtatatatatatactttcttcaattaagtttttactgatgagcatgtattacatgtatttagaatataatgactcttgaatgtttgcaggaagactgttagcaatctcacaaaggagtctctgtctgtcccttgacctgttccaaaatccagctagcttttttagagctttagccagttaatccccaagactaagtaggattagtgtcactctaggagtatgtagatactggactcatgaaaccaaaacacttacagattgcttagagctttcttcataactctgaagtcagaacttgtgattttcttaggtctaagatctcagtaataatataccaacttaatggaaaatttgaaagatgtctttatagttggaagacgtgatctcaagagtacactttggttcatagaactgttcaagtgggaaacgttttaggcaagtggtctttagttagtgacattttcatggatgaattaaagaatattgtagagttgatgttaggagacgagagattactactacttcagctaacaaattaatatgattttcaaagtattgtggctgtgtaaagtaagtgaaacaaaacgatattcatttaatacttgggaaggtagaataatctgacgagactgaagtaaaggtatctgttcactggctaatgttgctaggtaggtaggccaaactttgttaatgatagacgccattttctgccttttttggtgaatgtagaccacagaagcctttaggttttgagcagttgagatttattttacatcggaaagactggctgtatgagggtctgcaactctttgcttctgagttcgtgttgctctctttaagtgccttcgcttaggatactgccgatacaaaggata

SEQ ID NO: 24440 - DNA, 1031 bp, Homo sapiens
aaccagaaaaagtcttaatgaaataagaattatatttttctccttcaacctgattgctgtgaaagaaactggtagttgcaggaaaatacttgtgattggtacagtaaattttattaaaacaactcagtatttagaaaatacttgcattcatctagtgattttgtttgattttgttttacagtgaagcctgcctacagttttcacaaatctgtatcctttcagtaaagaatggcttatatatatacatttatttaccttccttttggttaatttatgaaatttagaaattattcatttttatttaggaaatcatacattcttttttatggaaactttattactaagtgtcctcatttaaaaaaaatgttattataggaaatttcaaacatatataaaagtaactcaatggtgtagtgcaccccatacattgagataatatattgcagctaaagataggatagggagtttttaaaatgtgaatatctgaaaaacaatatagatcagttgggttggaatgttacaagtagcttgcaagaggcagctggcagcaagatggatagaaaaggaagttatgatagaggagaatgtagtagattcttcactagaatatacctcataaattaacatgtcacatgtattaatactacaggtataatgatgcagtacttgaaattatttaataaatgttagattatattgtgaaaatcacaaagatcatttgttttcctttgttaccaatagtgtttcgtaaaactatcctttcgtttcacatgaattgttagacttcattaaactgtacagatcctgtagtgtgtgttccatccagtttctttattggagacagtggaattcccttggaagtaatagcaggaagtgtttctgcagatgaacttgttacaagaattcacaaggtccgacaggtaagaaggaacagaactgttgtttccgtaaatggtacgtcaggaattggatttttttttttgagatggagtctcgttctgtcgcccaggctggagtgcagtggtgtgatc

SEQ ID NO: 24441 - DNA, 1045 bp, Homo sapiens
tcacctgtttttgtaaatagcatgaagttacaggtgccagtagccagtacctaatacttgactgacttctttacctttctttatttttttatttttttgagatggagtctctgttgcccaggctggagtgcagtggactgatctcagctcactgcaatctctacctcccgggttcgagcgatttttctgcctcagcctccccagtggtgggattacaggcgcatgccaccatgcccagctaatttttgcatttttagtagagacggaattttgccatgttggccaggctggtcttgaactcctgacctcaagtgatctgcccgccttgacctcccaaagtgctgggattacaggcatgagccaccacacctagccatcttttaccccagtctcaacacataatgaatatcaccataactttgttgaaagagaaagttgctgtcatattaaggctctaactatatattgcttaatatattttaaggacgttatactcaataattaatcatttctgtctactttggacaaatggctggtagaagtttgtaacttttttctttgaattctaatttgagggaaaatcaatagtgtgctttaacaaatgtttttatggtcttgccagcttgcaggtaaattccataatgtgattatatcatacttaggattatacattttggattcatctatttatgagcatttcgtatttctctttttatagagtataaatcaacctgtattttggtctctactgccatggtaagtttagattcttatctattaattaaaatccaatttattttctgcctagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggtaacttttaatgtacctttttgagtgcaatagaagctccttcactacattttaatatttaa

SEQ ID NO: 24442 - DNA, 1032 bp, Homo sapiens
agagataaactagcctgatttgacaaataaattttgggaggaaaaattgataggatttagagatggatgagatttgggggtcctggggagaggaaaaggctgacttccagggccagtagttcttgtgcctaaggtgagagtactgggggaggagcagttttttattttgtagtttcagggaagggggaggtattggtcatttttcaattggagacttactaaacttgagactgagacatataagtagagatgcctagtagcaattggatgtataggtctggagctcagcaaagaggtttggactggaaataaatttgggaatagtgtacagtttataattgatgtctgggagtgagggatgagattgcttaaggagatagtatggagaagataaggggtcttatgagtaagccctatgaatctttcacatttgaactttggtagaaagaaatggaacaaaagaggctgagaaggaagaagctagaggttggaagaaaattttgttggtatcactgaagccaaggcaatagactgaaaaagaagggagtggccagttgaatattttgaatgcaactgggaaattaagtggcaaactaaagagcatacgctgaatttagcaacatgaagaaaattttatatttctggttgtcaatacacccataaactgtttgatgatgaattttgtattaatctgccgaagttacaatcctaaattaaaataaaatattaaatctataatatgaaccatatctgtcttcctgagttcagacgtgtttttagtatcatctggctgttctataagtatctaaaacttttcacagcttattcattcatagtatgtattttttaaatactcactatttatcagacactgaatgctagacttctaggtatgggattagaattcagagactagggaccatgaacgattaaacaaatatttgtttttcttgtgtgattagtgctgtcgtggcagtttattcaggttgccttggaagcacagagcaggggcatcaggggaggctttcaagg

SEQ ID NO: 24443 - DNA, 1051 bp, Homo sapiens
aacctgtcagactttgaagggaggttgccttttgcttggggcagagagctcacactacagaatagctatttcacttatgcctcaaggacccaggtaagtaaactataaggtaaatgaaggtatttgttcacccccacccttttttttaaaactggggtcctgtgtaaatatattaccaacgccagttacttcagtgtacacatccctcccttcctttcccccagctctgttggcttcccctttaaatagaaatatatataactaagaagaaggaatattttttcctgtccttagccaatttttttttcttgaaggttcagctgttgccattactgcatctttaaccaccccctcttcttgcccctgcacattcttttctatagcagtggtgtccagctctgccacttagtctaatcagtcttctgaaagacacagctgtttctatttcagagacgagcctatccatttagtacacattttagtcaactttaagtaaactggttttgagtaattaaaactacaagatggactttctgttttcacgtgtaggtcaaaattagctattccattaattctctcaaaacacgtaactagcccccttcctttttcattttatttttaaaccaacactgagtgttgtgctaggctttgccttacagaaattaataaactagagatgatattatacttaggtaataccacagccatgcacataaactctatagtaaaagacaataaatgaagtagactaatgagggtgtatattagtccgttttcacactgcctataaagacatacctgagaccgggcagtttacaaaagaaaggtttagttggacttacagttccacgtggctggggaagcctcacaatcgtggcagaaggcacatctcacatgacagcagacaagagaagagagcttgtgcagggaaattcccgtttttaaaaccatgagatctcatgagacttactgtcacaagaacatcacgaaaaacacccacccccatgatttagtcatctcccaccaggtccctgccacaacacatgggaat

SEQ ID NO: 24444 - DNA, 1051 bp, Homo sapiens
ctgttgggtttttttttcctcctagcttttattcataagcgtctgttttttggcagcctgataattttttattgaataactgtcattgtaaaaattgtaaaggctccagatgataatcttttagacaggatttattttttcttttcttagacatgttagtgtgggagctgataacttttatccaatcagggactaaagtgaatcaagactgttttaaggctatttgtacatttgatttgtcttcatacagtctagttttactttacaggcatttcaatttagagtcttaaattcttgggacactgtctctggcaaatctcaactctaatccttgtcttgtttgcagtataagacgtctgaaaactttgcctcttggcttcctgctgcatgcaaagtcagcatttggcagaagtcttaaagagcacctcaccaggatcttagccccttggatatcctgttttatctccagcgccgtaaggccaacagaatctttgctgatagtttcaccccatggcagtggctctgtctgggtaaagtgtggattctcgctcttgcattatgcttagaatctgcaaatattcttggggagaaaagtggctgtagtctgtcagcccaatttatttatttatttttgttcgcttttttttttttttttttttttttgagatagaatctcgctctgtcgctcaggctagagtgcagtggcacgatcttggctcactgcaagctctgcctcccgggttcacaccattctcctgcatcagcctcccgagtagctgggactacaggcgcctaccaccacgcccggctaattttttttttttttttttttttgtatttttagtagagacggggtttcaccgtgttagccaggatggtctcgatctcctgacctcgtgatctgcccgcctcggcctcccaaagtgctgggattacaggcatgagccacagctctgggccttgttttcgttttttacttctgtaatgacttgaaatgtcagcccacctttaggttgttctcccttctctagaatcttgtgaccttttgtcc

SEQ ID NO: 24445 - DNA, 1046 bp, Homo sapiens
acatgattgggggctgcatgcaccggtaatcagaacggaacagaacagtacggggattttcacaatgcttttccatacagtgtctggaatctatagataacacaagcagttcagtcatgggttgatttttaactaccaggcccagggcgtggcatcgggctgtctgcctgtggatttcatttctgccttttagtttttacttcttttttctttggaggcagaaattgggcacaagacaatatgaagggtggtcttctcccttagaggcaggatgagaaatgttgacatccttcctgtcacaggaggacattgactggacctgttggaagagggaacacagtgcttatggctacaccagtctagagtggagtttctgactccttgagttaggacagagcagctcctggttcaaagaccacagactctcacttttctcatagtctctactaaattttcttgaataaatgtttcttcatttgttctgtgcttccagcagtgtttttatatttttcaccaaattttctggggagtatgtccatggaactcctcaagttgtcacgctgaaagtttttttcattagtggttcagtctctgctggttatgggggtctgttcacattttcggtttcctcttgagtcagttttggtagttccacatttgtgaattttaaaattttttcttctgttactgatttatagtttcattcaactgcaatcagagaggatactttgtataatttaaatttttttaaattcgtcgagacttgttttgtggcctcggtagcatatggtctgtccttgagaacattccatatgcacttgagaagaatgtgtgttccactgttgatgagtgaaatggctgttaggtctagttattttatactgctgttcaagtcttctatctctttattgatcttcctcgttctctgcatcattgaatgttgggtatttctgtctccagctattattgtagaattgtctattctctctttaattctgttagtttttgcttgatatcgtttggggctctattatttggtgtatata

SEQ ID NO: 24446 - DNA, 1036 bp, Homo sapiens
ttctaacagataagtctaataatcattactctttcagtacatttatttaattaactatgaatttgcctaaaataaatattcaacttttgtttctgctcctgtttctactcccaagtctgtagaaaacaatagtggtctgtcttggagaatgttccacatgcacttgaaaataatgtgtgttctactgttgatgggtgaaatggctgttaggtctagctagttgttttacactgctgttcaagtctcctatttctttttttattttcctggttctgtgcattattgaatgttgggtattgctgtctccaactattattgtagaattgtctattctgccttcaattctgttagtttttgctagatatagtttggggctctattatgtggtgtatatatgtttatacttgtcataccttcttgatgaattgacccttttatcaatatataatatcctttatctctcataacaatttttgtcttaaagtcttgttttgtctgtggtagcatagggttctgcagacttcagtatatatattgtcatgtaatcttgaaaccctcttacacctccagagtgcactacttatgtagcttattctgattgtgcctcttttagtaagttacaaagcagcagcatctggtcactaatatcctggttaggttatgaagaggtaattatgcataccattggatacagtacaagaacagctacctgggaggaaattttatgacatagtacgtctcggcaagaagcactctgttagggatgaagtcttatcagagaacctgttgtctgagatagacgtggagttttgtagaaagtctgtatttcttcttacagagtattcattgcctgttacattccattctatgttttacttgacgaaaacttctggagtctgacagatgggtaactagtatttatagttctaactttgcaaaccttttggttttcatgactatgtcaataaaaaggtgaaggaggatgaaccagatattaactgatgtcattatgtttccatgatattttgtgatttta

SEQ ID NO: 24447 - DNA, 1045 bp, Homo sapiens
ccaagtgacaaaatgaaatggtaagatttttgtttgctttgaatttttgttttttgtttttgatgtgatcatcagctgctcatgattttgttatcatttttcctgaatgagtattaatgtaatttcatattagattggtagtatgttcctaatagtgtggggaattataaagaactgtgaggatgttgacaggagtgctgtttgtgacattaacacatgatttcagtgttctctctctctctttctctctctctctctctctctcgaatgcttttcaagtattatattcctccatgtgagcttattgttttattttaggtgcctgagggtaaacccaaagggattagatgatgaaagtaaagactacttgtccttatatttgcttttagtcagctgccccaaaagtgaagttcgagcaaaattcaaattttcccttctgaatgctaaaagggaagaaacaaaagcaatgggtaagtgatttgcaaactaagtgaagacatttctgtataactacatattatgacttcttctgcacctttacctagaaaagtctgggacttttttctgctaaaatctgcttaacctgaaacttttaatttgaccattatttaaatccagcatagagctataattattttactgagtcttagacttcgtaaaacatgtaaaaatgattaataatattacttcttcatgtcctaaaatgacatccagttgtcacttagaaaaatagttgctgttagggcaaggtgcctggttcagtgcttggcatatataatacgtgctcaggaagcatttctctcttgcctttttttgccaggtaataaaatctgaagaacaatgagaaagagatagagtgccctgatactttgtcactagagttttttgagcagtagattgaacactgactgaaaggagccatttttcttagtttcagggcctattaatttcagtccaaaattcacatatatagccagctgaaatgcagtagcctgagcttcataatagaagagtgatgtaggaaatgtacgttgtgtgtggcagg

SEQ ID NO: 24448 - DNA, 1034 bp, Homo sapiens
tcaagctctttttattagatacacatgcatttaggatttttatgttttcctaatgaattgatctgttatcattaaataatactcttctgtatccctgatgacactctttgtcttgaagtctactttagcaatattaatatacactaccttttttaggcttacattctgatggtacacatttttccacactttcacctttcactatcaacttgatgtttttatatttacagtgagtcttttgtggaaaacacatatgttggtcttagctttttatccagtctaagaagcttgccttttgattggtgtgtgtaaactataaatatgttatgtaaatgttattgtgtaattactgataagtatgaatttgcatctactatcttagtattcttttttatatgtcccgtctgtttttcattcttttgttcgtctcctctcttatgtgtttttttaaaaagttttcaatatcctaatttatttcttctgtttcctttttagctataccttttttcgtttttagtggttattctagacattacaatgtgtatccttaatgaaaaagattagtttacttaatgttgcatcatttcatgtaaactataaaaaatacacaactgtttaatttcatttattgcttccccaccctttgcaccactgttgtcatacactttatttttaaatacattataagccctacaatatcctgttgtagttattttaaatagttaatatatttttttaaaaaataagagaagaaaaatgaaaaaaaaaatttctatttatccacatatttactatttcaatgctctgtacttattcctgcacatctgagtttccatgtagtatttttgcatgtatttatagagcgctggcagggagtttgtgaataagttaatgtttgataaatagaaaactaaagcaaatatacaaacaaaaatatacaatcaagaaatagccatatcaacaagtttggaatttggaaagaggaaggtaaattccagagtgaagagttcagagttggcagggtttgtctccag

SEQ ID NO: 24449 - DNA, 1029 bp, Homo sapiens
gagatataaaaccatcatgcccagcctatatccaaattttctttttatttgtttttgtttgtttgtttgttttcttatttctttctttgtttttgtttttgcttttttttagatgcaggttccactctgtcacccaggctagagtgtggagtgcactggtgcaatttatagttcactggaacctcaagcactcttcctgtctcagcctccagagtagctggaactataggagcatgccactacacctgactaatttttaaaaactgtttgcagagacagaatctcactatgttgcccaggcccatcttgaacacttgggttcaagcattcctcctgcctcagcctaccattatatccattttaatcagaatataatatttaagcaaaaatggaatgtctgagcttctacagaaagcctcctttttcctgcctcttccatttcttgattttatttgtgataattattttttcttttattttctcctcactttattctttaaaatgcttctctttccactaattctgtatttttcttcatattactttttctttcctccttccactcaccctgccattttttttaaataaatggttttccaaatagatgtgtgcaaataacagggagtcaagagtaagatcaagttactttagatagtgtttgttttagaaatagcagtaaaaattcactctataattgttctgtggtcgacaggtttatgcaaacctatcccccaaaccggaggaagctgaaaggcccaagtaagagactgataaatccagtttctcagaaagaaacatttaatagggagtgagaaacagaagtcatgatgtcctggcaattgacaacaacaagattagatagtgaatccccccgtaccattacccaccgcgtatgacttatatgtaaaacatagggaaggattatgtggaacaattgaagtcaacctctcagggaacggcaagaatgctatgtgaatctgcctaagggcaggatttatggtagcagcagttaaaatagaaatcttaaag

SEQ ID NO: 24450 - DNA, 1030 bp, Homo sapiens
ggcaatttttgtgtaattttatggatgaggaataatatcctgaaaggtaaaattgatcacacttaaaatatgtaagaagtaaaattgaaaggtctgttagcaagaggaaaacagtattaaaattcaatgttctaagtaaaaatgtctgattatttccttcctgctttgcctgctttctcatggtaacaaaacattcgtctgagggctataattagggaggggtgaactatctgggaaaatagagaaattgttttgtatctcagccctaacactaagcagagcccagacttccttaaagatagaactgatattagtcagcagcctttctctccttagttatcatgagttcacaccctcttgtaatccactatcaggacatcactgatggagacaatcccttttgctctgattcccacttaacgttttgtctaccctggcttcatagggtcagaagtgttattatcagagtgttgtgtttcaaataacatgtaatgtccataaattctcaatgttaatagctagaacctcacttaaaagacaaaaggagttatcttagagaccaaagacactattgtcttgaaccacatatgattaaatatttaaaatgtctaaggtgtgagagatagaaaacttatgtagttcaattaatactgtttaagtaatagaagacaaaggagagctatagtcatgttgctgttactagtttatatttgttgagtgtttcataccacataaaccatagtatgagagagttattgacacatactaatcccttcctaaaatataccaactcagcaagtagtcagctctgagctttgaggtttggctaccttccctcactttaagagttatgggttccttcacaggggatctattattgaaaagctttccagttagaagtaaattgtaagacaggtccttcatgtggggagcaacactgggaaagtcacaaagaaaaatagaagatttggtaagaaggagagcgcttttattgctattgacacagtgaattgaccttattccctcccaa

SEQ ID NO: 24451 - DNA, 1026 bp, Homo sapiens
gcattaggatttgtggttcccctcttcacattatttttaagacaaattgattaaatgatgtagcatactttgtttttcctaattgaaggacctcaactttctgttactataactttttgttttttttgagagggagtctaactgtgtcacccaggctggagtgcagtggcgcgatgtcggctcactgcaacctccacctcccagtttcaagcaattctcctgcctcagcctcctaagtagctgggattacatgcgcgctctacaacgccccgctaattttttttgtatttttttagaggtgaggtttcaccatcttggccaagctggtctgaaactcctgacctggtgatccgcctaccttggcctccctaagtgctgggattacaggtgtgagccaccgttcctggcctgttattgtaacttttaaagtatcaattagcttgcagaaactgagatatgaagagaataggaagaaagggaaatttcttatctgtgttttttaggctagggaatatgaataaaaggtggcaaaggagtagtgaagacaagtaaaaaattcctagggacttgatttgaatttaagggatggaatttatagaaaaccaaatatagccataatccgtttagttataatttccattataattaaacaataatccacttagttgttgaaatcaaccaacaattaaggggaccctactatgttcgtctcattgtgccaggtactatggagcttacaaaaagagtgtaaagtttttaattgtctaagaaaacagtcactttggaatgataatccatatgctctaaaaatacacattctgaaactaaaaatgcaatataaaaacatgagatacattgattactaaaattaatgatatctgacaccaagtgactttttttttttgggaggcttggcttatcttttaggacttcactaggttagggatgcatttcagattctactccacctagtcttagttcttggccttgtttctttctgaatttattgctgctaaaataaaacca

SEQ ID NO: 24452 - DNA, 1092 bp, Homo sapiens
ggaaatgtttgtgatgaggtttttgtgctttgttttatttttgtttttcaaatttctcactcttaacattgctggttcctcaaagatgatttcacattatcttcatagcaagcagaagtgatccatttttactctttctgtgacagattgatgttttattaaaaagagggcctgcatcttcctaagtaaaataaagcactaaacaaacccttaatgtaggtagtgtcttttcagtgtaattgacacttttaggttggtttttgcaggaactagtaggaactattgtgtgcatgtttgtttccttaatttttttagaagctctgttctgattttgagaatttaccttttatctcttattcttctaaatttatgcccgattttgtttttttgtgcatttaaaaaactagcctataaattctgttgcaagtattggcctctagctgcagtcaccattatcccttctccccgcaaagaagaacatctaatgttagaaatctgttttgcacagcctagttaaaacttgtatttacttgtacctgttttgatgtaattcatcttatgagttagggccagagaactgcatggaactattttaatcttaaaacccgggcatttgtagatactctacacattttgtggctgtaggcaaaaagaattttctgttgtgtgttaggtatttttgaagatgcctaacttattctgggcaatatacagtgtatctttcatgacagtaagactaaaatattaggaagataattagcagtgaagtgaagcataggataattatgtatagaagcaagctttgttttctcagaagtttataagataaaacatttagaaacagctaactacccaacccaataaaccaaatcatttttatcttttagtttcttatgcttagggaaaacaaataagggactgtggaaggcaaaagcttcatctctgtattctaatttgacaatgcatttgatacctgtggcctttcagcatagatattgtataccccttgtttttattgggtagttaatatagtgtcctgagttttgttctgttccaacagtttactcattgttttctgattaatctttaaaa

SEQ ID NO: 24453 - DNA, 1029 bp, Homo sapiens
cagttgcttttgccacagaaattttagttcctcctcaaaatactcattatgcagccctccaaacccttctgttgcttttctctggaagctttccaaaaggcttcctgcatcttgctttagttgcagatagggaactgagagaatgctttcaatggagggttgcattctgctttgataggatttccttgtgatttgtagatgctgtattcctatttatatattatgtttgctctatttttaaaaaactatagcagtgcacgtttctttcatttaccatatcctgttatctactatgatgaccacttcttttctggatttttattcgtacttctttgccagtcagtcagttccagaacacaaatgattttttatctcagatcaaagggatgaattgttaatatgtttaaaattagaatgaaccagtttggttaaagaaatatttacttacatatttcctgtatgtgctttgtatttgatatacctatctgcaatgtgtttaagaatgactgccggtatctctgagattaatgaagaaaaaatttaaacagtcactggagaaagtaatagatcttcaggagaggtttttgctgatatatagtcataatttgctgtttctggcacttttcaaatcatcctcctcgaagtacacactggatgaaacaaatgaaatattgttaggagtatttcgtagttcacagaaaatcttagtggggaatattactgagactgatcagaaagattttagatcttctctcctgtggtacatatatagcaataatgctgaacattattatgaaactctgaattcaggttgcctgccttgtgatcactatagataattagtaatctaattatggcaacattgaagttaatgtcattcatatgtgtttactgtttctgtcagttgacttttcagtatactcactttttttctcattttcagagttggtgtgtgtcatgttctgcttatttatagtattattattatttatctgtaggacccaggaccacccccaccttctccattac

SEQ ID NO: 24454 - DNA, 1047 bp, Homo sapiens
catcttacatacatgttttatggctaggtcatcataactcagaaatagtctcaaaacagaagccatatgtaccaaggtggttctttgtgatactggggaaagcagttagctcttttaatgcctgcctttgcatctgagaaatggaattgttaatataacaatcattatgtttgtctggagtggtggaattaaatgaatgcatagtagatcttttgccagtgaaaattctaatagaaatgttaaataaagataaagattccaataaacaagtctaattgagtggttaaattttaatatccccctacgttgtcagagaaagcaaacaaaaaaacaaaagagcagtatactttgttttagaattggtatttagaggtatatcaccagacttgacttactttcattctactttgagtgtttaattatttcagtttttgtttgatgcattttcagaggcaatcgagacttcaaataattggtttactgttgaattgtttttaaggttggctggacttctcataaaactctgatctaatgtacctctgagctattcttgtgttttgttttgttccgttggtggtatagatttatgatgattctgtcttccccatctcttgcttatataccctggcagctcatgatacccttggtactgacgtcttggctggatttggtgttgcaggctctaccaccatacttagagagtggatgtttctttttccaaagttatcatataagcagtttctttgtcttaatatacctagattttaacctttttacctcctctgttcaatcttacctcctctgttcagtctataaactgtttacatagagtttatgaactgtattacatttttttttggtagctgtaaaccacagtttagttttcagagagaaagtgtattctgttgtgccaagattcataaataagataagggaagaaattatttccatgtgtaaggaagcataaagctcagagaaaggcatttggatgatattaacaagcccgacaacagcaacaacagtagctaacattttattgtatgcttt

SEQ ID NO: 24455 - DNA, 1058 bp, Homo sapiens
actacctcatttcctttgtcagaaatgaaactattatgtacagttctgggtataccacttgagggtttcatatgggagcatgttattgtaagaatattaaggtaaatggctttaaagctattattttgtctacttaaatttagtaatttgttaattttttaaagtactaattgcacttattgtaggttattactattttgaaaataatttcagctttctctaatacttattttcctcctgcacttacaattaatcagtaaatatacttactgttgtattaagggcccatacttataagaataaatggaatgcatattctcttataaatgcttacttgtgagtcttgccctatgaactgcctaaaaacaaacatttttgttttgttaacacatccttctactcttggcacaatatctggtacacagtagttcctactggtagcttgtcataatccatgttagttttagagttaggcatatttgaatttctttacttccatatgtggaattcctttcctctccttttcttgtcctcccttgccacaattttcactatcatgaacattttttctttatctctactgtggctctcattttatctaattaacagccaaattaaatactgttaacaatatggtactcatagtaacaagacatattcccttcttatacaggaagcagtttggcaaaagtgatatattatgaataagcaataatgatccaacacattccagttaaaaatatacttgtaaaaattgttcaggatgcacttaaatttcattgaccggtgcaataggttgttggaatgattaggccgcttttaccagctctataaaacaagtgctacttaggtgacatgtttccctgactttgtttttttggtccttacccagacaattatcaactttccagttttctatggatatgaagatttactcctagtcatcagtgggacccccatgaagtcagccagaaagcctatatccaacttatgtacctttgcaaacttgtctggattttgactgtatgtgcaaaacagattgtacttagcgattcatt

SEQ ID NO: 24456 - DNA, 1030 bp, Homo sapiens
caacaggaaacatcccacctacaatgcatatggcaaaggagaaagatagtgcagcagactacagacaaaaataatagctgagagctgaaaacaagtattctgctttacaaccttagatctgtcatctcaaaaatagagataatctttcttcaaaatataatatggtgatgtgagcatattttaatttataagaaaaatctttttctttaggtatcccatatcatatttttgcattctttatagtggagggtacagtgtctcctgtatgttttaaaccttattatttttctggtgtatatttgttgttttgtcttctagggacacatactatttttactttactaatgtgccaaattttaagaaatttaatacttaaaaaaccgaatatgcaaagttcgtaaagtaaatggtgagaagatttcactgaagaattgctttaaatagaaagctcttctgatgtacttaagtgtttgtaaagtcacttcctaccctgggctaaaagagacacaagaaaactcgaggcttaaaatgttggaaatcactgttgcttgaatagtaagcagaaatgagggtaaatcatttctgaaattttaagtataaactaatgaaaaattgctttgctatagaaattgcattttcatctaattgaatatattcattttattaagtgggttactactgtgtattctttaatttcattatcttcaagattaatttatagagtctatatgaaaatactacgtggaataggagttatattttataaggagttgctgtgttttaaggagttatgttaaaatcacattatctggtgagtatcagttaaccacaagggtactggccagtcagttatgtttcaaaatacctgttacttagtttgagaaaaagtgactttgggcacatattcctgcttcttattttgtaaaagggaatgctgtggtttgtaatactaggctattgtctagtttgattcaaagcaccctactccattcagcctgggcaagatagtgagaccccatctctacaaaaa

SEQ ID NO: 24457 - DNA, 1046 bp, Homo sapiens
tttgtgggtttatttttctcttttgttctagcctcagttttgttatctctgttgtaatgtttattttcttatggtataagactgttattgagtttttttttttttttttttttgagatggagtctcactcttgtagcccaggctggagtgcaatggtgcaatcttggctcactgcaacctctgcctcccaggttcaagcaattcccctgcctcagcctcctgagttgctgggattacaggcatgtgacaccacacccagctaattgtgtattttcagtagagatggggtttctctgtgttggtcaggctggtctcgaactctcgatctcaggtgatccacctgccttggcctcccaaagtgctggtgttacaggcctgagacaccatgcccagcagagatcttttttattgtgggcatttacagctataaatttccctcttagcactgctttttctgcatactataagttttcatatgttatgttttcgtcttaatttatctcaaagtatatctaactttccttctgatttgttctttgacctattgattatttaggagtatgttgttgaatttccacatattcatgaattttccaaatttccttctattaaattctcatttcattccatacagtctgataaacccactttgtttggtttcaaactttaaaaaatatatcggtgtttgttttctatgccataaacatgtgacttatcctggaaaatgctgtgtatttactttagaagaatgtgtattctgtcacttgagtccaggaggcagaagttgcaatgagccaatatcacattactgcactccaacctgggcgacagacccaagagttcgtctcaaaaaaaaaaaaaaaaaaaagagagagacaatgtgtattctacttggggtggagtctcctatagatgtctattagtttctaggattgttcaagccttcttttttcttgctcatcttctatttagatttgtatgttcattatcaaaagtgtagtgttgaagatgccaactgttattgttgaactgtctatttctcctgc

SEQ ID NO: 24458 - DNA, 1040 bp, Homo sapiens
ataatcaaagaggattttattttgatcgttattcctttacaaagtgttcttcccctgtatcataaccctgctttgctgttcgtgatgttaagtctcactgataggtaagattattgtaattatcagtaattggtaatagcattcaaatgatcagtcgctcagtggccatttctttttttcttttagtgtttctctttttaagtccactttatgcttactttagcaaatctaggaaatatttaaaattagaagagtttggcacatttgtctttcctctacccttcccccaactctttccctctacataattgacatcatattgtgcatctagtttttcttactcattgaaaaagggaaatctaccatatcataaatatgttttcatattattaaaaattgtcaaatgtaatattcctttatatgtgtacatcataattagccattcccttaatgttgggccttaggttgtttacagtatttcattattatattacagcagtgagtgtgtgtgtgtgtgtcatctgtgtgtgtaatactttgtcaacatctctatttccaaagactagaattcttgaaaatgaaattcttgaatcagtctatgaaaacttttaaagctattgattcatatcataaacataatttttaagaaaagtgaagttgatttatatatcctagctggcagtatatcacaatatctagactgtatctttagaaagctttagattttctcctctttaaaatctttaattttttcaggtcctcaggattttaaatatttcccatgggttttttttttccgtttttatttccttttgtttgagtaaaatatatattcatgtaccttttctttacatctatagagggcttacttttttattcataaatatgtaaggatgtattttatagtatgcatagtaacattgcattgtcatgatgtctgaaaatattttcccattttgtttacatattagattgaaagcagaattattatagaattgctcaactaattctctttttgttgccatcttaaccttaagatg

SEQ ID NO: 24459 - DNA, 1068 bp, Homo sapiens
tgcttttgaaaaacatccaaattttaattgatgcaagaaattgaaataaaataaatggcagggatagaagttggggatcgttagggttctttccagattgtgttactctaatgcaagtgtcagcacactttttctgtaaaaggccagatagtaaatatttaggccttaggaacctggctcaactctgcttttttagtgcaaaagcagccattgacaatacataaatgaatgagcattgctattttccaagaaaacttttttttttttaatacaaaaacaggcagcaggtcttagtttgctgactcctgtgctacacatattttggatgacactgcctatgtgaacaagggctcacttatttatttttttaagtggagatcttaatggcctctctattggtggcctttcccaccactgtacaatttacacgtcctgaaaagcctgttaatataccagttataatattgctgttttcttattttccaatatctaagccctttgacctgtggactctgcccaacctgttcctgagccaaggtatttaataatcctattcttggatggggattaatctgtctttttagtccagtaatcacgtgcctatattgagtccataagtgccaacaagctctagttttctcctaccattgccaccctgtttgctcagattgaagattgataatatgtctaatactagcaaacttgtttctcctgggttctggtgggactatagcttcttacacccaagcagggagtctttatgctcttgctctttcatatatagggtgaatctaaaggaaacatactattcccaccagctgtcttttttctttttttttttttttgagacagagcctcgctctgtcgcccaggctggagtgcagtggcgcgatctcagctcactgcaagctccgcctcccgggttcacgccattctcccgcctagtagctgggaccacaggtgcccgccaccacgcccggctaattttttgtatttttagtagagacggggtttctccgtgttagccaggatggtctcgatctcctgacctcgtgatcccctcgcctc

SEQ ID NO: 24460 - DNA, 1063 bp, Homo sapiens
ttggctctggtggggcatgaagcctctaggtcagtgcagctccctcacctgcttgatgtaaatctcaagttgtacctaagctgcgatctaagaggccaggaaaaaaaagctcctagatagctatgtgaaccactacatggaacctgcagagactcctgcagaagaggaatacctgattctgccctactcacatgcattagttcttgtcctgtaatattctgggtggacaggtgctcaggatggcctatggttgtcccgtgaatttgcacattcagttgaacctaaggagacctcttagtgggcattgaagatctgactaccttttgtttcttggatcttactgagagagaaatgtaatgaaagaatggaagcaaagatttttgattggttatttcacagtgatgctgtctctgtgtcatagtacccatatgttctgaatctaagagctcttgtcacacaggattgttgaaggaatacttccagcaggtaacttctgtggcaaaaagtctggtgtggctgtacactacagtatttgtgcattcatcaaatattctcctgatcatgtattgataggttccttttttctgtttttatgttttagagactatcttaagaagtcaggaggtgactggtgataattgtaactaattagcacttagtggatacattatttcactcttcactatattattgttctctgtatcatgttgataagattcttctaattttactaataatttgattcttttgtttaagattggacctttaaggtcatttataaggaagctattcagtccttgattataattttaagtaatgcattataaccaataggtgagagaaaatatcacagttttttaataattgaaaaacacttagactaaaaccagtttttctagtagtacaggattcattcatttaaatttttgtctgtgttacagaaacaatgtgtcttctcttttggaaaattaaaatgtatggatacatgagaaaaaaaattcagaatatctgattcccttactcagagatacccagtgttagcaagcatgttttgcattccaaa

SEQ ID NO: 24461 - DNA, 1078 bp, Homo sapiens
gtgtgtatggtttctgaaactttactggccctgaggatttctagagagagatatttgtataccattagtagtatagtcatgtgactctggagtcacatattttgtaactgttaaccataatagattccatcatcctgaagagacaatacagtcaacctccaatttgcatatcagttttgtcattcagaatctgttttctcatagaattttttttacatggtggttatgcatggtgatattatgtttatttaatgtacataaggcataatattagttctatggaacttatgacagtgttttaatgcaaaatatttttaaagtatacctgtctccttacctgaccctggctcatccccaaacataaacaaacccctaccacagcctttacataatttctgagactcacttatcccactcgtgcaattagagtaggaattggaacaggctcagactactgctagagttacatttacccaacaggatacagaataggggtgggattctttttgtatttcctgtcttcactgttctcttcattcttttcttctttagatcttaggaagtgccctgtctaaatcctttcctctttatgctacccgtagttctggtatttatttggaagtaaatgggactagacttccatctgtctttactacctcgcctttatctttaattttgaattacccatttgacccttctctatctctcaatcttcctttcataaggaaggctaatggtttttgccacaataatgacagaaaagaggaagcaaaaatacatgataggtgattgcagttattaaaaaaaactgaggctagaggtagagggaagatgacagataggagacagggctgacctgcagctcccactcggatgaatagaacagcatatggagactcacaccatggacttttgctccaggaaccaccacaggagtataccagaaaaactgaaagaaatcaccaatcctttgaaagcagcagcaggctgctgcaaattctgtgagactggcaaaaaactctggtgctgtctccaaattgccaccttctggctggaggccaaccaactcaggacatta

SEQ ID NO: 24462 - DNA, 1033 bp, Homo sapiens
taaaaaatacagttgctaggtaaagagtattcccatggccaggcatggtggctcacacctgtaatcccagcacttttgggaggccaaggcaggcgggatcacaaggtcaggagttggagaccagcctggccaacgtggtgaaagtccgtctctactaaaaatacagaaattagccaggtgtggtggtgtgcgcctgtaatctccgcttctcgggaggctgaggcaggagaatcacttgatcctgggaggcagaggttgcagtgagctgagattgcaccattgcactccagcctgggcaatagagtgagagtccatctcaaaaaaaaaccagagtattccaattttaaaatttttcatccatattgctgaactactttctcttaaggactctataccaaaatggtttaatttaattgttagagaaaaccagtaaggggtgtggctggtttaaatactgtctgagaattccacataacctctcagcatgctgaaaaattgttggttaaaggtctggacgtgagaataagttacttactgtgtgctgtcattagaaataacatattaggaattaccagtataaactgaaaggaatacttatgtaacagcacaggatattttaccaatatataaaagctatgagctataagataggtttgattaatgtagtttccccttcttttttcttaaattggaaatgtctttattgctgattctaataacgaaaataatgtgtacattgaaaaaaaaagtctactagtatacagagaataaaaattcctacctgtaacagtactccttatagataactactgaagtttgtgtgtatgtatatatgtatatgcatatgtataaagtatctgcatatacatacatatatacaattatgtatatttaattttttaaatttatgaaagtgggatcatactctaatcgttctgtacaagttgctttttaaatatctatcaatatactggtaacatcttgtcagattactacatatagatttatttcctatagataatcatttagatca

SEQ ID NO: 24463 - DNA, 1034 bp, Homo sapiens
atcatggttaaaatcatatttttacctttttaaatttattcctcatattaccttagttgactttctaaaagataaatatgatcataacaaacatataattcagtatataaattctgatgatattccctctgctggaaatacccttcccaatttttcactttcccattcatacttcagggctcatctttggtgtcatcttggaagtctatctacaacctctctggtttctccagcacagcctgatggcttcctatgcttaactccttttaatacttatcactgtgtagtgcaaatgccttacttaattttctgtctctcttactaggcttccttgatgtctgggactgtgtagctaacacaagggctatggctgccacttaataggtcaataaatattgaaagaatgaataatgctataaaatgttttgtttctaaatatttttttaaaggtggctatgaaaagttctttgctatgctgaaaaggaaagtaaaaagaaagatttgtagagtcccatgattagcttagaaggaaatgaaaaatacattggtagtataagtacatgctttcttctctaaaaatccctctttaaaggaagcagcaattattaataaaataaagatgtgttcaagagatctgtttactagccagccagtgcatcatggagaattgtaggttaagaagcaggctgggcgcagtggctcacacctgtaatcccaagccctttgggaggccgaggcaggcggatcacctgaggtcaagagtttgagaccggcctggccaatgtggtgaaacctcgtttctactaaaaataaaaaaaaaaaaaaatttagctgggcgtggtggtgtgtgcctctagtcccagctacttggggaggctgaggcaggagaatcgcttgaacccaggaggcagagtttgtagtgagccaagatcgtgccactgtactccatcatgggtgacagagggagactccatctcaaaaaaaaaaaaaaaaaaaagtaggtgtctttacaaaggaaaagttactaaagattt

SEQ ID NO: 24464 - DNA, 1045 bp, Homo sapiens
cgtattccatggtatatatgtaccacattttctttatttagtctatcgttgatgggtatttgggttgattccatgtctttgctattgtggatagtgctccaatgtatatacgcatgcatgtatctttataacagaatgatttaaattcttttgggtatatacccagtaatgggattcctgggtcaaatggtatttctgcttctagatctttgaggaatcacccacactgtctttcacaatggttgaactaatttacactcccaccaacagtgtaaaagtgttcctttttctgcacaatctcactggcatctgttgtttcttgactttttaataatcaccattttgactagtgtgagatggtatctcattgttgttttaatttgcatttctctaatgatcagtgatgatgagctttttttcatacgtgtgttagctgcatgaatgtcttcttttgagaagtgtctgttcatgtcctttgcccactttttaatggggttgtttttttcttgtaaatttgtttaagtttcttgtagactctggatattaaaccttgtcagatggatagattgcaaaagctttctcccattctgtacgttgtctgttcactctgataatagtttcttttgctgtgcagaagctctttagtttaatcagatcccatttgtcaatttttgcttaacacagtgctgttaactccctggttaaaagaccctactttaaaaagcatgtctacatatattactttttatgcatataatatatatgctatacagatatgtattattgatccttataatagccttgtacttttagtagaacaggttgtagcatcctgaacccaatgacaaacagttgtccaaggtcacacattaattagagttggagcaaaaactaagtcttaagtttctttgtgggactgtccttttttgttcataccacatttctatgtcatggactgtaaatgacagcacaaaaaagcaatgcataaatctttatatgcacatttgcatatatacacatatatgcatgttttttgtacttaaaa

SEQ ID NO: 24465 - DNA, 1074 bp, Homo sapiens
tatgagaatggacatttgggaactcctaaaactgtagaatgtagaatttaaaaactgttctaacctcttagtgactgctcagctgctagtttacacagctaccataatagtgaagcttttggcttttggcctactatacaactggagaagaggatgggattagtgcaaattaaaatgccacaagattcgctcttcatatggaaattcagccacttttcttgaataaatattctttggattattttaagtttttaatttccagagttctgaaaaaggtgattttgacaatgtttgccagtgttattacctcaaagtttctaattcaataaatctgagttagggcctgggaattatttttcctttattaatattctccctagtcctttgtctattcctttttagatgtttttgttcttcttcctttgcctactccttaaatatatggtatttcccaatttctatgggttttataaattctcttgatcccttatacattgtctatagatatgacatgcttgatagaaccagctgaaacattttccttgtgcaccagtttaatgtctcagagacagcccctaatttagcatgtcttaaaatgaacttatcatcttctacatttatttttctctctatatgcccttgtgggcaacactgtacagttcttcactgaatcattaattaattaaataaatatttctttatttattttattttatttttaattatactttaagttttacggtacatgtgcacattgtgcaggttacttacatatgtatacatgtgccatgctggtgcactgcacccactaaatcgtcatctagcattaggtatatctcccaatgctatccctccccactccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtg

SEQ ID NO: 24466 - DNA, 1044 bp, Homo sapiens
tacaaaaaatagcttggcattgtggcttatacctgtggtcccaagttaccctagtggctgaggtgggaggatcacttaagcccaggaagttgaggctgcagtgagccaagattgcgccactgtactccagcctgggtgacagagtaagaccctgtctcaaaaaaaaaaagaaaagatttgttttcaatataaatgtcatggatttctttattatcccagctctctataacatatatcctatgagtgtctctctacaaaaagaaactatcatatgcggtatacaaagtatgactaagaaataaagtgatttgatttttaaactactacatcatgccatccaaatgaatgttaagtcttccaaaataatcatcttaggaagctgtacatttatcttatgatagaaaaattccttaatcgtttgcatatcctcttttaaaattacctcctcaatctgaagtgcattattttgactatattgatagtttcctcaccttctttaaacttttgctcaaatgttacttcctcagtaagaattactctgaccattctattttaaattgcagtcccccccttaccttgctttctttttcccccctaagatttaaattttctaatgcatatgtaatctacatatttattgtctgcccacactagaaactacgcaacaccgaggcagggtttttgcaatctaatagaggtactttctcaaagagtttgtagatatacaatccagtttttataaaaatgtagcacttaaaagcaagtctaattcagacttaagttgtttttgaacagaaatgtgatctggggctgggcgcggtggctcatgcctgtaatcccagcactttgggagccccaggcaggcagatcatgaggtcaggagattgagaccaccctggctaacacagtgaaactccatctctgctaaaactacaaaaaaaattagctgggcatggtggcgggcgcctgtggtcccagctactcgggaggctgagacgggagaatggcgtgagcctaggaggcagagcttgcagtgagccgata

SEQ ID NO: 24467 - DNA, 1044 bp, Homo sapiens
ctactatccaagaaagatattttgctatgtcatagctatgaaccaaaataacctagcaccaattgattcaccattatattataatagatgctccaaaaacaaatacataccaagggaaaaaagccctgatgatcggactaggtgaaccataggcgcaattaactactcaatgcagggatgtgtgtagtgtaatctatcacaggatactttgttagaagtgagtcttgaagtagaaataataaaaaggaaaaaaaaacagtaatctaaaaatgaaatgattaaatgttataaacactaaacagaattttttaaaggctgatgcttatggttcaaagacttttgaataaagaccaagacttctctgtgttttctatatatttagtaagttctgtaattaataaatcttatcctaacctgcagtgatctctctcatctgaatttccagaggcttcatttttctgtattatatctttgacaaataattgtgtgcagcccctgaacaactcttctgctgttttctgaaactatttatttaaatctcatatggttattgaactacttttgtgcttacaacttcccaaactataagcttcattcattacagtgccttgctaatagtagaaatggccaaaatagtttttttatttgactcaagctgatacaaactcattcttttccagaataagaaaaattaactttactcctatttaatgtatagtacatttatctcataaaactatgaaaagcctttatagcaaatattaacaatttctccttttatgaaacttataatgagttcttctttcaatataggttatgagtggaattttagattcatgttctagagatttggtaagacaatagtgctcatgagggtaagatgacatgtttgtgaaaatgtccagaaacaggtattttcttacactgtgggtaggtataattagtacaactcttggaaaacaactaatcaatgtatgtatgccatacctacattggatacctaccaaggtatgccatacctacataaaggataaaaagatatta

SEQ ID NO: 24468 - DNA, 1059 bp, Homo sapiens
tttttatttttggtacttgtagtagaaacggggtttcaccgtgttggccaggctggtctggaactcctgacttcaagtgatctgcccacctcagcctcccaacatgctgggatttacaggcatgagttaccgtgtctggcctctttgcatatcttataatattttattgaaaactggactttctagatagcatattgtagcaattctgaatattagtcctcaatatttgtcattgttgttggcctgtttattcatttaatgacttccctggactattttaacaaaatctattcaccacctatgtgaagcttctgatgttactcttcagagcacgcagcctttcccatgcatatagtcctcctgggatgacagtagctatgacagactccctttgactgtctctttccttgatctgttatgctgtttgcttctattggtatcatacctacctgttaagctctactaattgctggggtaatgctttattgtttccaataataccccagggaacaaactgctgtagtctgttccaattaaattctgtcccctatactgaactaattttgaggccattctttgaagtttattctgactccaggaagattgttcttaactgcctctttgattctctctggcaaataccttcaagttttggggagtgtttttctgttttgtttaataactgatatccagtcatttcctattgttcaccgagatgacctactacttagcttatttctctcatggagatactagcctccttttgcataccatcagaatcttcattgtttcaagagcactcttgggcttgaattctccctcactctattctcaataaagtcagttctcttggggagagcttcggagttctctgttcttatgatattctcctccccctgggcaaaatcttggaactactagcctgaagctaaggttaggaacagcagcccacttttcatgcagtggcaaacctgttttatgagcagagcagtgtgcagaggagtagcctctaatctcttggcttgcttctcccagcatggaacctgtgccctaagggtg

SEQ ID NO: 24469 - DNA, 1048 bp, Homo sapiens
ctatttattatgtaaatatgtttttaaaaagtgggtgtcattcacacaacttaagtcacaacgtgttaatgacggagaagaaaacagcattaatatgacagcaggaaactgaggttctggtaaataaaaatacataattagccatgaattcaagacttcagagctttcaaaatagccacactaaccagttcataattttgcatgtttagatctggctaaaagaatatttttggcaatatacaataagtcacaattctctgaaatacaaatttgccatgaaaatctaataaaaatgagagagaaaatttgttctcttaaatcttatattacttccattgaatacacacctaacatagtagaacacaatttcagtagtgattttggggttacaattttcacatgtaattccttctgcaggtaaataaaaatataaacccagaacagtaaaaataacataaggtaacagtaaaagcctaccaaggcttttgtttaggtaaacatttatcttaacactggagcttcggaatcctgagaagacccttgggataaagtgacagacacaggtttgattcttcctggtatttcaaacaatgcccccataacctaaggacaattttttgaggataaatgactggctaggagcaccaatgtcctcaggccttgcttggggcctgtaatctcacctaatcattattcactatcccccagaaaagcctcaagctaaaattgtgattgctatttagaactaaacttgcaaattcatttttgaacatccgttcttctgccctcatgacttcattttttgtttaattcatgtgcaccattacatagcagctgcactaagcattaaaacctacagcaacagtcaatgtgttctgagtgctggccttctttattcatttataaaaagatattctgataacaaaaatgcctaaggattacattgcataattcatgcaactggatatctagtcattaaaggggataggaaatgcagtgatagtgggcaatagttcagtaaactcagaattttgcaatacagttttta

SEQ ID NO: 24470 - DNA, 1078 bp, Homo sapiens
catgaagtctttgtccctgcctatatcctgaatggtattgcccgggttttcttctagggtttttatagttttaggttttacatttaagtctttaattcatcttgagttcatttttgtataaggtgtaaggaagggatccagtttctgttttctgcatatggctagccagttttcccaacagcattattaaataggggatcctttccccattgcttgtttttgccagttttgtcaaagatctgatggttgtagatgtgtgatattatttctgaggtctctgttctgttccattggtctatatatctgttttggtaccagtaccatgctgttttcattactgtagccttgtaatatagtttgaagtccagtagtgtgatgcctccagctttgttgtttttgctaaggattgtcttggctatacaggctctttttacatttcatatgaaatttaaagtagttttttctaattctgtgaagaaagtcaatggtagcttggtgggaatagcatttgaatagtattgaatctataaagtactttgcaatagcattgaatctataaagtactttgggcagtatggccattttcacaatattggtttttcctatctatgagtatggaatgtttttccatttgtttgtgtcctctctcactctcttgagcagtggtttgtagttctacttgaagaggtccttaacatcccttgtaagttgtattcctaagtattttattctctttgtagcaattgtgaattagagtttgctcatgatttggctctttgcttgtctgttattattattttgcaaccataattaaccatgtacattattgtgtgaaaagggcttttgcatttggtgttccctctacctgcaacataaattcactgagatgacaatttaatccctctttttcttaaattcttgacgataatggcagctgatcagtagggcctcccttgccatacttattttaaatagcaacttcccatgcctggaatttttgctctggtttccttattttttttcttcatagctcacgttgttaatacacattatatattttaattttcttaatttttaa

SEQ ID NO: 24471 - DNA, 1062 bp, Homo sapiens
gattttgctaaagcatccctaaagtgtgtgatcttttagtaagaaattaataacttagagtggaaaagaagggcacagaatttcaagtcaaggcctgtttattacatcaggcagttttcatcattttcttatacttaacgtgagagccatttttggttctgaattcctaacttgtaggatttcaaagtagtagctccatcaggaattaaaaaatgactttttccctccatcagtgttgtgattctcttattatacatgtagtgaacttcctataaaaacatcaacatattaaagtcacccttgatattggtgattgaatacactattgaaaaacctgctttggcttatattcatttagcttatatcatatacatatgtaccaaatactgtggttgagctaaagctgtagacatagaagatacagtccccattctcaacttgtttaaaacaagcaaactggaccatgataagctaatataataaatatgacaaaagtaagtaaaacactctatggaactatgtagtaagagctgctagcccatatggggtagttatgaaagtcagtgattttgattacccaagttacaaacagaaaaatataaatgaattttggatccaaatcacgttatctaaagataaacagcagttttaataacattaccaatacactgaatgactaggatatgctaagtgttaacaacaaatacaatcttatcatctacattagagatctaaaataataataatgaagattttttcctaagaaaatatttgtcttatttcttctgattgttgggctctttattgttaattggtatacaacaattcaagccacacaatcgaccttttcagagtgacacagcgaaaagaatatgtgtttattaatgaaaatccatgctttactactagaaacacaagtcaaattcgtggcctactaatgatagatcatgaggttcatccttatgtaaaggacagtaacctcatggttacactgtgagccctcactggtgggaaaagcattatgatatgttgtttgagaaagatagtagtggtgaatttgga

SEQ ID NO: 24472 - DNA, 1045 bp, Homo sapiens
gagggctgtgaggactgccagcactctgtcacctctcagcgggaagaccacttgagcctaggaatttgaagttacaatgcactatgaccatgccacagcaccccagcctgggtgacagagtgcgaccctgtcactaaaacaaaataatattgaatcctcatatattaaagatgtattttgataactggatctaaaaatgttttgtactttggggaaagtgaagtatgtatccaaagaattgctttaaatacatatgctgccatttagctcagtttcttcttatttacccatatctgtagatcatcagcattactaggacaggtttttcatctttatactaacactcttctctagtaaggatggagtaaagaaccctggaattagtcttgaaatttgattctcttgtaaaatgatgccataactaagagcaaatcacctgtttcttgagtcttatttataaaataatataaatatctaccaatatatcccaagattgtgaggacctaataagcacatgattgcagaggctctctgagaactgtaaaacattacataactgcaaggtgacattgtatatttcatcactttctgtgaccagcaaggtgagatgtaagaaaagtataggagaacatgggcttaaatcgttagaaattactgattccagccttggcttcctagttctttgatgttgtttgttgttgtaggtgtgtggttctcactgccttagagcaaaagtttgttttttgagagagagagggtcttgctctatctcccaggctggagtgccgtgttgcagtcacagctcactgcagcctcccattcctgcgctcaagtgatcctcctgactcagcctccaaaataactaggaccactgatgtgagccaccacatccagctaatttttatttttttaatagagaatcatagtctcaccatgttgcccagggtggtctcgatctcctaagctgaagcgatcctcctgtcttgcctcccaaagtgttgggattatagacataagccactgcgcctggcaaaagtttttacta

SEQ ID NO: 24473 - DNA, 1091 bp, Homo sapiens
aattggccatactgagtcaattacagtttaggttttccagccctccctctcccccattggttttcaggagggtttctgctagtgggtttctgttcccgtaagttgtgattctgtgtattcacctctgtctccagttttgggtgcgatgcttttgccttgtgacctcacagatttaagtgttgtttattttcagtttgttcagccttttatatgttgttaagatggggtggcaacttctaagtttcttctaagtttcttacgtgcctacctggaaaccagaagtcttacttacaattttgttttcagctttttttccactcgatgtttagacttttttccatatcgtcgtctttgtaattttttattggttgcataatttttgaggttgatatacttaaatttcttctgattgagacaattggatttataactttttagagggtttaacattgataacactgcttgcatttgtagctttgtttttttaattcttagagttctataaaaactttaaaaatctcttgtggaatttttagtgttttaaaaatgtcttcagtagtaatatttgtctttgacagaatggactttaatttcagaaaacccattcagagccaagtatggtcaataacttagatgttattttggttttaaagaagtttttgactgtaaaatgtaggactcttttatacaatttataatcttattctgaagacagtttcagagagcagttcctcaaatgctttctttatttttattggaatatgtatgctccctaaggattaagataacttattcatttatttttttaaaaataaatttttctcaatatttttgttttataatttttaacttttacagcttttaatagatataatgtacatatttatgggctacattgtgatgtagtacatataaatgttagtgaccagatcaggataatagcatgtccatcatctcaaacatttatcatttctttgtggggaacattcagttatccatcaatgctgtagaacactaagacttatgccacctatctagctgtaactttgtatccaataacaaattaattttttttaaagtctcgttttatc

SEQ ID NO: 24474 - DNA, 1052 bp, Homo sapiens
caatgttataatattttattgatcctttccatatgactagtattggtgcttccataactaaatttgcttgcttggatctttaaggcagtcatcttatgtcaaatcttgctcagatattaaggtactcatcattttaaatggattttaattttaattacttatacattatttcagttcagtgagggaaaaattatttacaaaagaatattctttagtgaggtattttatatatggcacaggtaatttaaaatggcactgtctttctggaaagcagttaagcagtgtaagtcaggagcctaaaaatatttatgcactttgatttaataatctcatcttttggaattgttcacaagaaaaataattagaaaaaatgtcagtgatttttgagcaagaatgttcagaataaataagatgtctctgaggtagactataacacaggcattaaaatcatgattttgaaggatgtctagtgccataggaaattgtacattatataatatcagatttagaaaacaggatacagaactctttatgtggaaaactttgaggtttgtttaatcatttatatttatacatgtgcatagaaagcaaaagaataaggaagtttacaacaaaatgctaacagtggttatatttgggtgctgcaattggtgatttttatgttctttatcctatttttctatgttttccaaatttatcatgagctatgtgttgatactataattagatttttaaaataaactttttaaacataagttttggtgtacctgtgtggtatattaatgtgctaattgttattaacattctaagaagttagagttgcaaataaactttttacagtagattgttaaaacttttcattagtttacccatacaaatttattattttaccctacaacttaaatcttttaaatctctaaggcattacaagctcttcagagcattttcctttggcaagtgactttgctgcatatttagcctatcagtttgccccccccccccgcaccattttgatgaaaaataatatccactgtactattcaaagaaataca

SEQ ID NO: 24475 - DNA, 1048 bp, Homo sapiens
aaaaaatttttttgattattcatgtgtgatcctattcaacagaaaacttgggagagttaagtaaggtagattgaggctatagttgccagtctaaactcctttaggtcatattgattagatcactcaattgcatgtaaatgttgattcattaattggtatttcttatgtctgtcttttcttcccaactacattccaggactttgtaacagagatccttttcttattttcccctatattcactgtgactcttagtgcagcattctgcattatagtagatagtaaatatttgttgattgaaatcattgggagaaaggatagcaagcaataaagaaaacagagcaaaattactctaaagtacatgtattatcatgtcatttaatttttcttgactctaatattataatgacttccatggaaatgtctttgtgttctctaaatcaacttatcagtgatctacttaaatatcaacgaatgaaattttgtttacatttctttgagaaaagtggtttctgtaacttagctgattttttcaacaaaagttgtagatgtcttgttttcatttgaaacacacttttaacacagttggtcgcagtagaatttactacatctgaggatacatagtatcttcagttttctgaatacttgtctgatttctagcccatatttttatagatggatttactttaggcgttgaatctattggcttaaactatggtttgtggttatgttagatgaatgttgttctctactttgatttgtaatcagagaataaagtattttcacttcagtgttttatgaaaccagcagtaaaaatcatttatagtcttgcagatggtcctgctttcttattaaggctataacttagtcatcattattattaacatgaataaatcaaagtttttttcattacatgctctccataatatagagaattaagagtggtctcaaagatactaagtctgaataaatggtaaaatactcatgttagaactgtattattcaacaaaaactacatttaggcacttttcttagcatgtgatggagatta

SEQ ID NO: 24476 - DNA, 1035 bp, Homo sapiens
gattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatcaaaacatggacatgctgcatatgtgtttatttcacaatgtgcacacagtataagtgaaaatttaagggagatgatagcacttaacagcacttttcatgttcacatgctttccaagcattaatgaaaa

SEQ ID NO: 24477 - DNA, 1046 bp, Homo sapiens
gagaaaaaacacccagactcccctaggatatatcctagagtaacagcacttgcttgctcatgtgttttttaaaattttcttaataaatatggctcttggtaaagactggcttgaggatctgtttgaaacaatgttttctggtctagacatttatccaaaagagtttgaaagggggaaaatatacacctctttgatagctacttccttagtaacattgcgctgtccaaatggtagctgcacgtgactactgggcacctgtaatgtaggtagtcaaattgggataagcagtaggtataaaatagccatcaaatttcaaagacttagtacacaaaaagtaaaatattttactaatatttaaaaatattcattacatgttgaaatgatagtattttggatatgttaggttaagtaagttattaataaaatgaatttcacctctttctttgtacttcttttaatgaggctgctagaaaatttaaaattacatgtgtggctcacatttgtggttggcattgtatttttcttggacagcacggctctaacatttagatgtgatattctgatttttttttttgcctttatttcagtttcactttgatatatggagagtctattgtgtgctaagctcagtcctaagcatcatggatttactatgataagacaagatccccgctatcaataacctaagtccaattgggggaaagcaaatttaaaaaaatcgcttcgtatcagtgcccaaagacaagtggaaagaaaacatgggtggagccaaacagagaaagcacattcgattctattcagggaaacctcaggcagagggacaatttgattcttactttgaagctggggtaggaatctgcttagaaaatgtaaaatttgctttttttttttttaaattcaacttccattttcgatggagggggtacatgtgcaggtttgttacttgggtatcttgcacccaggcagggaccatagtacccagtaggtagtttttcaccctacgcccccttcccgccctccccacgctagtagtacgcttcggttac

SEQ ID NO: 24478 - DNA, 1046 bp, Homo sapiens
tcaggaggtatttgcagctgtctacaggaagcattttgaatatcagttagtgtctaatatatgtcaggtgtgtcaaaattatagcacttctgacagcaattatctcacctttgtacagggtatgaaatcaaggcttaggtgcaaagccattggataccatacctgagaccacacagccagtaagtgactaaacatgtaggatgtcctaggatgcagtgtctgagcacagccctttgggtcagtaagcccagtgttgaagctaattctgctattgacccattctcttgtttacctctcccctctgagccccagtcttctctcccacagagagatatataataatgcctactttcaagaatattgggaggattatatgagttgcttcagtttttacctagcacaagggctggcatgagtccaggtaaaaaagtccgtgaccgatggcaggctatcggtgattgcaagttctgcttttccttcgtcttaaataatctcacagtattgcggcttgaaaaggtcatagtagtagatgggactagactgaatataatgcactgtaagggacagcactgtcatataagggagaggattaaataaagtagaattagaattacattttgggaatgaacaaataaaaaatgctgcaggtaatttgggcttccaggaagtaaaaagtaatataaattatgttttcaaatgaaataggtcggtctacattcttttatcagagtcatctagattctgctctctgtgacagcagggactgagtttgtcacagacattagtttctcatcaaccactgcacaactagttcacagtaggtggtcaataaataaatgcttatcaaatgaatgaacagatgaatctaaagcttattgtgtaaggttacttggaaagttagggcagttgctgaacattgatgccattacgtccagaagtttggttgggtttggatctggtttgctttccaaactattattggaaatgtgtgaggtttcgttcctttccctttatccccaagttagttaatggattatttaaggatg

SEQ ID NO: 24479 - DNA, 1108 bp, Homo sapiens
ggattgttaaatactggaaaatgctcccaagatcaggcttccttttgtagactatttctgggaaatgttgaaagccgtttttggatggtgtaacaggtcccagcttagagtacatgaccgctcgtaaatgtaaccattctttcatggaacctttattgtaactgattatttcataaatccttgtgaatgaatctaattctagcacagacttctcagatactatagagttaatcttattaagcttcaatttggtgattttatatttgaagatttaattttttgaaccatacattggtgttgagcaataaaattcgatgtgaggtgattaaatggcctcacaatatgaaggtggagttgatatatgggaagttgatgcttgctgctgataacgataaaggaagaaggtatttttatgctaagttctaaaatagagctgatgaaaatgctaatgaaatcaggagtgtctgggtgcttcagtattgaaaaaagagtctttacctttgggaatctgaactatgattgagattgagattgtttttaaatactcaattggatatttttgagattatttttggattccagacattggatgtcctagttaatttcattgatagccatcatttctatcattctggtttttttcatataattatgagttcatcattagggtgataagagctaagggagtagttgtatgactttggatgagtgactgtacttctttgggcttcatttttctaatttataaaatgacaagataagctcagacagtatcaaaaattgtcggctcagaaattacttgacttctgcacatttgttttagatttatccttataggtacaggtacttttcttattggtcatgactatgaattgatatagtaattcttttgatataggaaaatgaacagatcaagggaatttgtttcagtggttttgtatttttattcctaaaatgccatttaattttcacaaggtccctcctggtagggctctgggatgggggaaaaatatgactattggagccttccccagtccacagttctagaatatgacagctctgaaaagccagaaaacagaaaaacccatatatccccagctcaatcatg

SEQ ID NO: 24480 - DNA, 1080 bp, Homo sapiens
tgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttct

SEQ ID NO: 24481 - DNA, 1599 bp, Homo sapiens
tagtaaacaattctcctgatgctaagtccaaagagcgataactttggtagttgcatttagtaggaaaccagcctctaccatgaactgctttgaaatcatgtatcctattttcatctgaaatgtgaagtgagtgctgcactttgtttctgctttatatggtagacattggtggacattggtgctggacttttggaatcagattgggcaaccaaggatgccgcttctcatgatcctctatcctcaatatctagttagcaaagaaattggcaaaaagacatgatcactaatgctggaagaaagcagaagtggagggcagcatattttcctgttttcagcaacaatactgccatgggctggccaggatcactggaagaatgtgagggaatgaggtagagagaaatgccttgggcagtcatttatttcacaaatatttattgagcatctactgtgtgccagacactgttctaggtgctggggattggagcttacagtctactagatggagacatttatttatgttttgtctaataagtcaggcggtgagaagtacagaaataaaaaataaaatagatccagacaagagtgcagtcattagaaacaaactggatatagtgctggaaatcatggcttattctctcttgtttccagcagagctatatggtctaagcaggtagggttttgggcaaaaaggacaggtgttcatgtggaaaaagacagttaaatgttaaataactcaattttataggatttctttcatgcagaatttctttgattgtttgttataactcacattgttcctaaatatgatttataatgacttacaaaaacatggtaccaggtcatgagaaataaatgtagaaacatgagcaaagggaaaataagggtcatttctttcatcattatgttccagaattgtttagttttggtagcagggaaaggaagaaatacggtggttacaaatgtggtgattcatgctcagggttcattatttaaaagaagagaaaataaattttgatgcctcaggaacttgtactttcttttggtgtttaaagaatcaattttatttgatagaaaaagtggtctctttactaaggacttgtatgaaatttatctcctgaattcaaagaaaactaacttcttttgggtcaatataaagtacaccaaaagttaacagatcaaaagtccaattccaaagttaaataatatgctacagatacaaattgatgagaggttatgtttggacccattactgcctggaaaaaacagaaacgcaaataaaattttaaagtgttgaagtgttttgcagaggtaattttaactacttgcttttattgagttttcttgttgttcagtacaataatttggatataagtcttgtgtcagaaatgtaatttgtaaattacttctcccagcgactgccttgtcatttttattcccttaacaatgtcttctcagagcaaaagttttaattttgataaaccagtttatcgattttttaatacatccaacttttattgttgtattgaggaattctctaactaaccaaaaagtcttgaacatttctattttcttctagaagtttcatgttttatgttttac

SEQ ID NO: 24482 - DNA, 1037 bp, Homo sapiens
gagaagaaaacgagaagcccccataagcccatttggtgtccattcttctctattggcttgtttcaatggaggcttctgccttgatggaaatgctgtctgccaccccatacagtagccactgttcttgggaggctattgagcacttgacatgtggaaagtgcaactgaagagttgaattttttaattttgatgaattctaattaatttgtatttaaatattcgcatgtgtctaccagctagtgttggacagaatagttttatgatttctataatatggaggtatgatagatacctttcattcgtacatacatacatacatatggaggtaagatagatacatagttaaaaaaaacaaaataggatcatactgcacattgtgcttttatattccttgtcttgctaacagtatatcataaacataattttaatgaccgaattgtattctgttgaatgaatgtaccataaatagcttaacaaagtcttcattgtacctttaggatatttccaatattttgatactataaacaacattgcagagaacgtgtttacagctaaagttgtaacattcctaattatttactgaggttaaattcttaaatttgaactattgggtcaaatataatacccattttcaaacctctcttccaagaagttctatcactgaacattttcatcaatagtatatgaaagtatctcactgttattatttaattgagatataatacacgtaccataaaatgtacctctttaaagtatacgattcagtggtttctgatatatttaaaaagttgtgcaaccatcatcactacctaattccaggagggttttatcactccaaaaagaaatctcatacccattaacaattgcttcctgttcccacctccccccattccctggcaaccactactccactttctgtcttgatggatttgcctttgcctgctctggacatttcatatagatagaatcctacaatatgtggtctcttgtgtctggtttctttcacttggcatatgctttcaaggtttgaggttcat

SEQ ID NO: 24483 - DNA, 1061 bp, Homo sapiens
gtttttgattttagttgcagttacttctagatagatctaaaacatcaactttaatgccattaataggaataattatagcacatatcagcctgattctccaacctacagagcagaggttgagttagtgataggatgataggtgataggaagttctctgaggttttctccctgcttccagcaacacgaacctgacttctaagggcacgcacaaaggcttttggcaatcaactgtgaatcaaggtgtgctgatgggcccttccagcctcagagaagagtaattggggtgaaaaaatgttattataataaaactataatattgctgtgattctagaaggtagctaaatgaagggaggttccctctttgaagaaaaatgtgaactaagtggtttctctgggcctaccacttactttcctgggaaaaggattaatttgagttaacatttattgagcttccagaatatcctatgaaatgctttaaaagtttaaaatacaattttttttctgaatcggtaattgactcatatgcttcaacatttaaaggcaacaaaagaatgtacagtgagaatcccccaccccatttttcctcctccaggcagctagtttttttctgcaaggcaacccatattagcagtgtcatatatattttgttaatatacaatatagtgtgctcagtcagtgttaataatcttaaagaaaacaaaatgccttttctctttttaaggacttcgtatttcataaaacatggtgagccaatcagtcatatggagctgtattttagaaacttttattataaatccagtgagtatataattcctagatgctccattaactttatgcttttgatttttaaattcagaaatcttccttctcctctatttccctcccattttataaactgttctcaaatctttggcactcactgttgcttccttatggggcagtgccagcgctgattggataagtagtaaacaaatattatagtaatagaaaaatgtagacacagacaatcaagtgtagattgactgtttctatttagatgggtctatatgtttatggctgtg

SEQ ID NO: 24484 - DNA, 1071 bp, Homo sapiens
atgttgcttttatttggatggcaataaaaatttaagataggcatattctggatcatttggatgactaccttataactgagtactgtgacatggtttccgtgtctgcatctacattaggtttgtgttcaaattagtgtcaagcaggaccactttcaatgtggagtgttcttaagaaaaaatcacggtagatttagtttgatcccagagcactgtttacattcaaagagcaaatgcccacacagaaggctgatgaagaaaggtttcacagtagttccagaagggaaggtggcaggaggattcagtcatcacatggaacaggagtaaatgcttgctgagctccagagaatccatgccacagtgatcagtaccatacagctcctcatttgggcagcagtgtggtttcagcagaacatcattcagcatgttaaattaatccttttaacttaacttgaatgctattggctttatggttttggttgtatttatttatgcatgttctgtggtgttggtagatgaagggtagtatgtctaaggattttgggcctggttttatgttgattgttttctaagtaacaccctaataatgataattagagttaacattatgggaattcaagggaagatctttaaaaaaagatctgtacgtaactaaagttggacaattactacgcggaggaaagggcactgaactgataattttggcctttgtgtcctcttcatgagaaaaggaaagaaaagagaagggagggaggaagaaaagaacaatttaaaaatgctgtacacgcctgtgatcccagcactttgggaggccgaggcaggcagatcacgaggtcaagagatcgagaccatcctggccaacatggtgaaaccctgtccctactaaaaatacaaaaattaaccgggcatggtggcacgcacccccagctactcactcgggaggctgaggcaggagaatcgcttgaacccaggaggcagaggttgcagtgagctgagattgcgccactgcactccagcctggccgacagagagagacttcgtctctaaatacatacataaataataatttaaaaa

SEQ ID NO: 24485 - DNA, 1031 bp, Homo sapiens
cagttgttcaagaacgttactcatcgtcagcagtggctctttccttatctttttttatctctggtaggctgattactctgagtgcaaaccttttcactgttccagagaggagcctgacaaccacattctccttctcaaggtaagaatggcagctgttacaacagccctcggcttttcatttgggagctctggttaagttgttgggaatggactcctgaaagtcccgggaccctgtgtttttcccatctccttggcagtttgccaggtttcccatcctaagccctcactgctcactgtgatcctgcggtttggaagcctggcttgtgcttaagttacaattctggtgaaccaaaaaggggagtccccatgctcagcgaatggttggtagatcaaagacttctctgcttaccacagaagctaatttggtcaattgaaagagaacttcctcagagtaatcttctcagtgacagatgggggtgcgtcgggggtgtggagcaatgttcaaaagtgtctgcattaagtgaaatacattgccgaatacacttagaacatgtgtgcactaattattgagcatttgtagttacagaatctttgcatgttaagccttagaaaatatttactgatctaaaacaggacgagagtgttaccccaacaaagaagagagacagcatagatggacgtgggcacattgaaagttatgtgtttaattgatgattgctttttacttgatgcattttgtcttttggttttaggtgtggtgcttactgcgcaggctgaccaggttagtgtgtcaggcctgattccatttttttaggtgaagacatcaaatcagaggtttggtttttctgagggcaggtggcaaatgccaaggaatgcctgtgtgaggcttcggggactgggcctggttgtctcatggtcttcttcttggctatcaaggctatcaactaccagcccagaggccttctgcctgtcaaacaggcctcccactttgcatctgatggctggaagagagggaggaaacatgcaaagga

SEQ ID NO: 24486 - DNA, 1029 bp, Homo sapiens
gagagagcctggaacatcccaatgccattcttcaaatgcatttccagctactcatttggtggggaaatgcttttatttttccattgttggatctctgtttccatcaaatatgtagccatgtggctaaggtggtaactaacaaagctggctggggttatgtttttagtatcttggcagtaaagagagatgtttatttggttaccttagctctgctcccatttggctatttccttctgtctcttattccccttcactttgtttctttggcagccagtagcattgctctttgtaaagaaaatggatgtaaattaccaggggaaatgaaacaactcatacattgatttttggcttagaggcccgacattttgggagtcaacagcaggatgctttgctttgggatctgcaagggattggagtagatggctaatgctctgtgggcaaatctcatgcctgccaggtgcttcttcattatcccttccatgcaatgagcaactttagcaggcgatgtgcagagactgtttataggactgatggtggttcacgaaatctgctgcccaaacaagagagctcaaactgcatcttctccttacacaacctggcactgtatcccttctgcaagagttttttttttttttttttgtactattgaaagtgaatagaactggaagtaaggtaatgtttattgagcacttattatatgctaggcattgtaaaacacactttgtacttaattaatgtaattttcactgtattttttataatttactctgtactatatccctaacatttaagtattactgtcctgatttatagaagagaaaattgagattccaagaagtattttttttttcaggttaaacagttcctaatagttcttaagttgaggatctcagaaaaatatccttgactccaattaaatctaaaatacactaagtcttaagactaactcgtgttccattaggggccagaggtttaaatactcaggctgagaagcaattaggcttccagcacagcctttccatgtggatt

SEQ ID NO: 24487 - DNA, 1055 bp, Homo sapiens
catttttgccatgagcattgagttactactgggagatgttgaacttgcagtgtaataaatattggaggagaaatgctttgttcactcgtcttgtggtaagcaggactgattgtattaaattacagacaattcggatgttttctgattttgcatgggctcgatctctatggcctcatcaaatcttcacagcaggaaggcatcaagagagatcctcttttttctcctgttgattataagccaaagggaacaaagatttccaggcaatatggaaattcctttgtgacacaattgtaggggaagggaaacccccacattcttactggtccaaccagtgcaagctgcgattcgatcatttcctttttttccctcatgtctaggagtttattctaagaaaataatggggcatagaccatataatgtagtagcaaggatgttgctcacgcattatctagaacataaaaatttggaactccctgaaatgagtaataataagaagttgaaatgggggacatggccctttaaaataacctacattttgatctgtattgataagattttatagttaaagcaaactgggttaaagagaaaccaacttctaacatatggaaacacttctttcctctaattctctcgagaccttgcgctatttctcagatacctgtccacaattttcccattgactttaatagcttgaggagaagctagcagattcagagaaggcctagagcatttggccagttggcaaagtgcgagtaccccagagccccaggtttcaatgtttgcttccttctcttcacccttcttcagcacccagctttcacatgcttgctttatacttcttaaaacctaaatgaccactttcccctacagtgacacattcttagcatgtccaggatacattgagcaagccagcctctctcaaaggcagttcttttgttcaccttatcttctaactggctgaagacttttaaaacctggcatatgaaaccaggctgcttcaattcaaattttgagtctgccactttctataatacaattataggtgacaattgatc

SEQ ID NO: 24488 - DNA, 1093 bp, Homo sapiens
tcaatattatgtgagattcatccatttcgttagatttagttgtaatccgttcattctcattgttatgggaacagatactataatttattcattctgtcgctaattgacatttttacagcgtgtttgtacaaatagttcttctatgcacgttctaggacttatcattcttgttggatgtatattgaggaatagaattttagcttcatagaatatgcataggtttacttttagtagtcctggcaaataattttgagaagtcatgatagtatatgaaaattgcactactggtagaagtgtagtattatttctcttttaaatttgatgagactattcaaattcaatggaagatatgttatagacgtcgtagaactaaattaaaatgttttaatttggttcaactttgaatggaagagcttagctagatatattcttcctacccatccatctctgctggtaatacaagagtttattagagattaaatgcctgctattgtgtgcaatgccctgtgttatatgttggagggaatgcagacaccaacaagaatgggcctgattctcaagattataatgtataatacaacagtagatctcaaccaggagcaattccctcttccctgcccgaagtatatttgtcaatgactggagacattcttagttgttactattggcagtgacattggcatctagtgagaagaggctgttggatgctttaaatgtcctacaattcacagagcagtctgcccaaaacaaaattatctagcccaaaatgtcagaagctgaaaactcccatttctggaaagatggaatggatgtacttttctattcctcctgctaagtatgacaaaaaattctgaacattatttattaaaaagcaaaccaaagacatgaagggactctgaaaggtgtaaagaaaatgacagactagggacttcaagactcaaggaacaacacagtgctgagttcactaggttttctttcagtctcatatattctagacttgaagctaaagaagtcaacatcctgcaaatgccataggcactggcaaaataaccccccaacagaagtttgctctctagcagaaggaccaggaagg

SEQ ID NO: 24489 - DNA, 1032 bp, Homo sapiens
taaactatcaaattttgctactggctgcctgccctgatcaaagatttggaaaagtgtggtaaagacagctggttgttaaataaaactatttacaaatcctttagttttcccttacatagacacatatgtggcttttacctgacagaacctcggaggtgattcccccctcctcacctttttgattcactgtagaaatcaaacaaaaatgttagtagggcagcgaggcaggagaatgtcagttacccgaatggtgccacaatggaaggagtcataaggctacagcattcaaagaatctgaagcatttagccaacttagaggacctggtgggaagctaattcaggatttccttgcagagggaccttgtataacaggaattatttcattggccgactttgtattcatctgaagcctgtttatagagcaacctagaaacttgcgcagccaggctgtaacagagctttgggaggacgaaagggactcacaggttgctgtgtgctcttggaaaaggtttgtgactccaggctcttggcagggttaagtaatttgtctatgatccacagacagtacaggcccacttcgttctctgctaagaccaagaaatctctgaaaacacagttttttcataacatatttggggatagaaccagaccggaattgacacaaggctatttaacgttttagtgtgtgcattagtttgctggagctgccataacaaagcatcacagactgggaggctgaaacaatagaatttcattttctcacagttctggaggctagaagtctgagatcaaggtgttgaaagggttggtttcttccgaggtctctccttggcttggagatggtcatcttctccctgtgtttttacttggtcttccctcttgcctatctgtgccctaatttcatcttcttataaggatagtagtcatgttggattagggcctatgctaatgttctcattttgacttaattacctctttaaaaactgtttattaaaccaatcacattctaggtactaggggtaagcacttcaa

SEQ ID NO: 24490 - DNA, 1034 bp, Homo sapiens
gttgttttattttctctcagtatatcctcccctctaatctgaattttgtgtttttgggagaagtttggtatcagcattggttctctgatctgttctctggatatacatttaattttatgattgatgagtatattgttttctctagttttatatttgagactttaaagagtatcacctattctatacaaaattaaaactgcttgtttttcagaggcaaatgctctagaattgctttcaaaattgaatgataccattaagaattcagacaaaaatgtacgtactagagcactttgggtgatatctaagcagacatttccctctgaagtggttggcaaaatggtgagtatagtttttgggtatgccatcttaactatatgccaattaaaagaaaaaactataatgccaataaaaacagttcaggcttatttcatttgtatttatttggttcgttttttaggtatccagtataattgattcattagaaatactgtttaacaaaggagagacgcattctgctgttgttgattttgaagcattaaatgttatcgtaaggtatgcatttggatgttgtgcaaattgaagaatagttttcataaatttagctgaaggagagggtttttgggatttaaatgagagacagacattaaaaggggggaatgtcatttacaccaaacgactcaaggacaaaaagtaatagaaaaaagatggaagtagatatgtgtgggttactaggttttttgtttatttttactgggaccatgttcaaggtgaagtcttggttatgttcctgctagtaacatacacagttcaggtttgaaaaatatcttaaagtttgtgtaaggatttaaaaaataatgtaaactcataagtgggcttgggttgtttaggaaggcagtcagtgtttagcagggaatagagtaccttcttcatttttgttgtaacaggcatgccaacgcataaactcttttaagtgtaaactctttgatgacatttctgtcttccctgttttttgttctttaaaattttcttgttga

SEQ ID NO: 24491 - DNA, 1776 bp, Homo sapiens
ttgctttcatttgtagacacccaaagtggcaaagaattggagtcacacaacgtgcatgtttccagctgaggtcaagcaaggttacgctctgcctttttgttttagttctcataccttaaacaggtgtcctttttataatccatgtaatgccacatttttcacttttctgtgcttttcctggtggtttcactgtttaaatttggaacctaaagcttgggtccaggtgctttctagtttgtgttcctaagcaaaggaaggctgtgatatacccaatggtgaaaataaactttgttcaggcatgatttatagagctactggctgtgagtttgatgttagtgattcatttgtataaaatatcttctaatagacgttaagcaggttatatattgaacagctgacaaaagtgttgtgtccagagaacctaaccctgtatttcccatgggagtgatcactcagtatttgccaatttagtgttcaaggctactttatataatagaaaaccataactactatgaataatgagagagaatcaactgtatgttcaatgattaagccaggttttgggtggtagggggtgtgctgcttttattgtggtaaatatacatgttctaaccatttgtaaatgaacaagtcagtggcattaaatctattcataatgttgtaagcatcaccactatctatacccaaaacctgtgcatcatccctaacaaaaactgtacccattaaagagtaaacttcctctgccctcctcctgcacccagacatcaccctttggtaatgtctgttctacttcctgtctctgaatttgcttattctaggtacctcataaaagtgaaattataacatatatgcccttccgtgtctggcttatttcactaagcataaagtttttttatttttctctgagacggagtttcgctcttgtcacccaggctggagtacaatggcgtgatcttggttcactgcaacctctgcctcccgggttcatgcaattctcctgcctcagcctcctgagtagctgggactacaggcatgtgccagtatgtccggctaatttttgtgtttttagtagagataggatttcaccatgttgaccaggatggtctcgatctcctgaccttgttatctgcccacctcggcctcccaaagtggtgggattataggcgtgagccaccgtgcctggaagcataaagtttttaagatttatccatgtcataacatatattaaagttggattcttatggctgagtaattgtatgtatataacacattttgtttatctgttgagagacatttaggttgtttctaccttttggctattgtgaataatgttgctgtaaacaccagtgtacaaatctgttggagttcctgctttcagttttttgggtatatgcttaagagtggaattgctgggttatgtagtagttctatgcttaactttttgagaaagctccaaactctttttttgagacaaggtctggctctatctatcacccaggctggagtgcagtggcacaacctcgctcactgcaacctctgtctcccagtctcaaaccatccttccatctcagcctcccaattacctgggactaccacccagcccggctgatttttttttttttttttttttttttttttttccatattttttgtagagactgggttttgccgtgctgctcaggctggtctctaactcaagtgatccgcctgcctcagcctccaaaattgttggattacaggcatgagccacttgaaccagccagcaccaaactcttc

SEQ ID NO: 24492 - DNA, 1035 bp, Homo sapiens
gaggcggaggttgcagtgagctgagatggcgccattgcactccagcctgggcaataagagtgaaactccatcaaaaaaaaaaaaaaaaagtaaatacaccattctcagccaggcatggtggctgacgtctgtaatcccaacactttgggaagctgagatgggtggatcacctgaggtcaggagtttgataccagcctagcaaacccgtctctactaaaaatatgaaaatcagccaggcatggtggtgcacacctgtaatcccagctactcaggaagctgaggcaggagaatcgcttgaacccaggaagtggtggttgcagtgagccaaggttgtgcccctgtaccccagcttgggtgacagagcaagaccctgtctcaaaaaaaaaaaaaaaaaaaaaaagaactatacccttctttttgctttttgataggtaacaaaaaagagaaaccaggttctgaagttttgactctcttattaaagtctttggaaagcatagtaaagtctgaagtatttcctgtatcaaaaacgctggtaagtataatacccgtatgttggactttaaaaaccattttctgaagttaaattttatatagaagatatttgcacaaatctagtttgggaagacttttttatatcaagcattcatcagcagtttagtcctattgcaataagtgccattctattaactgtagagtcatttgaaacctttttaatagtgactataacaacagccacaaaagtcttcaacgtggtaagaaaaaagtatccgccatacagagaaaaactagggtaaaggacatgaaacttgaactgaagaaactcagatgtcctttaattttatgacaagattgctgaaaactactaatagttggtactttgttttcaattaactgtttttaaccaagataatgactttggtattaaaaccccttttttttttaaacccgtgtagtacaggaagaaaagtgaattggatatgattttgaggatatgggcatctcaaaataagctccagtggaacaaacaataccctt

SEQ ID NO: 24493 - DNA, 2287 bp, Homo sapiens
caggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaa

SEQ ID NO: 24494 - DNA, 1050 bp, Homo sapiens
ataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggtaaggggaatgaggctaaatattaaggaacccagtatttggttgggatattttggccatacagtgacctctggtgaatgacaaaatattacaattatatggccactcatttgattatttaccataatggttgctagggaaaaggtaggtagaagaaaaggtttcgaaaaaaggagactgaagccttttagataagtctttcattttacaacactaaagatctttatgcagctgtgcacattgttcacctttggcaaaattgataaggctcctagcatcttttctgctccccataccataatatcatatgaggaaacagatttaggaatgcaggcaacactgccattgataaagcagatttagtagttgtgtgttggaacattatgctgttttacgttttacatacatgttccagaccatatctaattaaaaaaaaaaactcatgtgccttcatcaacttgtagatgtgatcttatttagttatttatatccc

SEQ ID NO: 24495 - DNA, 3046 bp, Homo sapiens
tcccataggaaaaagtgttaaaacttctcctactacacaatctaaggtaagctataggctttaaaatatacatatatgtataccgacacagaattacatgtacatgatgtgtcataaaatgaactatatatgtgaaaaacttcttccttggtttaaaatatattcttttgtctggtacacggtaagcagaaaggaagagaagcagaaaggtaagaggcagtaatgatccagcaagtaattgattaggtagtagattactctttttatgttttttgaacttttaaagaaatgattgcagtctaagttgtaaaaattgtgaaattatagtcatctagggttctgagtgtttttttctctcctttcttctatctagcataataccacttcagccaaaggatttctgtccccaggatcacgtagccctaaatttaagagctcaaagaagtgtttagtaagaagtgctttagttttcatgtcactttatattttcatgttcagtcagttgacctctgtgtaacagcttctgaaatttattctaagatttcagaaatggccaaagaatccataccatgcccaacagaaagtgtttacccaccattggtgaactgtgtggcaccagttgacatcattttacctcagattacatcaaacatgtggtaagtggttatttaggcttcttgcttatattccaagatgccacttatttaagaggacttatctgattgcttggttctcatgtttagaattgattggcatgtactctcacacacattttatttttgaaataaaaatgcaactgagaaggtaggccagataaggcaatatgaaaaacatttagtatagtaagatgtatgcataatatttcaggtgctgcattgaacccttatatcattatcttgtttaatccaaatataaaccttatgaggaatatgaatatcatttctactttataggatgaagtttacaaagattaccagcaaaaccacacagctgttaagtcatcacatgtaagaagcatgagactcacatacataaaacttgttcatcagctgttttgttttgtttctaattacaagtttgtttccttgatgttttaagtcttggaaacttaaatgcgtgcatgtagatcgttcactatatcttgattaaaagaattatttcaggtagtttgtgatgccttgagatagtttctctttaactgaattatcaagctgccctgtcgtagcataatccccaataggagatgaagtattcttaaacttctctgaggaatttaatgatgcagtaatatgtatcagacataccaagtccatttctgattaaagttggggaggggattatgtgtacttaagaattatctattaatgagatgtatgtagaagcacaaggcacgcagtgggctcattcagttgccagtactgttgcttataccagacatacacatcagattcgaattttgttttaaattacacatacatgtgcctgtcttcactgtgggctaacctcagttatgattgagcttaaatggggaaattgaactggataaacccttgcaaatagcatataaataaaactatataattataatttcctgtttctgttttgtttagggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtaaaaacttagatattagctatgatgtatattaataaatgatgtagcagtacagttacagaagtttgttaaaagatcacttcataatggcacagggaaattgattcatttattttgtactgtctttatgcattgcacctcagataaatttttaaattgttttttcattaaattctgttcatccccttctctctttcatttccaccattcggtatttgattccatggctgctactgctaaaacctagatgttcaaatccaaacatctaccaaaaccatacagatttgtaggtcacagtattttggtttggatgcctaccacatttgtgacttatttttcttatttttcctttttgtcagtattgtgcatatgaacattttgggtcatgggcatttttcaagattctgatgaaagctaagattcttccctgctgtaaaactatatagaaaattttgtatataatttcagaaggattcacagactactgaaacccattcagagaccctctatccattgacactacaggttgagtattccttatctgaattgcttaggaccagaaatgttttggacttcagatttatttcgattttgagatatttgcattatgcagctacttgccagtttagcagccctaatctgtaaatccaaaacgctcattagagaatttgggcatcatgtcagtgctcaaaaagcttcaaattttggattccattccatccaaaaaagattccatttttggagtaggcatactcaacctgtatcagaagttttgaataaatgaaaaatagaataagcagtgttctgaatcagaatttctcagacctggggtttgccagccactgaagacttctgctgtattcttgaaggtccttgattttatattaacttatttgtgatcttctaaacattcattaactggttactcagaaaaccaatactactagtaattttctgtctcacagattgaatttagtttctaaagtattttcttactcagtttccatgggtcttgggaaagtctatgagaattaggttttttttaacagcttcattaagatatgatttacatcgtgtaaaattcacctaccctatgggtgcagttagtttttaatatattcacagagttaaataatattccccatgatctaattttgaatctttttttttatcacccagagaagaaacactgacccattagctatcactcctcatttccactgtccagccaatgcctacttttcctctatagatttgcctattctggatatttcataaaagt

SEQ ID NO: 24496 - DNA, 1061 bp, Homo sapiens
agcggcagctctggtagatttttttgtgtgcttgtcctcatgaagacttaagcctgctctctcaatttgaaacctaggcacttggactaacttaaaagatcatgtaaaaaatttaatttttgtctggtatagatttaattgtggttttttttttctcttttagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgttggtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaa

SEQ ID NO: 24497 - DNA, 1029 bp, Homo sapiens
ttaaaaagaaagtataaatgggttaatttttttcttccaactttgactttaattcagtaagaaaggcctaggtttcatctcatattcttcataattgattttcaagaagttaatttgtcattcagcctaggaggctataaaacagcagttagttggcattattagactaaaacttgggtggggggaggagactgtttcctcattgctgcaacccatggtctatcctattcctaagccattagaaagaccttgtactttgtatagaaacattagagtgaggttttgatttttaacatagtactctcaaactttgatgtgcatatgaacaagtggattctgattcagtagatctgcattgggccccgtgagtctttttaaacacagtcccaggtgattcatgcagatgcctgtgaactgcgctggtagatgggcctaagaggcttcaggctgtgttttaggttttggtaagccaggcagattcaagtccttttataactgtcaattttgtgaattggggatgcagactggttttgaaggcttaaagttcaaaaattataagaaagttaagaattttgcttaagagccttttaaaaatatggacgatttattttttaagtaggcagactaagaatttcaagttataaagaatcttattgataaggcaaagtagacaaagtattttctcatgagtatttgtgggttatgtttttgttaatataaaagttgatttctaagtattagaatatatttagtctctaaataaatcttgccttctattatggatcatcgttattaataaacatggaaaatcaacactacccctaatattaatctggcagttaaatttagtagtgctataatgaataagtcagtctagcagatatgccctgtcattatactgcggacctctggtcacttaattttctgttatattatgtggttgaaaattcctgtttcatcgtaaagtgaaatttgaaagatggagttgaataatatgattctcgaaaagtgagtttttcttggaattct

SEQ ID NO: 24498 - DNA, 1930 bp, Homo sapiens
gaagtgatgagttgaagagaatggaaaaggcagattgagctggaattttaatgcatagtacatttagtagagagacaagctgtcctatatactcctgtatacttcagaaatagctgatagcctatagtctctgagagctattctgtacatagcacagtattataattgatgttcataaataccctgagagattatgttaaaatacattattaatactcccacaaaagcagtaagttaataagtatttccaacaaaaggcagctttgtttcttaaacggataaacaacatataactaggaagatcatcttcaaaataaagtgtcatggaactgaaaatagagtatagtctaacaattattttgatacactattgaatagctaacaagtgtctaaagaattttttatttttatagaataggaagtttctaaaagaaaacaattaagagcaaaattggttttgagtatagaaactgaaggatggcagtcttaactcctaagttttttacagagcacagattggtaaactagcatgccacctgttttttgtactatctgtgagctgagactggtttttacattttttaatggtgaaaaaagtcaaaagaaggacattttgtgacacatgaaaacatattaaattaaaatttcagtatccagaaataaagttttattggaacagctgtgcttattgtctttagctgctttcctggtacagtggctgagtttagtagtatagcagagtctgtatggcttccaacagtcaaaatactgcctggccttttaaagagtttgtcaatcccttttatggaggaaggttttgctcatgcatggcatgttagtcaatttagttatttgcttctagctggcagaatgtggtcttgattacttaatttctgttacccctgtgttttccagaatggcttctcctgattttacttacgtgttttactattgctcaaattacagatactaggaaacactactactttataagtacacttctttttcctacttaaactctcaaactacagttacgtatttgccatgatgttaagggaccttgatggtctgtgaattatcagttgctttctgcactacctcctgtagatagacctgactgatagcacttacaaaaagactgatagatgccaaatcagtcatttattaaccctctaatattgttgtcccgatcatttggtaaacgctaagagagcttagttttacattcacaaagtatttgtatttgataagtcttaaaaatgatttaagttgaagcctaacagaagtacttgttcattcctcagttacctgcaaataatggaaataatggtgcagtcagttttatttgattgtgtaatgctttatactaggggtctcaaacccctgggtggcattagattcttacaggagcgtgaaccctattgtgaactgcacatgcaagagatctaggttgtgcgctcattatgagaatctaatacccgatgatctgaggtggaacagtctcatcctgaaaccatctaccccaacacctgtgtctgtggaaattgtctccacgaaaccggtccctgttgaaaaaaggttaggggaccactgctttatacagtgtttgaagtaggcacacttacagttactatttctggttctttatgactgttgagggggggcagaattctatgtttgattcacagtaaaacttttcatgaatcattgagggttaactgttatcacttgccaatggaaactggatattgaaacatttttttaagaaatgcacttttacctgaaataaaactataaaaactaaactctggtacttgtttttgttggctacattttggttttttgttttgttgttttcgtgagatctgaaatgagtatgaatagtttaattcaaataccacaaagtgtatgttatattcctccacaaaca

SEQ ID NO: 24499 - DNA, 1748 bp, Homo sapiens
tcacattgacacagaaaaaccataggcagcttgagaacttaggtaacagtggagagtctaaaccgaaacattgactgcaggatctgtaagtcctgcagacaagtgtgatgctttgaaatgcctaaatagcttcaacgtagttggctgggagcattccggtcctgccagtcctctgcacagtgccatacatccagccttcatcaattgcttgaacatttatgatggcatctccatccttgaaggacacctcatctgcatcagcagccatatagtcatacatggcacggaagattttctattcgtggggatggaaaaggggaaatattatatgttggatttgcaacagttaacacacatctatttgtaagatctctcatgactgactccacaaacttaagttgaacaaaagagaatgtgcaagcatcaacaaagtaaaaggaacccacaaaataggaaatacttgcaagtcatgtatctgataggcaattaatatccagaacatatgacgaactcctacaactcaatgccttcccccaccaaaagaggcaaaggatatgaatagacatttctccaaaaaagatagacaaatagccaaaaagcacacaaaaggatgctcaaaattagtcatctggaaaatgcaaattattaaaaccacaatgagataccccttcacacatgccagaatggtgatgataaaaaagacagacaataacagacattagaaaggatgtggagaaattgggtccttcataaaccactggtggaagtggaaaagagtgcagccaccttggaaaagaatttggcagttatcacatgttaaatacagcattaccctatggcccagcaaattccactcctaggtgtatacccaagaagaatgaagacataggtctgcacaataatttgtacatccatgtccgtagcagcattactcataatagccaaaaagtggaaacaacttaaatgcccaccaactgatgaatgcataagcaagatctggtatatccatacagatctattattgggtagtaacaagaatggggtagtaacaagaatgaagtactgacacatgatacaacatggatgaacttcaaaagtaaaggacgccatgcaccaaggtcagtatattgtatggttttatttatatgaaatgtcttaggtagccaaataatatagtgacaggaaatggatacctaggattggatggagcagaaaggggatggagaatgaatgccaatgggcaccagcatttgtttgtttgttttaattcaccagaagagttttgaatacagttttttttatggtgatgaaagtattctaaaattagattatggagatggttggaaaaaaagcttaaaatcattgtacactttatgaacttcatactaagttatgtatgcatgaaattgtgtgtgtgtgcgcatgtgcgtgtgtgtgtactgacagaaaagacagaatatgctgctaattttatttatggcctttttctacctttcgaagaggtcagtcttgtattttagagaagaatttgaaaacccgtagcactattgcatgtcatctttcactctgggaatttgggagcatacgagtagtaaaagtttctcaaagctatcctccacagtgttaaaattgtaataatttggaggtatataataagtgataatatcaaaagtttcttcctaggagcagccactggttagtagttttggatgtaacctatatggttttttcttgcattttgaaattca

SEQ ID NO: 24500 - DNA, 1058 bp, Homo sapiens
ggaggagccagtgacacagggaaaccagtgcagcagccataataataacaataatgcaattaagttctgcttgactaggatagcatttttttttgcttgagctttcatttaccctgctgattaataacacatggtgtgaattaatctttagaaaaataatgtcccatcattaacatggtggatttgtgttcttgttaaggctagcagttgcaaatatagtatttagacaattatgattgtacatcccaagcttcttggggcagggttgttgtggctacttttacactactgtgtgtcgcagttactgggtgcaattccttttaaaattgtttacaatattctaagcctctcaatcaagaaacaaaaacaataccaggctgaccttttattgagtagagacaaagcttttgggggaccaggtcagcttgggaaccctcttcctagggacgcatttggaccattgatgcgttccttgtcccaggtcagctccacttgctctttgacaatctgtgagaggagttgaaaccttccagatcatctccgtgggccaatagaagtgcgcagtgttggtgatttctcttgttttttttttttttctggagttgtgtgtgtgataatctcaactttgcttttcttcatgagttgcttaagaaatcagttcaaaccatttaattgtggacatcaatcttgaaggacaagttttaagtggcagatttttaagtatgtatgtggagggcaatggaaattgtgttggcattattgataccagttcaactttcttgtataataaagatcatacgggtgttttgggaggaaaaccagatagtaataccgtatagaaaagtgtctaagcacctcattgtaagtatggctaacatcaataattaacagactgtttcaagctaggagaacagttcctcccaacttccagctctagaatatttaaggcctcagagagaagtaaacaaaaattaaaatgacaaaagtccattttatttcttgttaggaaagccttaagagagaacaaatctattcaatgactataccctccctcccca

SEQ ID NO: 24501 - DNA, 1095 bp, Homo sapiens
atctaggatagaagttgatcaaatgcaaatgtttggctccaggaagagactggcaacagtgtaaagtgatgaaatttggggagagatggtatgcgtggccttaaatccgtaagtgataagaagtactttggcttgtggcctgtcatttagcattggcctgggaggcaggagacctagtttctagaatcatatttgctgcaccaacttggacaagtgaaactctttcctctggcccttggttttcctcctttgtgaatgggaataaaatttggcacaattgttaacatagtcgtgagatgatggaaatcataccacttgaaaacaaaatttccagaacataatacattgtgattcattagttgacattggcttttgaagagctttcaggtggaaatgtgtgtaggggtgttctgtgtggtctaaagagtagaattccccagggtcagtgactgaaagtcatatgagcatagggaaaaatattctaacatgtagagttgttgaaaatggatggtgagttctccgttaaagttattcagataatctgtgtgacaaacactggtgattggaaggccctttgcagcccaagaagataggaagtacattattggctcgaaagttgccctctttgaggtgagtctgcaacttgcaggttctagacatagaattataacacctgagagtggggaaagatctcctggtaggtgcttcctgggcttaaagaagaaaaagatacgtatgggctgatgtttgttctggaaattcatttgactttataagaactgttgcttaaagggtttggtcttaatgaacagtgctcttctttttcatatttagagcttggggaatagggacaaggtaaagtgggctctccagccctcaggtttaagcaagtaatagatgtcaaaaaagtagctaatacaagaagcactgattatagatgattgcccctcctttgcaagaggacgctgtaactggagtacttttaggaacaaagcattgaatccttataaaagaaggaacagcctagaggaacttaggagggaaggtgagttacaagctatacagttgcttggcagatctcatcttgtagagcgg

SEQ ID NO: 24502 - DNA, 1053 bp, Homo sapiens
ccaatatctattccttgtagtaattgctaagattggaaacatttgctttttcaaatttttgactgcataataaacagtggggaataattaagactcaagaagatactgagaaaagggctaaattttagcaggcatactaatatatttgggtctatagtctcattttttttccaggtaaaagcatttatatggaaagtactacatttgtaaaaggcttttttttattctttgataacttctaatgtgtatctcttgagttttgcatatgttgtgagaacttggataatgataataatcaatttttacaaacttctgtttgaaatttagtttgatatggtcaacttaatttttactcacttgaaaacttccagtaaaatatacatgaaaaccaaaaacacagggcagccttttggggtgtgtgttctaaattgtggcttatttctggggctttttatattgtttcaatatactctttcaccttgctaataactttatagataattatccttgtttattgtctgtttctacctacatctgcgcctcttgacttcagtggcaaaataatatcacaacagaaggtggtttgatattttgtttctaggtgtctacattttacatggtaggccacacaagatagcatcattctcataaaatcatccattttcttggttttagctttctgattaacagtttaactatgaaagctggaatgacttaaactcaggggttttaatccagctttgccagccatgtccttaagatcccctgcattttaaccccaccatccgcaaactagattaactatcactgttaccgtcttagagcattgatatgggataaatcctccaaagggcttttgagggaaatgttttatatgtaataatgtgggatgaggaatatgaggaattacactcattttagtcttgttactataaagttatcaaacagaatatgacaagttacactcaatgccaaccatacctataaatactttttttcccattagtacacataatatattctcattgtagaatattagaaaacaattaggaa

SEQ ID NO: 24503 - DNA, 1034 bp, Homo sapiens
ttgctacgcagttaaattacagtctattgaccttaagtatggctttcattaaacagtaatgtacttgcttgatgccctgcctttggtatttcattttattgagtttgcctgaatccctgctaatcctcaaaatttgtgggtctggtaaggctgttggctgaatgaagagggtagaggtttattggtgcacttactgcgtgccgattgtctaggccactgacacatgcaacttagcctctgtggctggacatgtacatagttaacagtaaagcatttctctctttccctagacaggaccatggggtctgagttagtgtgaaagaatgcaaggatgtggaaatttgaacctcagggttgttcttactgctgctgtgtttcccggaaaacagccattgacttttcttctttctttttaacatggggaaggcatttatagcataatggagtattgtttgattatttatatgcatttccttgggtctttttgcttttagagttttgttgatttgttctttgctgtgtattgtggggaatagggtatgtgtatttgctgtgtattgtgtggggaatagggtatgaagcctatagggaagaagggtggatggagaggcactaaaagtacagggatttgacttattttaacaagaaaaaattctgatgactaaagataatttgtgaacatgtagttatggcttcataccttttgtcttagttcaggctggtataacaaattagtgtagatgaagtggcttgaacaacaaactttgatttctcacggttctggaggttgtaagttcaagatcagggtgccacccagtatggttgggctctggtgagtggcttattctgggttgtgtgctgctgatttcttgtatcctcacatggcagaaagagaactaggaagctccccggggtctctttttataagggcactaatcccattcatgaagactctgctgtcatgacctgtttcctcccaaaggccccaccttttaataccatcaagttgggggctaggatttcaacacatgaat

SEQ ID NO: 24504 - DNA, 1058 bp, Homo sapiens
tgtggtaatcatttcacaatataaacttatataaaaaaatcacatacacctttattatatatataattcttgtcagtcatacctcaataaagctggggaaaaaatagaagtgtgtccataatattcaataaataatacagtcatgagccacataacatttccatcaaaaacggacaacaaactggtctcacaagattataatagagctgagaattcctatcatccagtgacattgtagctgccttaacatagggcaatgcattacccacgtgtttgtagtgatgttggtgtaaacaaacctactgtgctgcaaatggagaacacatacaattatgttcagtatataatacttgataatgatcataaacgactaagttactggcttaaaaaaataggagtgtggtgagggagagaccaacaaatagggcagagagagaggtagttttaatttctgggagagatgcggatattaaatttacctcccttggaaacactggaaggaggataaagcaagagggctctgggaatctagtggaaactttttaggtgtggacacttccgttaatcctttttttttttttttttttttgtagtttagggggcaatagtgtattaggctctaactttgggttttgtgatttccttttataagataaatttagttttcttttttggagtttaattgtttattgtaatgctaattgtcttcatgtagcatgttgtaagcttaaaatgttccgtaagagtaacctggcgtggtggtgcatgtctgtagtcctagctactagggaggctgagatgggatgatagtttgaacacaggagttcgagaccagcctgggcaacataataagaccctgtttcaaatcaaaaaaccaaaaaatatttcataaaaggtagctgctattaataatggcataattataataatatcttactgttattatatatccagaatggttatagcaaacttggtgctctttgaaaattaccacagcagctaaccctggaaaccaaagaaagccattgaggaaaccctagccatccccaaacttagag

SEQ ID NO: 24505 - DNA, 1359 bp, Homo sapiens
gggagctaccatatgttatacagatctcatcccttacatttctagagttgtactgtaggaactatgtctagtaaaaatctcactcttggcttatatgcatttggaattaccctttcatataataaagaaatagggtattgatttctatttttgtgaatgcttactttgtgtatatttatctttttaagttttcgtagcagctctgcaaagtaggcattttatctttattttccaggtgaggaaactgattctgaggagtaaaataatttgctcaaagttttgtgatagtggcagtactcaggttggaaacaaggattggctgactccaaagtccattttctgtttgttacttaagttgtacttacacattttcctaaatttatttttctcatgacttgtcctcactccagagtctggattaccagcccctgtggtctagcagaagtttgggatgttgaggtagggcctgggcattggggtgtagacatcgatattgctggccaggataggggctaggccatggaatgactgtgggtagaactcagctggtggggagatatggtccatttgatggctgacattagtgagagggcaggagagtactcttgatcagtgattggtttcccaggacagaagcaaagccttccctcaggcttcctgagtgaaagagcatccttcaaacatcgtgcttgaaaggtggactcttctcctcggttcagtggaggcagcctgcctgggtcccttgagtgcgccttcatcctggggcatcttgggatttaggaagcttgtatctgaattttggaatgcaagggcttctggtgggggccattatattttcagctaagattggccttccctggtccagagcctgcacacgtttctaaaatctttttcaaactctctgctgcttcattaaagtaagaaaaaatagctacactctagatttggtttcttgtttcttcaatgacactttgtctcctcatcctaacacagtaatcaactaacctagtaaactaacccatgttagtgtagctaatatccataaatgtattagaggaagaattcttttttagcaagaaactccgaggccatgctccctatctttgtctaactccttggtgactttagtaatgagaattttaatctagaggctccagggagacaccctccccacaaagtgtgggattgctcctgtattctgttaatgcctatttgttaaaagagttaacagtgacccttgaaccatgaagcaactctttttggtgctaaaagaacacaagtgcccaagaatgcagcagcatcgaaactggggatgaagtgatttgttcttgacatcagttggcaggtacattctcttgc

SEQ ID NO: 24506 - DNA, 1054 bp, Homo sapiens
caaggcttctttttggttgaaatctaaatgctgtttttcaatttggacttaacagggagggtgctgcaaatgaaaggagcattttttttttctataaagcctaacacagtgttagggtgtcttagtccatttgggctgctgtacagtaacagagtactataaattaggtagcttctaaagaacagaaacttatttctcatggttctggagactgagaagtccaagatcaaggcatcagcaaatttgaggggaggacctgcctcctggtttggagacagccatccttctgctgtatcttcatatagcagaaaggataagtaagctctctgggacctcttttttaggggcactaatcgcatttacgaggactccgccttcatgatctaatcacctcccaagagccccatctcctaaaaccattacatttaggggttaggtttcaacctatgaattttgaggagacacattcagtttatggcagtgggagatactttgtcttcagataattagatctttaactccgaattcttatgtaccttttagaaataaggactgatttagactagagttgttgggcccggcgtgacccgaagtagtggagagagcacaggactagagcgcagacctcaggacgtggatccgagccggcgcgatgggcggagagcaggaggaggagcggttcgatggcatgttgctggccatggctcagcagcacgagggcggcgtgcaggagcttgtgaacactttcttcagcttccttcgacgcaaaacagactttttcactgcaggagaagaggggatggcaaagaagcttatcatacagactttcagccacgacaatcagctggcacagaaggcccggtgggagaagagaacccgggagaaggtggagcgggtggccgggctggccaaggaagccaagtcagagacctcggggccccagataaaggcagacaggcagagaggctgcagctagagattgaccagaaaaaggatgcagagaatcatgaggcccagctcaagaacggcagccttgactccccaggaaagcagg

SEQ ID NO: 24507 - DNA, 1779 bp, Homo sapiens
gaacattattggaactatggtatcagatttcctgaaggtcacattattcattaataataatgttgctctttgagcccttaaaattggcctttttctagactcctaaactctatatgttcttaatgaaataacgctggctagagcccttaccaaaccctgaccagaaacagtgaattaaaagatacagaagactgggagctagaagttgttttttttttttttttttcaaacccatattgtctcgaaaacatctaccttaggatctattcacatccttattcacatgccaactccttgattcatttgcaagattgccaccctccttgctatttacaataattcattctttaatttcaaatttttatgctattttcatattgtttaaatgaggttctctacctacccaacatggtagctatttgcctaatatcttagttgtacctaaacattgtggaaggtagtttcttttataaatttaaaatgtttggcttttcaaacccctgttttctcatcttcctttgtcagagttctgtttgaggtgaccaaagccacttggatcctgatttagtggatgatttcagtgaaattaagactttgggattgacttttctctcccccccactcatcacagtgggaatgcatttttcatcttttctgtggggtgatttggagaatgactgagatggttattccttttttcctcctgtttcagtctgttctgtgctgtaatgacagaatacttgagactgggtaatttataaggaatagaattttatttctcaccgttctggaggtgactgggaagtccacgatcaaggtgccagcatttggtttagggagcatttggtgaggaccctcttgctgcatcctcatctggcagaaggcataagtgcaagtcatccaaatgcggagtgaagcctcttttataagagccttaatcccatcgagagggagaagccatcatggcttaatcacctttaaaggctccacttgtaaataccatcactttggcaacacctaaattttggaagggacacattcaaaccataacaccccctgtcacctattgtctgccctccttttgggagtgggcagtggtgctgactgacagatggatcctccaggcttccttgccctctggcttctaactggattggccaagggggaacttaaggagagctaagagtgggaggggagagagctgccagtcgccatatctcttctctctgcctgcttctctgctgcagttttgtcagtgactgtgtcccaccaagaaaccactcttgcctggtgggtcctctttcaggcctccagcaggttactttcctctccttgatgcttcgagtcactttctacctgaatgccccttgtggtacccttcacccttccctcatctttgtaaatagtccttcagtcagatgtcttcattgaaactatgtgagttgcctctatgtagtacatgtaagacactgttaattaaaagtacaggtaagacactgtggtatcaacactttaatatgaggaaacacatagcacattaaatgtacatgattataagatatgtcttaatttcagatacattaatacttagaaacaacacccatgactcttaaaacagagggaaacctatgaaattgctactggtttttcattgtgttaaagataccataataaatgtctttatttataaacttgcctatatttgagattatgtccataggatagatgagaagagagttatggacattttctaagacttgtttctttttgccgcattgc

SEQ ID NO: 24508 - DNA, 1189 bp, Homo sapiens
tatctggaccagtcccttaaaattaaaagttaaattagatgtgatgtgatttgaaatttgaaacctatgtttttatttaactagactacaatggtacacttagaatttttgttcaacttccccacccaatatgaatttggagaaaaacaagaatgactaaaaaatcagcaggctcacatgaaattgagaggacggtttggaaatctccttgaatttctttttgtaagccaaatttatttttataagcctttaacggaagacagtttgttctttggataattggcccaggctttatcctcctctttcaaatatgcttcaaccaaatacccaactgtgagatgaataggataaatgaaggtgggagtcgtagagtggtgggggtgggtgggccagggggcggggcggcggcaggcaaaacagtcatgtggaatcttttgtttcatttttaaaataattcttaagagctgctgtctttcgacagagtcagaaagtccttgcttaagtgtatttgtcactatagagagtgaatgggattctgaagtctttaacgtggttctgtaaatgtaagtcttgttgtttaatcacggcatttctgcaaaaatgaactcctgtacccacatccctccccctctcctttattttagtgtcttagaactcagctaagcatttgaacagtcattgctaagtgtttccacactgggggagctagaagaacttggctggatagaattctgattttcatgggagggaattagttttccgttttctgccttagaagtcatatactatacttgctatttgggctgaactgacttgaaaagtcaaacaggaatgagtctagctactaaatttagagaactgattcgtaatttcttgatctaatacagtgggcagtcttgtcattgaccagttatttatttcagtgtttgccaaacctagaatgaaatccaaggctgctgcttaaccctctatagctctggtagttcatttctacttctcctgctcatttccgaagataacatgtatccagagagcctgtgaggtcctggcttagatgagtcctgcatatcagggcaaacttccatgcctctggacatctttcacatttcagacattgtcttatttctttttcttatccagttaacaagtatgtttttatttaagtcaggctttaactctcccctctctc

SEQ ID NO: 24509 - DNA, 1084 bp, Homo sapiens
tattattttccatactgggttgctgggacgattagaaaccgagcatctgaaaactctttgcacagtgcttaaggtaattaatgagtgtttgtcattatacttatgttgatgttaaattaacatcttaaagaactctaaaatatttttcactttctgtttttgttttttttttctttccccctgaagcttcagaatgtcatttcctctaaatgcctgccaccctcagggagttctagtaatagggtgaacataacatcaatggaatatgaggagttactattagcagatgctatttgtttcccttttcatttctttttttacagtcgtttgggagaaacccttccagccctgggcgatgcggtgtgtcagtgtctgcctttctgccgactcctgacagcgcctcccttcaggggtgtgggtggagctcttcatgcctgcccctcctgctcacatttctcggttcactggaaaagtccccaaatctttttgtctgctcagttgtggcctagtagccagagtggctcgtgcattaaacgaagaggaacctatgtttcttctcttttcagcattttggctgaattttgaatttttatctgccccattgagtctgttggctctggctgctgctgtaccaagccctctttctggtgttcataaaccaatgagagtacaatttcatggcctgggtcaggcttgtttgttggtttcgtcttaattagaagcaaacctctttgtcttcccttttcttcatcttccagggagaaatggattttctaggctgagcaaattaatcatagtggtgtctaataaaaaacaatcaccactgcagtacctggcacacagtaggtactcagtagctgaaagaaacagttcctgtagctcttccaaggtatccagcattttgtgcaggtaggctgggggctgctgaaggatctgtttgtgaaagacgagaattagcttaagtaacttgggttggaaaagtcactctgccttctgagtgacatatgggggctggaaggtggcagagaacagggttggagagtttctctggtaggtggattagtgttgttcccagctcagaata

SEQ ID NO: 24510 - DNA, 1101 bp, Homo sapiens
ctatagaatatctagggaggttgagaagtttctagtattttgaaataagaatttatagcaaaccctgtgttttgactaattgtgttctataattctgtgatgtggctattggtcataagtcattagtgactttggatagagatagttcgagtggtggggtagaaagtgtttctagttataatatgtcatatacctcaaggtctagtctaatgtctgatgccatttttctggtctgtctagagattcatctaacactgctgcatgaaaatagttaaagcttgcatgttctcacttacaagtgggagctaaatgatgagaacacatgggagcatggtggggagcaacacacactggggcctgttgtgtgtgaggagggaggaggcaggtgggaggagggagagcatcaggaagaatagctaatggatgctgggcttaatacctgggtgatgggatgatctgtgcagcaaatcaccgtgtttacctacgtaacaaacctgcacatcctgcacatgtacccctgaacttaaaatagaagttggaaatttaaaaaagccttagaggaacaaaaaaaaaaaaaaaaaaagaaagaaaatggttaaagctgaagacagcacgcagtgtccgaccaaatgtgtccatgcagagctgtccctttctaggccggtgcccctgccttacattgtgtgtaaactcttgatccttttctagagcctagtgaagggtctagctgtgggaagtggagcatgaactggaaataacttcctgcctctagcgattcatttttcttttcagcaccatttcagcgatagaggttttactgaaatttaaagagagaaaggctaaaagcttagtatttcaatgtgccagctattgctgacttgcagtaaagaactgttgccgaattaatgtggttggtatttactgacagatcccttagatagcccacttcttttgtctttttttttttgttttcttttcccttctaagacttctgtggcatctatcttcaatttgtcttcaattttggggaaatgctctttcttttttaatttctaagtttttagaaattgatgctctcagatatgtctgaattgacacagt

SEQ ID NO: 24511 - DNA, 1407 bp, Homo sapiens
tgttttctcctatacccattgaattcgtcaaaacatacctgactgtatgtgtaagggagctgcttaaagattttggcagtataggtttttgcacctagcatttgctgatttcttaaaaaaaaaaaaacacataataacagaaggctattctgtatctatttcagcactgctgagtgtttaagtatttattgcttaattttaaatttttggataaaagtattggataaaagttgcttagaagcaacttttagggagttgcttctgagagtgtgttcaaagggtacctttgactcttgttggagtttgagtaatgttcaaacaagagtaacataaaataatcctccagtgatctgaaattgttaattgtcgggataagcatagactgtcctcttagttcaaaccaacagactgaggaacttgttcataaaactctcttctttgacttggaaagacagattaaatgtggagtaaaactcctcggggttttctcttttttggactgtcagtatggcataaaaggaaaccttctgtaaattgaatactatctgaaaccagatgcactcatcaaagcatttgttgaactcctatgcattaggctctgtaattctcgtgaagccttgcaccattttcagcattgaatttaaaagtaggtcagtgaccacagtgaggtaagaaaaacattttttgcaaaaagaaaatccttggagagtgctgctttgataagacgtttaagctttccctcagatagctgattacatgcgtgtgtccggatttcctacatctctcatgctcttgtcccttgaagagtctctgaaatacagaactgtttagtgcttttaagccatgcactttgtgtttgtcgagaagaaaccaaaagacctgtgcctggcaaagccatgttgaagcctctaatgtctaattgtctgttggttaagatggcactcagtagtcaagacccaaaacactgaactcaccaagcaagcacaacagaaggggtgttcaatatttctctttttgtaaatgcttttgtgcctcttagttgctagaaaggactagatgatgtctgttttaggcacacttcttccttctttctccctctggtttctctctctttagtttctctttccggaactatgggatttttgttgcatgatagcctcttagatgtgtgatcttcatgcttaatatgcagtgatatgcagggaacagattctgggactacttttttcctttttttctctgctcataggccttggtgtatgagattccttttcaggatttttctaccatctaatggatttctgcaaaattaattaacagtgtaaagtttctcaaatttttttcctgacctctccccttaaaatagtctgtagttttatggcaggacttggggggctctcatccttg

SEQ ID NO: 24512 - DNA, 1033 bp, Homo sapiens
ccagccagggtgacagagcaagactctgtcttggcgtcagggggtgggggtgggggtggggattacagaaagaaagaaaatacggctgaatgaaaggtcaggagtggattctgggccctgactgacccagtgtgattcacagactccttcattaggagcagtctgctcagaaataccctttgcgtatatatttaaaagagctttctgtgtcatgtttgaactgtgacttattggggattattaacacttggtggggaagggagggaacaaagaatcctcagcccttcatcttagaggaggggacgatccagtttgtggattgccaggacgcttgttttgtccccttcctcccctgctgcccagccttctggctgtattactgcttatttgcctctttgttagagggagaaacaaaaggagttcagattcaatgcctgcttttgtttttgggttagcagctttggttgaagtttagctgaatgagagaggagagggaaaggtaaagactgagctatctgttaaggttattgactaatttagattgtatgccattctgtcccttgcatgctgtctgcgagggcacagccattataagcagagagtgaaaagggagattgtgtataacagaaagccaaggcgttagagcctaattggaaacaatacatgccccaaatgtgctctcgtgtcctagccaagaacatggtttcaaaaacatgagaaataaggataatgaaatgaaaaacactttagaaagcttagatacctcaggtattgtattgtgggggaaatgaaaaattaagtattagatttatatgttttctggctgggcgcagtagctcacgcctataaccccagcacttcgggaggctgaggtgggtggatcacttgagggtcaggagttcgagaccagcctggccaacatggtgaaaccctgtctctgctaaaaatacaaaaaaatttagctgggcatggtggcagatgcctgtaatctcagctacttgggaggctgacacaggagaatcacttgaatttg

SEQ ID NO: 24513 - DNA, 1052 bp, Homo sapiens
caaagtggcctgagactgtcactttatatttctgtaggaaaatgtgttccaaaggactgatgtgcaatgtagcccattgatatcttggaaatgatttagggtcaagaggctagagaggtgtatattaacacatttactatcagaggtggattcagtgaagaaagaagccccgagggattcctggaagggtaggtgggattttaacaggcaagggaatgaggaagggcagttcatgtcaggagggtggtgtgctctggaggaaggaccctctaagtgaggaataaggggcagaggtagctctgcatgcttatttttgcaacgtgttaggtcacgcagaaaaaaaattaacatagcaggcctgagactgctatgcttagcaaagggcctgcctgcaaggttggcccttggctggcatctaggaacttgtgtttgacgggggaaagttcctaccatttcctgataagactgtttcgctgtgcctaaacagtttatgaaaacaatacggcttatgctgaatgcctcttttccctctgggagtctgaatttgtgtaatgtactaggcagagagttgcctattaaaccagctcccaataagaacctggccactgagtctctaatgagctttatgcatgttgtcatttgtgtctcctcggggagaggactcctggaagattgcacctggtttcctgcacgttttatcctatgcaccttttctctttgctgatcttgctttgtattcttttactgtaatacatcatagccacgggtatgactgtatgctgagtcctttgagtgctcctaatgaatcattgaaactggaggtagtactggggtccctgacccataggaatattggtgaatactgttgtgtgtgtggggtagggaaataaaatctacttactgaaaggcacattacataaaacaaggactttttgtagtcctttctcagtagttaattttcatggtgaggaaaatttgtgtgctctgcaacaaaaaaagtgagggaagcccattttagaagtgaagatatttttcatattgtgttaaattta

SEQ ID NO: 24514 - DNA, 1095 bp, Homo sapiens
ttctggttttattttgatgttaaaggccacagcattggatatgagggagaaggtgagtagtagagggtggcaccagggcttttgtcttgggcacctgtgagatatatttgctatctacaaagatgggaagactgcaggatagatggatttgagggagatcattaggaattctgtttcggggattttaactttgagattccccttagacattcaaatggtgatcttaggtgcatggttggatatgccagtctggatttcaaggcagtggtctaggctggagttagacatttgagagtaattagcatataaatggcataggaagccaggaaggtgaatgagatcagtaggggtagactgagaagtaaagaagtccaaaatatgaactctagggctctctgtttaaatgtcagagagacgaagaaaagctggctagagagcctgaaaaatagccaagtaggagccaagtgaaggacatatttcaaggagaagggagtattcagctctgttagatgctgctaagtcaagtaagatgtggagtgaggattggccattggcttcagcaaagtgcaggtctttggtgatcttggcaagaacagttcattgggatggtgggggtgaaatgcttgattggagtggtttcaagaatgagcaggaagtgaggatttatactgagtgtctggaggagttttgctgtaaaggatagcagagaaatgagaggcagtggctgaacacaggttgtggtatcaagagaggtttttattgttacttaagataatttgcattttttatgctaatggcaatgagtctatggagagggaaaaataagggggaagggaggaatttctggaacatatgatgttcgtgagcagatgcgagggaatgggatggaggaaggactcatgggaggggttggccttagtttggagcacagaagagttcctctttaataggaggtgaggaggtaagccacaaatctgtgtggatagattgatgtggtataggaacttctggatgttttctctgatgagctgagagtgagttttgaggagaaagaatatagttgacccttgaattttgtggggtgtgaggggtact

SEQ ID NO: 24515 - DNA, 1050 bp, Homo sapiens
aacactgtggacaagacccattcagcaatgtactaatcacagtccatggatgctctttaagagcctctttactcattcaaagtaactgaagtcagtaggtactttaatttgggtgagccaacaggcttccagcccagggttgggaactggttttatcagccaagaattgtgttaacccagcctggttcctgtctgattgaattagcataatgctatctcctcgaaccaattctcccaaatttctgtacttccttttacagatcagagtaataacttgggcactagtaggagaggcagcaagtgacttttccttcatgtctgttgcacatgaatgttgcttataagcttccagatgcttatagctttttataatgggacagtccaataatatgcagatgtactgaaaatagtatgatgaggtcccatgtatccctcatccatttcaacaattacgaactcatggccaatcttgttacatgtacactctacctacccccatatccaacccttgacaaccaagacgtagaatttcacttggaaatatttcagtatgtatcttcaaaagataaggactcttaaaaaataaaaacaaaaacatactttacaccattatcacatctaagaatcccttaatatcaaatatctagtcattagttcacatttccccaactgtcctgatttttaaaaatagaattcctagactcttgatgtctcatttcttttttttttttgatggagtctcattctgttgcccaggctggagtgcagtggtgctatctcagctcactgcaagctttgcctcctgggttcacaccattcttctgcctcagcctcccaagtagctgggactacaggcgcccaccaccacgcctggataattttttgtatttgtagtagagatggggtttcaccgtgttagccaggatggtctcgatctcctgacctcgtgatctgcccgcctcggccacccaaagtgctgggattacaggcgtgagccaccatgcccagcctgtctcatttcttgttatagcttagtgaacattgtacatt

SEQ ID NO: 24516 - DNA, 1050 bp, Homo sapiens
agtattggtaccaagtagattgcttataagatttttgagctaatgtccttcaacatatccattaataacaataactgctatacctaacatgtattaagaacttactgtgttcaggttggatgcagtggcacacgcctgtaattccagtactttgagaggctgaggcaaaaggatcacttgagcccaggagtttgagaccagcctgggtaacatagggaagccccatctttacaaaaatcagctgggcatggtggtgcacacttgtagtcccagctacccgggaggctgaggtgggagcattgcttgagcccaggaggtggaggttgcagtgagtggagatcccaccaatgcactccagcctcggcaacagagtgagaccctgtctcaaaaaaacaaaaacaaaaaacaaaacatactgttctaagtaggtttacagatattaacctagcccttttatcctatacccagttaatatgctttgatagcataatcacctgccatatgaaagtgctcaggaatgcgaagtgctctaaagtgcaaaatgacttgcagaaggaactgtgaactatgcacagctgcaaatcaggcctttcttaactctcttatacgtccatagcatgatggaactcgtaatatgagcttaacacagggagcccttttaacctagcttgtatatgtagatataggcaatccatagctttatgtcaccctactttagtaggccacctctattccttctgaatgtcatgcccatgttcaactatcagtaattccatgttggagcaaagctgtgaggcaggacatgaatacaaaggcttaggtcctcccactgtcttatctcattcacgcatcttcaccggtagctctgttccatgtcaaacccaggctatttcttctgtgatcagatcatatcttgacctgcttctttggtcaggatgatggcaccagaaatactaacagcaaatatcattggaaaatgccactgtttttaaattgggggggaaaaaagggtcaaacttttcaaagtaacctcctgggcacagtttttga

SEQ ID NO: 24517 - DNA, 1026 bp, Homo sapiens
atgtttcatttatcattcccctccccacttttttgcccttttttgcaattctgatagttttgtctcctaggtggtttatttctgttttgctcggagacattgcctttgtatcataaagtcacaaaaccatgataagtggaattccattgcagaagacattgaactgtgcttatttggaagaatagagaaaggaactgaactccacctagtatgccctttagtgtttaccactaccttagggaataaacagtactctcatcctatgtacggtatatagctgttggctcccttagtggtcaacacattaatttgcttgctgaaggtcacatagctggtaaattgaatcagaatttgaacccagttctttgtgactccagagcactttccacagctccacaatgccttcacagcccttgagttacttttcaaattatagtattgctttcctacctaagtccctctttgtatttgcagagttgcatgctgagaatttgaaaaatgaagatgatgtagacactggactattaggtatggacttaattgccgcttgctttggttttgagctcacgtttgtgtttctagatcatgtttgaactaactctgggataaaatacttaatgtatttctatgtgcagtcattcagtcttgtttttaatttgcatatgttggtgataaatgttattagatttcctttatatgtgtggagtatgtgtatgcatatatggtatgtttgctataattttttaatggggccaggtgcagtggctcacatctgtaatcccaacactttgggaagctgaggcagtagaatcacttgagcccaggagttccagaccagtctgggcaacatagtgagaccctgtctctacaaaaaataaacagaattagccaggcatggtttcactcatgtttgtagtcccagctacttgggaggctgatgtgggaggatcacttaagctgggaagttcaaggctgcagtgaaccgtgatagttacactgcactccagcctgggcgacagagtgaga

SEQ ID NO: 24518 - DNA, 1029 bp, Homo sapiens
catggataaaaaatatttgggaaaaaaattacaatacaacaataaaaagtaatacaaataaaaaacagtatagacaactatttacacagcatttactttatattaggcattataagtaatctagagatgatttaaagtataggggaggatgtgcatacgttataggctaataccatgccattttatataagggacttgaacattcatggattttggtgtttgtgggaatcctggaaccaatctcccagtggataccaaggtgcaactgaactgctgtctttccattaacaaaaagagatacagtcacagccctctattggttaaaagccttcagtagctttcctgttgccttcagaataaagtccaactcttaagtatagcagaacagtccttccccaaatgaccctaccctacttttccaacctcagctatttccctactgcaccctatattgtagtcacataccagattagcttgacatccccctcataaactatgcaattttgagaagtcatgattttactcttgctgttctctctccctggattatcattttccctttcatgttgtcttttaccactgtcacgattcattaaccttataagtgtaagaagcctctggggttagagaaggttttagtattctgttaaagatctgctattctgagggcatttaactaattttaaaaaaaattatctttgcattttgtattaaattagaatcaatttaataaagggcctcaattttccatgtatttattaatgtattagtctgttctcatgctgtctaataaacacatacccaagactgggtaatttataaaggaaagagttttaattgactcacagttccacatggctggggaggcctcacaattatggtagaaggccaaggaggaacaaaggcacatcttatatgatggcaggcaagagactgtgcaggggaactgctctttataaaactgtcagatcttgtgaaactcactcactattatgagaacagcagcatgggggtaaccacccccataat

SEQ ID NO: 24519 - DNA, 1039 bp, Homo sapiens
gttaattacttccaagataacaatggcggtacaagcactgtaaatacacccattccaaatgggataaattggccaaaacaaaggggctacaggcccatgcaagtccgaaattcagtagggcagtcaaatcttaaagctccaaaatgatctcctttgactccgtatctcacatccaggtcacactgatgaaagaggtgggtttccatgatgttgggcagctctgcccctgtggctttgcagggtacagcctccctcctggctgctttcacaggctggcattgagagtctgcagcttttccaggcacatagtgcaagctgtcagtggatctactgttctgatggccctcttctcacagctccactaggtagttcccccgtggggactttgtgtgggggctcccaccccacatttcccttctgcactgccctagcagagaggttctccatgagggctccacccctatagcacacctctacctgaacatctaggcgtttccatacatcctctgaaatctaggtggaagttgccagacctcagttcttgacttctgtgcacctgcagtcccaacaccacatgtaagccaccaaggcttggggtttgcaccctctgaagcaacagtgtacattgaccccttttagccacgcctgggacacagggtaccaagtcctgagactgcacaaagcagcaaggcccatgaaaccatttttttctcataggcctcccagcttgtgatgggagaggctgctgggaagacctctgacatgccctggagacattttccccattgtcttggcaattaacatttggctcctcattatttctgcaaattgctacagctggcttgaattttgcctcagaaaattgttttttcttttctgtcacatagtcaggctgcaaattttctgagcttttatgcttttcttcccttttaaacataagttccaattccaaaccatgtttttgtgaatgaataaaactgaatgcttttttttttttgggagatggagtcttgctctgtcacccaggctggagtgcagt

SEQ ID NO: 24520 - DNA, 1066 bp, Homo sapiens
tcccagtctctttgctaaagcatagcaaaaatcacctttgctgctccagttcccaataagttcctcatctctgttggagaccacctcaacctggacttcattgtccatatcaagatcggcattttggtcaaagccattcagcaagtctctaggaagttgcaaactttcccacattttcctgtcttcttctgcaccctccaaactatttcaacctctccctgttacctagttccaaagttactcccacattttcaggtatgtttacagcagcaacccgctctaccggtaccaatttactgtattaatctgttctcacactgttaataaagatatacctgagactgggtaatttataaaggaaagaggtttaattgactcacagttccacatggcaggggaggcctaacaatcatggcaaaaggcaaaggaggagcaaaggcacatcttacatggcagcaggcaagagagcatgtgcagaggaactgccctttataaaaccatcaggtctcaagagactcacacactattagtggaacagccacatgggggtaaccacccccatgattcaattacctcccaccaggtccctcccatgacgtggggattatgagaactgcaattcaggatgagatttgggtggggacacagtcaaaccatatcaattagtaattagcattttttgtttttgggttttttgagacaaggtctggtttggttctgttatccaggctggagtgcagtggcatgatcttggctcagtgcaacctccacctcccaggctcaagtgatcctcctgcctccaccctctaataagctgggactgtaggtgtgtcagcatgtcaaataatttttttattttttgtagagacaggattttgccatgtgcccaggctggtcccaaaaccctgagttcaagcagcctgcccaccttggcctctcaaagtgctgggattacaggcatgagccactgcacccagcctagtgatccagttttaatatgaaatggtgtcatattagagccttagattatgtacttattaataaatctaaaaatggttttgaaatg

SEQ ID NO: 24521 - DNA, 1063 bp, Homo sapiens
tcttttttttttttttttttttgacggagtctcgctctgttgcccaagctggagtgcagtggcgcgatctcagctcactgcaagctctgcctcctgggttcacaccattctgcctcagcctcacgagtagctggcactacaggcgctcgccaccacgccacgcccagctaattttttgtatttttagtagagacggggtttcaccatgttagccaagatggtctcgatctcctgaccttgtggtccacccgcctcggcctcccaaagtgctgggattacaggcgtgagccaccacgcccggtccaggtcctttttaatgtctgacagtaaagtgtttttttgttttttgtttttttttttcatataatttacataggataaaactttactcttaaaatgattaagtatttaatattttcactaaaaactactgaataacaatattcagcaaccatcactgctagaacatttctatcactccaaaatgaaaaccccatacccattagcaatcactgcaccatttcctcctgcctctatcccctggaaacccatagtctacttttcgtctctatggatttgcctattctggacatttcatataaatggaatcgtacagatttttttttaatgtagtcttttgtgtttactcctttcacttagcatactgttttcaaggttcatccatattgtggcatatgtcagtacttcattcctttttaaggctgcatggttttccgtatggatataccattttttaaatccgttcatcagttgatggacatttgggtagttctacttttttactattaggaataatgttgctatgaacactcaggtacaagtttttgtgtgacttgttttcagttttcttggatatatacctagagtggaattgttgggtcatatgttaactctgtgtttaactttttaagaaacctccaaactgtttcctacagcagctgtatcattttacattcccaccagcaatgttcaggacttctgatttccccacatcctcaccaacacttgttttctttttctttttttaaattataaccatcca

SEQ ID NO: 24522 - DNA, 1044 bp, Homo sapiens
tcccagtcccctgagagtgcagggatgcctgggtgcacagctgcggctgggcagctgcagctgaacccaggagtgcagggctcccacaactcccaacttggaaggggccagctctcccgcctgctgcttgttcccaccagctccctggagtgcacagctccagccatgcctcccccactgcagctggcatccccacaggtggctgctccagatgggctgctgctgccatcaatccctcatgtgaagaggtacatctaactgtcattaagatagggatgatgcctcatcttaattgcttcataatgacagggggcatgttttggggaaaacagcagtcagatctctcagaggcctatctaagggttcccagtaaaagggagccatcatccatggttccatttgcatgaccatttggagtgtgatggcctgaagacaagaagagacaactgggttattagaagacatagatcaaaatgaaacaagagggtaaggacagctcaaaagtcctgaggctgctgacacacctagataactggtagctacagttgtgcttgctaagacttgggtgcatggagattggcttcagttagctccttggtcttattttttcaaaaaagaaacctgcgggttatgaggaccacatttaaccccatcacctggcagcgtttgcaggataattgcccagaattagaatattggtccagatttttacattatgtatcccttttgtttcttctgagctgcagttagagatcactggttggtcacaggaataagcaggcttagtctaaaatgcagacaaaaacttaaaaacaactaatgagcatctgtcaaagtcctatagctgattataaactatctttagaagaggatcaaacaagaggatcaaaacaagacaacaattgtctgtgaatggcaaaatgttttagggtagtcacagtcaaaaacctgattgacaaagaaatttggttatttctgtggtttataataacataataaccctagttatgattgataacatatactcagacattaaaatttaga

SEQ ID NO: 24523 - DNA, 1008 bp, Homo sapiens
ggcaagaataaggttatattttgagatattcctgagatctgcaaaagtagtttcttgaataatgaagcattaaaatagccacaaaagcacatttttggcatttctttagaaattgaggaagcctgccctctggaggttgaggtaaggcaaagatgatttgcgtatttagtttatggtctcgccaaagggcaaggcactgtgattattggtttctcaggcacacataatagatatggaaatgggcatttcataatttttttctagaaaaggagttcaaatatttcagtaaaatacaaacattatatcctttattacccagataatatttactgaattgtacacaattttaaaaacaaccaaatttgtattaataaaatttaacttttaataggaaagaaacatttatcatttttacaagcttccataatgagctcactggtaactatgttttgcttttatctttattgccaatattatgattacattaaatggtagataaataatatggattattaaccctatatgtaaatgtaacacatgttgtctggactgagaatgatttctaggtgaattaacacatgattgcagccacccttgttgaaaatagaagagcttagggtagtcttgtaaggtctgtgataatacacattttctagtttttatgctttgtatgtgcattgaaatgatatggatattgtgacttctttattaattctgatgcttagctatttatttttgtgttctccattgaaatagactcctgagacagaggctgtttttcctgctgtagaaatgctatgatatgagtgagtggtttataatttctataattctcttttcactgtaacctattagggctccattccaagatctatttctgactcctttgacattgggaaaattactttatacccttcctcaacgtgctttccctcatctgtagaataagaagacttagctctacttatctcaatgggaaatgtgttttattaaaggcctattagcttc

SEQ ID NO: 24524 - DNA, 1098 bp, Homo sapiens
ctattgcgttatgaaattcttgtagtgtttttttcagctctataaggtcagcttcatgcttttctatactggctattttgtctatcagattctgtgtcattttattatgattcttagtttccttagattgggtttcagtgttttcatgaatcttgaaaatcttcattcttatccttattctgaattctatttctgtcatttcagccatctgacctcagttaacaactcttcttggagaactagggtggtcatttggagaaaagaagacactcttgctttttttgagctgtcagagttcttgtgctggttctttctcatctttgtgggtctgctgttccttcagtatttgaagttcctatcatttagatgtttttttttcttttatcctatttaatgaccttgggggtttaattgtggtataaggtgtattcagtcaattggattcatttctgcaagattttagggagtcaaggcttagctcaggactcccggactgtgttttctaattctgggtgactcttattgggcactggctttgttttctggcccctcatggttaggaacctgttgcacaggataggctgaaatgttcctgaactgctggtcacaatacttgtatgcatggtgccagccaaagctctttgtagggcagtggcagtggaatctatcctcatttgcatgtgctagcaacagtggcagcagcagcatggccaagtgcacacttgtcagctgtggcagggtggtagtgggtgctgggtagccagcaggtgtttgcagcagtggtgatggcagtattactcagggagacaggggtcctccactggcaactgtgcatgtgtttatgccagtgttggtgttagcatggtggtgggggtgctggtgggcgcaggactgtgcatgccctctatgcatgttcacactggtggtggtggctgcctaggttgtgggcaagctgtctgttttccctgcctagtttcactttggcagcagtgtcagtgcaagtggtgggtgctgctggcagcagggcaggcggctttcatgcctgccaatgctctgaggacaatggcaatgtgacaggtggggtggggggcagcatgc

SEQ ID NO: 24525 - DNA, 1058 bp, Homo sapiens
atttttgaggcaggatggagtgagttaaaatgcacaggttctaacatcatacagaactattctgatctcagttcagcaaatactagctgtgataccttgagcaaggtttttatttggttatacctcctcagctgtaaaagggcatgatataactgtgtttaaatgtttcggtgtggatagaatatgataatatattcaaagggttcattgcataggaaatagtcaagaaatggtatatttagtttacctatcttatattagcataaattcagtttaagagaggacggtgtctataaatgactaatacagattgatagagtacaaaggcaactaaccttgtttctcttgagtagagctttaccttttagatgggattgagtctcaatttctgttctttgatgtataatttctatactttgaattaaactgaaagattgctcaaagttaaggtctatgatagcagcactttatgtaatgtcaaaccaagaaatagataagaatttaaaggtttctctttaacctttgccattggtaagttatgaaactgacgaaagaaattatacacctctgggcctcagtttattcagctgacaagtcacttagttgatgagatgacctctaccacctatttaacagctttaaaacaccgtaattctgtgcattttttttttgcctaacacagattcttttgccaaaagaaatatccttgtctctgtttgtgtctgtgtgtatgtatttattcatattgccatcatctttaaaatatcttgaatataccatatgtgtattaagatgtgtaaagtacactaatattaaatatatggattgatgggtttttacgtagttatatgcctgcattactgctacctatagcggtaatatagaatcaggaacacacagaatatttctaacccccaataacttccctttacatctcttccccatcaataaccttctggtttttattattttttattttgactttatgataatataatttgaaaaaggtatgcattattttgaggggtaattcaaacttaaaaatttttctagaagta

SEQ ID NO: 24526 - DNA, 1022 bp, Homo sapiens
tggattcctacttacatggtgggttgcattacagaaaaagaccaataaccttagataagctactattttataataaacatttttcaatattccttactgcaaacacagttatgaaaagtggcctggctgtttggggccttgcattcttggcatccccagcaagaagtattaggagtttatgagagtggaggagtgtctctcaatgatatccacttttgatctttgatcatgttggcttctggtgaaatttcatgtgattatggcactccattgaacaccctaaataatatgacagtggctggggtcagatgtatttagtttttctcatacagcatttatataaggctattatgagcagaacttctaacaacaggattaggccaacttggagttttgactttactcatgtttccctgtggtccgggactcagtcactgtaaataagtctaagaggatatcaataggttttattctataaagccaaactgtggtagtctaagaacagtgtattatccagcacaactgacacaagggagtttacatagaactgcttatctttggttatcattgcaatagatgatttaatagaatctgaatttccatggagagatagtccatggctcactcagcccatatacaaacatatagcccaaagggacataaatctgtccaatcaggattttttatttaactttatttggatcatcattacattggtctgattaagcatgtgtcatgtcactgaagagttgtagcctggattgtttacatggcataagccaaagtgctcagatatcaggagaagcaagtgaatttctatcagccagatagaaacaatgttatgcaagttcctgtgtttgtttaggtgggaggaagggtatctttttgggagcagccatttatggcatcaggcacagcagagcagttcaggactggccatgcccacatgagtttttctgtttcatagcacttggaagagatgacaaatggaacagcaggctggattgtcagccacagatgct

SEQ ID NO: 24527 - DNA, 1035 bp, Homo sapiens
attgattatttgctgatgtttataatacaatagcactaaaatattttagtatttatttaaataaagattcatactgaagttttattcattaattaaaaccactcaaattaataactaaatggaatactgtcatttaaaatttttacgttacaaattaattggtaggagaaagaaagatttttgtcctgtaaaattgagtttagatattatttttaaaggtaactactcaagtccaaattcatcaaaatgtatacatcaaatatgtatatttttgtatatcagttatacctcaataaagtataaaaaagtaactactcaaaaatctttactcatgtagtataagttgagacaacttatccaagaaacattacttgaatactgattgtgacaaagcctggagatagaaagaggaagaatacatatttttgttttcatgtttagcagggaagaaaggaatttggaattaagtgaatgaaatgtcagcacatcaatgctgtactattaggaggagagagactctatgaaattaagaccaaaaaatcaatagatgctatctgtcctttgaaggcaaggtctaatattctttgtaatattgaacagcatattctatgcaaatacttaataagttattacagcaatgtaaatatcaggcagatattttcattcacgtttatataaggcaaatgcattagttagtgtaaagggaggtaatacataataataaaggtaacagtctatcaagaagacagaacaattttagacatgtatatacaacaccctttatataaaattaggaaaaattagaattacaatgaaaaaattagcagacccaacttcatagttgagtatttagcaaaatgctttcaaaaattaataatctttaaaaaatggaaataaaagctatagaaaacaaaatttacaagcttgaagatcaaattttcaattccacaaatacttgattgattagagagtgggtaacaaaactgtttaccaaattgtccaccaataaaatgggaatggacagattttatctct

SEQ ID NO: 24528 - DNA, 1026 bp, Homo sapiens
aggcttacttgatatatctttttggattctaagaaacatctcaaacttaccatatccaaaactgaatttctcatctttcatcaaaagcttttctctttgccatcttttctgtgtcgatttttggcagtttcatcactccggctgcttaaaccccaaaatttcagatattctcaacttttccttttctctcccatttcacattagcacatcctgtttgcattattatatgcaaactttctttaaagtatatttagaattcagacttaagtcagatcatgccattcctctgctccaacatctttgctagctccccaatactcagagtagaaacaaaagttattatgatggcttactcaagttctgtgccttgagcactggagtcacattgactttaggtcttggtattctccccttattcattctgttccagtcacattggctttcttgctattcttgcaatgtggcaggtatatttctacctcagtacctttgtcttgctaactcttctgtatgtaatgttctttctccagtttacttcatgtcttaattttctacctcaccttattcaggcattatctcaaatgtcagtgactcagtatagcccacatggccacactatttgaaaaggtaaattgttccccatctctacactcgctgtccttcttctctgccttgtttttttaccactgtatttttcactgcatgacatattatgttttacttatttacattctttcttttctagtctccctctctgcccaataacaatcctgtaagtctattttactgctgtatctccagtgtctagaagcgcttgacacatcagatatgtgaatgagggaaggaatactgagtgaatatttgcttaatgctgtcatgatagaagaatctgcagagcaagaattcagcttttgttccaataataatttaccactagagagacttatttcaagaatttaactagaaatctatatacaacataaacagaatataagcatgcaaaatttatagagaaagcatgaagtt

SEQ ID NO: 24529 - DNA, 1024 bp, Homo sapiens
aatattctagagaaatacgatctttcaatcctgggaattattgcattaaaaaaaacagtgccttcaattacagctgtttgtagataatcttcctctttgaggatgctattcatgcctcagctatcacctagaaaaatagatttaatagcttttccaaaaatgttgtttcattaattatagtcatgctttccaaaacattacaaatgaggtactgaatttaatgcaaggtaaatttctcagagataagaagatagaatattgtctgtttattccctaaactgctgctttcatgctaggattgcaggtcctcagggtcagaaactttctttctacttcctgaaagactaagatagtagcataaggacagaaaattgaagaggtttcctacattttcattatgactgaaaccttgaatcatcatctctacttgcattcagcctgggtatgaatttttgctttcctctttgttttgcgtgacctttgtcaagtatcatagttttctatgtctgatatggtttggctgtgtccccacccaaatctcaacttgaattgtatctccttgaattcccatgtgttgtgggagggaccctggggaggtaattgaatcatgggggctggtctttcccatgctattctcgtgatagtgaataagcctcatgagatctgatgggtttatcaggggtttctgcttttgcttctctctcatttttctcttgccaccaccatgtaagaagtgccttttacctcctgccatgattctgtggcttccccagtcatgtggaacttgaagtccaattaaacctctttttcttcccagttttgggtatgtctttatcagcagcatgaagatggactaataaaatatcttgtttctttatctattaaattgagctgggcatggtggctcacacaggcagtcccagctacttgggaggctggggtgggaggatcctttgcgcccaggagtttgaggctgcagtgagctctcattgcaccactgcactccagcctgggtgacagggca

SEQ ID NO: 24530 - DNA, 1048 bp, Homo sapiens
tttagtcatgcagtggtttgcaagctttgtttcttaaagccgtaaggtatcgtgaaggtggctcagaatacctcgtatattgaggagatacctgtgtataggaagccaggctcttccttttcaactaaaggagctttacttttatgtaagttgcaatctcaaatgatattttattcatttaaaaaattttaaaatatctttattcacgaatggaaactgtctgctacattattaaatagtgaggtatctcagttcacaccctaatatttgagaatgaagccatgaaaggcaactatcataattatctccaaaattatttctttaaagactaaatactagattggagctactgcttatttggtctcatgcaaaattgtgttcatccttgtgatattttagaaatatagtttttttattatactttaagttctagggtatatatatatgcacaatgtgcaggtttgttacatatgtatacatgtgccatgttggtgtgctgcacccattaactcgtcatttacgttaggtatatctcctgatgctatccctccccactctgcccaccccataacaggccctggtgtgtgatgttccccttcctgtgtccagatgttctcattgttcaattcccacctatgagtgagaacatgcggtgtttggtttttttgttcttgcgatagtttactgagaatgatggtttccagcttcatccatgtccctacaaaggacatgaactcatccttttttatggctgcatagtattccctgatgtatatatgccacattttcttaatccagtctatcattgatggacattcgggttgtttccaagtctttgctattgtgaatagtgctgcgatatagtttctagaaactataggcaaaagttgcttaaattcacagtttaacactttgaattttgctttgtcacctgagaccagcaattcattgagccaggttatctcctttggctttcagaattttttctagctcatggtatacagatctgttgtctatatccaacagtcctctctcagacatagaatag

SEQ ID NO: 24531 - DNA, 1050 bp, Homo sapiens
acaagaacaaacacagtaccaacatttatcattttagttaagtgaaatgctaggaatcaaagtgacaggctctgagagaagttatactgtggaataaaactttatgatccatttgcaaggacggaaatgtacttggctcatcttagtaagtaaataatgctaaatgtatttaaatattgatctgttttcagtggaagggtgaaatgaatttcaaaatatagaggctataaatgtatacaaagcattttctactgtactaccaatattgtgctatgtcactttacgaatctgtgagtaagttgctgaaaactgcaaattttgttataagttgtagtagtcatctatcaccaagtttgtatgttgaagtcaatgtacctaagggaaaatagtgacagagacagattagtttctgcatagcatctgtcagtgtagatagctctcaccattttataggtgagaagcttaactatctttaacaggtaatataggttctattctaagatccactgtctgtttcctttaacaagcaccgtgatgaggctgtaacttctaccttgatgtttggagacatgttcaataatcttgagcaaacataatacttcatttttatttttcaaaagatttacaaattatcaaataaatttaattttatacaaaaataatcccaaatgacagacatatttaatctgtctggggaaaaaaaagaatatgcaataggaagttttggtattttctctgccgtggtgctgaggatatttaagttaccgggtatatttaaggtgctgagaatttttgttagaatttgaagagaaaaacacagaaggactaaattttcttaatgtattgaaacaagaactatttttatctggagataaattagacaataataacaattttataaagttaatttatcagaaaactaaaaagcgatattgaaataagtctattctgtttataaactaattctgtcttgcatagagtgaaatttgatgtgaacagcaagtagcaaaatttgctgtagtttcttcaatgtttgctgaatttttgagt

SEQ ID NO: 24532 - DNA, 1064 bp, Homo sapiens
tgaaaaaatcataggttgggtttattgcaggcttaaattatttttataattgactagattattggcaatagttaacatcttcaacacagtcattatgtgtgcaatcttgtacttgtatttgaaagtgtatttaggggctatatagtaaaggatactagctccagaagactgtagtatactaaaggtatccagagaagttaacattcaaatacatcctaacagtgaaatttggagagaccaggtttctatcacttttaatattatttaaatattattggaattatataaattattttttatttttatgttagatcaaccatcttttaagccagattgtgagttatccatttggttattttttcctttaatcaattttattgaagtgtaatttacaaacaatcatattcaccaattttaagtgtgcattatgatgtgttttgacaaatgtatacagttatataagcaacatgatgccctcctctcaccccaagtccaggaatttactgatctatttttaataattatagcttattgttctacatattcctgatgcttctctttactatttgttttatatttcctctcttttttttcattttggatagttttcaacactatcaggttcactgatcttatcttctgcagtattaaatctgctgtgaattgtatccagttctttacttctattgtatttttcatctctacaaggagttctgtgataaaatatgcataatttttcgaatgactagggggtcaaatcctgttgctgatgttttcatttgaggaagttccttaattattcagtgccttgcaatcttttatctgaaaaatgggaaaacagttccatctgtgttgtaagatcaactacaactatctatatgtaacacttaaaagtaaaaagtaaactttctgtaagtaccaactattatttttattatcagttagtatttatgacttattaaatgcccattcttagaaaaactaaatatgcctattatttgtaattctcagctaagcgcatcacgttcctaagaaaaagacccttacatcctacttaactcgtc

SEQ ID NO: 24533 - DNA, 1059 bp, Homo sapiens
tggaacaggaccgagtaatttaatgctaaatttttcattttacatataattcattgaaaaatacatgtatgaacaaagttcaacctgaacactgaatgatctgattgtataacttgcttctgggcatctagattcatgaagctgattccctaataaaggtaagtcattctggaataagtgtatccccttctagtaatttctaaacaacaaattgcatttgcaatatattgtcatgggttataactttagtctgtgaaaacaataccatgatactttttaaaaaaaaatttagaaaataaagtggaacaaaaaagcagaaaaccaatggcagcactaacagtgaaaaagtcgatctgctctaagtgctgcctcatcacccttgcctattaggcaaattatttttattgatgcttatagaagtaaactaatattcattttatttggacatcttatatctaatacccaattttctttcatcattaaaactttaaaatcctacaaatatttactttaatagaaaatatactgtgaaattagacatgatagactctggggaagcatttatttgattaggaaaggttagttcaagctgttctttatgaaggaatattaataaattcagaagatgatatatttacgactaatatattttatatttttaccaagtatgtgaagtcaatttataaatcacagaaaattatcaagattaacaccatttacaactattgtatatattaagtttttatgtgctatatttgacaactttagatatttactataaattaaatatcaagttcattctgaatagatgtgtacaaataaagtgattgtaaatttattgaataaagtggaataaagtagtagtagtatttagaataatatactgaattaaaaaatgatttcttccaacattcatagtagaaagcattattaatatgataaatttggccgggcacagtggctcacacctgtaatcccagcactttgggaagccgaggcgggcagatcacgaggtcaggagatcgagaccatcctggctaacatggtgaaaccctgtct

SEQ ID NO: 24534 - DNA, 1072 bp, Homo sapiens
tagcccccgagcccccgacagaccctggtgtgtggtgttcccctccctgtgtccatgtgttctcattgttcaactcccacttatttgtgagaacatgtggtgtttggttttcttttcttgtgttagtttgctgagaatgatggtttccagcttcatccatgtccctgcaaagggcatgaactcatccttttttatgtctgcatagtattccatggtgtatatgtgccacattttctttatcaggtctatcattgatgggcatttgggttggttctaagtctttgctattgtgaacagtgtctcaataaacatatgtgtgcatgtgtctttatagtagaatgatttataatcttttgggtatatatctagtaatgggattgctgggtcaaatggtatttttggttccagatccttgaggaatcgccacactgtcttccacaatggttgaagtaatttacagtcccaccaatagtgtaaaagtgttcctatttctccacatcctttctagcatctgttgtttcctgacctttaatgatcaccattctaactggcatgagatggtatcttattgtggttttgatttgcatttctctgatgaccagtgataatgagctttttttcatatgtttgttgacagcataaaggtcttcttttgagaagtgtctgttcatatccttcgcccacttttttgatagaattgtttgttttattcttgtaaatttgtttaagatctttatagattatggagattagccctttgccagatggatagattgcaaaaatgtttacccattctgtaggttgcctgttcactctgttgatagtttcttttgctgtgtagaagctctttaattagatcccatttgtcaattttggcttttgttgccattgcttttggtgttttagtcatgaaatctttgcccatgcctatgtcctgaatggtattgcctagggtttcttctagggtttttatggttttaggtcttatgtttaagtctgtactccatcttgagttaattttttataaggtgtgagggaagggtccagtttcagttttctgcatatggttagc

SEQ ID NO: 24535 - DNA, 1050 bp, Homo sapiens
ggaacttaaaatgaatatgagtcagcctttcttactacatattgtagattgatctcttagtgttttgatcgacagctagtatctcagtcgtaccatagatcagttctcatttctgatgccactagtgtcacaaaaattgatttgccattactctgttacctctgatctttgaagtggtagggtattaaacttttctattggtgagaaacataattttggcacagttatgtttcaaatatatgttattgattgcaaagagaatgaatctttacacaatgctaaacaaacaaatacacataccaggtagatagtgactcagtgatatcagcattttacatactaaattattgcttgtagtctcagaaaatagtatttaatccctaaagtatacctttaaaattagaaaagatagtatggcaaatttagtaacttttaataagggctcaatataatctgttgctttagaattccatcactgtgcagaaaattgaccttattttgtgcatgtttcatttttcaaattgattttctgtattttacctctgtaattactacatatgtttcgaattttgtcttcagtcatttcagctaattgaatgtaaaatttatatgatggttatattgaaaatgatttaaaattattggttggtgaaattgctgttatattggtattgatatacaagcaataattaccttactttgtagagtaattacaaggatgatactcctctacttatagttgtgggagtttgattcatattatattttttatttgttgcgaattttattttcaggtttatgcatttattctgtgtgatttttggcatcctggaaacctgtgcccactatgatattttttaaataccttaaaaaattcttcactacataatctgcaagactgaagttctagtgtctttgatttattcttcagttgtttgcaatgtggttggaatttatggccccaaaccataatgtggaaatgagaaacaacactggaatctacattcaagcttgggccctttgctcttttctcagaggcttatccaagca

SEQ ID NO: 24536 - DNA, 1019 bp, Homo sapiens
tgtacactgtgctcacttgcgccagagaagaagcggcacagcaggggtgggctgctggtggacacgaggttctggaatctgtgcacgcagttgcacccaccgctgtgcggtgggctgcccacacatcagcgagggcgcagtgctggcaggggtgggcaaggcagcagagtgtgctcatgacagcagcggtggggcagtggggtgcacactcacatgcctgctgtaggaagagggttggcgaggtcggtcggcccttgcgcacacactgccaaagcagtgaggggaggctgcagtgagaagaggctgtgggtgggctggttttgtcggcagagtccggtctgctggacttctctgatggttaggcatggactgccagcgaagaagctatcatgaaggcatcagggaagcaccctggttaggcatttgatgctgcattgcaagcgggagtgatcaggctggggctccaggagaagctggcagcaggagaggctgctcagatagaaatggctctgaaacatgggcaggaccgccctgttcccaatccgactgtcacccaaatgcaaaagccacttagaggagcttggtgagccttgggggatagacatccctggccatgctccactgcagccattcccccgacaaaccttctgagctatgcccaggttggagtcctggcactggcatctctcaaagcagctctcgctgccagatcaagtggtttgtgggggtcctgaggtctcctgcaactaggattacgggggtctgtggcaagggtgggccactcatcacctgttaaactcaccccttccccagtattcactgggggccaggagtgggtcacagggctcaacagccccatgcaggatttccagattcctcccgcttcagtccagtatcttcatcctccttccgtccactctcagtgccttccctctgaaggtctgcttgaagtgtgctagtattcccagtgcctggctgtgtcaggtcagccatcttggctctttcctctgttttttttt

SEQ ID NO: 24537 - DNA, 1032 bp, Homo sapiens
atgtcttcttttgagaagtgtctgttcatatctttcgcccactttttgatggggttgtttgtttttttcttgtaaatttgtttgagttcattgtagattctggatatcagccctttgtcagatgagtaggttgtgaaaattttctcccattttgtaggttgcctgttcactctgatggtagtttcttttgctgtgcagaagctctttagtttaattagatcccatttgtcaattttggcttttattgccattgcttttggtgttttagacatgaagtccttgcccatgcctatgtcctgaatggtattgcctaggttttcttctagggtttttatggttttaagtctaacatttaagtctttaatccatcttgaattaatttttgtataaggtgtaaggaagagatccagtttcagctttctacatatggctagccagttttcccagcaccatttattaaatagggaatcctttccccattgcttgtttttgtgaggtttgtcaaagatccgacagttgtagatatgcggcattatttctgacgcctctgttctgctccattggtctatatctctgttttcgtaccagtaccatgctgttttggttactgtagccttgtagtatagtttgaagtcaggtagcgtgatgcctccagctttgttcttttggcttaggattgacttggcgatgcgggctcttttttggttccatatgaactttaaattagttttttccaattctgtgaagaaagtcattggtagcttgatggggatggcattgaatctataaattaccttgggcagtatggccattttcacagtattgattcttcctacccatgagcatggaatgttcttccatttctttgtgtcctcttgtatttccttgagcagtggtttgtagttctccttgaagaggtccttcacatcccttgtaagttggattcctaagtattttattctctttgaaacaattgtgaatgggaattcactcatgatttggctctctgtttgtctgttattggtgtataag

SEQ ID NO: 24538 - DNA, 1075 bp, Homo sapiens
aacgtaacattggactacttaacaatatagaaacattgctttgtgtctgcttttccatattcagtagattgatatttttaatgtttgatcatttttaaaaaatgatccctgactagagatagcatgagattagcagggcaaactgtcgaatggacaacatatacctaattaatgaaaatatgttatagatgagtcacacttcagacattaatccataatgggtctctatttggagttgtttgaatgacatgtgagatatataatccaaaagaaataagcttagaactgtttaagcatgacctttcctaggagaaataaaaaataagttaaaaagttattttcagaaggaaatatattaaagtcattcctagagttaagaaaagaatgttaggaaaatatttacaaaataaattgtataatatctataaatatcatgggggataaataaataggaactgggaatatatctccaggtattttcacagaacagcttaatgacaaagacatttcctaaggcttaaatgtagcattattttgaattgtaaaaagacaacaaattaaacagtatttgttgtaaaaatgtatctcatatattattacatattgcacatcaagaatatttttaaataaagtgaatattatatactcgcttttttggtaaatattgcctaagtaaaacatacaattttggcttttgctctcaaaaacaagccttgatgtgcacacagttagagctgcgactgtagagcactattgccaaaggaggatggtaaacttttcagtaatgctgaacctactagcgtgtgagggcatttagcatactgatagtgatatgaactaaaggaaatgttgacactgtcctaaataatattctttttatttttaaagttacttccttgaaggcaaaatcataacctgcataagctcatagtacattaaggcttattattttgcctttgctatattgctaagaaaataaatttggttatcctgataaatttattcttcacaaggccatgaatattattttttcccaatagcttataattttattatagcttgcaagttgattgtt

SEQ ID NO: 24539 - DNA, 1145 bp, Homo sapiens
tcacatttttattagaatttgtttatattttaatcaaggcttttcattctgctgcattttgtggggcataattatgttttcataaggacatatatgatacaacatatgaattaataactaaacaggagacttagacttacttccaaatcctttttgaggataaaaaaataatgggaaagagcatcacttctagctgtagaacagcaagcaaaaaaactagaaagtttgcagattcacaacttttcatggagtcatcagagaactaaggtcgtagggcaaccagctaacctgaaacttaggaggagacatgagcacttgttttcctggagcagatactgccagatagcagtaagaatttagctgaatttttaagtcgaattggtaaagccagttgtgcactagaaagataatatagcaaccctattgactgcagatatgaggggaatttgcactgcagtcttttctccatagacttcaatgtatactcaatatctataatatttatagatattatacaatttattttgtaaatcaaaaaaaaaaaaaaaagatcgtctacagccctctgaaagcatctcttctgatacaggcatagcataagaagtacaggaatcactccgagaaaggcaggaatcatcacctggatccttctccccttccccctacagaagaaaagccttaaactgctaagtgtaggacagctattgtctgaaaaacagtgtaaaaggaagacctaaagttgagagtggagcagatactgagaaaagaaatggctatccatgtattacccatcctcaacacaagagaatactagaggaatttgaagcctgtgatgccaggtaactttggtaacaacaaatcccaaacctagcttaactcctgagtagaatgattcaaaccgcagatctagcagaaggacagtcattctcatttaaagacataaacactatttactcattctttaatgtcctacgcaagatatttagttttaaacaaaatgtacaagacgtgtacaatggcaagaaaaaaatgggcacactgccaaaataaaaagaattttataaaagcaaagatatgacttacataataaaactgtgagacagaaaagttttaattactgtcattaatattttaaagactcaaat

SEQ ID NO: 24540 - DNA, 1013 bp, Homo sapiens
atctgtatttaaaaaaaatctccccaagtgatcctaatatgcagtaaaatctgaaaatccttcctctagaaaacaaaaataaaagtgcctaataaacaatgattactgtgtattctgaaaccagaaacaaccattttcttaaccttttatggtttaaaaaagtatggtaggaaagttattttaaaaggaattaaaggtgattttatgtgacatatgtttatttttttaatgcaatcttcattataatggttttgaattaaggtataacctgtttttcttgtggagtgtatgcaatagaaaatcacccaacttaagagtcagaaaacatgagtgtgtgtggtggttctgccacttcttaaatatattgccttggctgggttctcctataagacttactttcttattgcccatggtagtacaattgttatagcatttcaaaaattaaatggtgtgtttataataaaggctatatataacaaacccaaagctaacatgggtttcccatactgaacaggcaaaagttgaaagcattccctctaaacactggaactagacaaggatgcctcctttcaccattcttactcaacatagcactggaagtcctagccagagcacttaggcaacagaaagaaataaaggtatccaaactgggaaagaggaagtcaaattgtacctttttgcacatgacatgatattagatacagaaaaacataaagactcaaccaagaaactcttggaactgataaatgaattcagtaaagttgtaggatacaaaatcaacatataaaaatcattatcattcatatatatcaacaatgaattagctggaaaagaagtcaagaaagtaatcttttttataaaagccacagcaaaaaattacatacctaagattacattttaccaaggaggtgaaagatctctacaattaaaagtataaaacactggtgaaagaggacataaaaatattgtaagatgactaggcacagtggctcatgcctgtaacctcagcactt

SEQ ID NO: 24541 - DNA, 1073 bp, Homo sapiens
ctcaacagggtggggccctaattcaatgcgactggtgttcttataagaggaaaagacactgtggagaaaagaaagaagaaaaggaagattaaaagccatctgaggatacaggaagaaggtggccttctgcaagccaatgagagaggcctgagaagaaaccaaacctgctgacacctggatcttgaccttctagcttccaaaactgtgacaaaatatatttctgttgtttaggccacttagtctgtgggtttttttttttatgtctgtcatagaaaacgtaatatacagtactttctggtgagtaagtttttattttccctgagtgaatttttagtagcacatatcttttctgtgctgaaaatgtgagacctctgatgatttgatgagcccttctcttaccctaacttgcttttacacttgtaatattataccaaaactaagtgctttctattcttattttcttgttagtgtgatgtttcacttagttgcattattcattttgctagaaattttgaatacatttgctaaagctggaatgaaaatctcaataaatgaataaataatgatttagtgacatctgccgtgtgcttgttcactcgttgatctttaagagtgaaattttccaaaagagactgatcattaggggtttctgtagatcttaagtatgatgctttttaaaaccttttatcagaaacacgcttctttgattaacatgaatataatatagtgatgtagttaagagtatatggtctggagttaatgtgctatggtttaaatcctggctcagcctcttggaagctgggtaacaatgagtgagataatcaattaaattagagcctcattttcctcatctgtagaacaagagtaataatagttgtgttcaactcatagtactgtgatgaagattgaataagttaataaatacaacagcacctggttcatcgtaaatgctccctacatttgggctattgttatttttctaaattctattgcttgcttgtctgaacatcatcttgggttaatattgttactactggaactttattgtgatattaacttaaagcagatttctc

SEQ ID NO: 24542 - DNA, 1033 bp, Homo sapiens
aacagctgcatagtgctagtcattgcacttgagtcccaggaagatattgttatggactgaatgtttatgaccttccaaaattctatgtaggctcctgcccccaatgttatagtatttggagataggacctttatgaaggtagttaatgttaaatgagattataagtgtgtggtcttgatctaataggagtggtgtgcttataagaagagacaccagagagctcatactctctctcaaccatgtgaggacataagaagttggctttctgtaagtcagaaagagagctcttaccagaacccaatcatactgccattctgatctcctccagactccagatctgtggcaaaacaaatttctgttgtaaaagccaccaagtctgtggtattttgttgtaacaacctgagctgattaaaacagccataaataataagtgtaatacataaataaggttaatataacaattgcattattaacataaagtgtaatacaggtagaatattataaggcaacgacttgtggaacacaggaaaagtgggaaagagatagggaataggaagtggtgtgatgaagggaatcttacaacattaagtaggaggtctgggtaggcctaattgaaaatatgacatttgagcaaacacatgaagtttgtcctgtggatatttgggaagttcgcattctaggcagtgagaacagccagggtcctggccctagggtggcatcatgtctgctgtgtttgaagagttgcaaggggccagtttggctggaggagagggatactggaaattaattagcaggcaataagtttggagatctaataggagtgaggtacctcagggccttttaagctattatagattttaggttttactttgagtgaagagaggaaccattgtagggttttaaggagaagggtaatgtagtgaagggatttgactgactactgtattatgaatagatgttaggaggggccagacaaaagcaataataccaattaaaaggctattatagtaatccaggcaagagaagatggtgg

SEQ ID NO: 24543 - DNA, 1063 bp, Homo sapiens
aacaacaactttccaagacatagccagtataataagatataaagagaaataataaaaagttaaaaaggttggagacaaagttaaagtacagtgtttttattagttattgcttttcctgtttgtttgcttgtttttgttaatgtaataagtgtcaagttgtcatcagtttaaaataatgggttataagatattacttgcaagcctaatggtaaccttaaatctataaacatgcaacagatacataaaaagaaagaaattaaacataccaccagagaaaatcatcttcactaataaggaaggaaggaaagaaagaagaccacaaaaccactataaaagaaatggcaaaatggtgggattacatccttacttatcaatggtaacattaaatgtaaatggactaaactctccaatcaaaaggcatagagtggctgaatggattttaaaaaatgacccaacaatctgttgcctacaagaaacagacttcacctataaagacacatagactgaaaataaacagataaaaaaatgacattccatgcaaagtaaaactaaaaaagagcaggagtagctatacttacatcagacaaaggagatttcaagacaaaactataagaagagacaaagaagtttattatttaatgataaatgggtcaatttagccagaggatataacatttgtaaatatgtatgcaaccaacactggcacagccagatatataaaggaaatattagagctaaaaagagacaaagaaacattggacttaatctgcattatgtctcaccatatacaaaagtcaactcaaagtggattaaatacttaaagctaagacttgaaactatgaaattactaaaagaaaaatttagggaaactctccaagatgttggtctgagctaagatttcttgagtaatataccacaagtacatgcaaccaaagcaaaaatggacaagtgggatgtgtcaagttaaaatcttctgcacagcaaagaagataatcaacaaagtgggaagacaacccacagaatggaagtatttccaaactgttcatctgacaagggattataa

SEQ ID NO: 24544 - DNA, 1023 bp, Homo sapiens
ctttcgactctgagaacaggtattatattctatataatgccaacatatatgtatgtataataaggatgaatatttatatttattcttaatatatcacttttagtatgatacatatttttacacaaacaaattgaaattgaatttgaagtcttccagtggaacgtacctaacatattcaaataaagtaaaatctcaagtcctggtaagtgtttcttcatccccatcaccaactccattactggtatttggtattaggtacatatccactcctcttctggcttctggctctgggacatacccagctggcataattggtagtgtggagaagggagacaaatagtcttcctacaaaccagaagaggttcttaagaggcattccacctttccaaccactgtgacattgagatggcttacagtaatctcatgctcagttaaaaatgacaaaaatatttctcaacactaaaatgattctcaaagccttctcatttcttgtatatacaaagactcagagacttgcatacacagataaatttatcatctcttacagaatcttctcaactgatattcttgctttttgatttctatcagaaacaaccatttcccttgctattattgattagttataaaatgccatcctttcaccatatagtccagatactattaataacttcttgttggctccaggacaaattcaacattagtagcatagttatcaaatccttggtagtaatgactatgaagagcaccaataaatagcatgcttcttccctatacaggttctaaaaaattaaaatatctgaaaaggtcttaataaaatgtgacttttattaatgataaagatgaagttggaagatacagcttattaagagggcaaaattgccctgttaattgaatcagagaatcaggcagatttagccaatatgacacagggtatttttgtcctttgggagaaaaaattccacatcatcaaaataaactagtaagtgaataagaaaataagtaagtaagtaagtaaataaataa

SEQ ID NO: 24545 - DNA, 1069 bp, Homo sapiens
tgcctttcccaccataatatccctcactctaccagttagggggccaatgtgggggttctgccagctgctaaatatgtccatgccaattatgcattctggcactggggaaatgaccacaggatgaattcagggacccactggacccactgcaagtcagatctgagctaaaactccattaattacctgatctccacaagtttctactttaaatggaggcccacaatgacgttttgtgtcctctggaatcaatgtcagctcagagccagtgtccagtagtccctgaaatgcctatcatttctctttcaccagaagtctccttggggaaggatggaagaaatattaacagcataaattgtcagtagtgtagtggggtccttccttaaggggaccgggactccccttcattcaaggggtactgggtctgtaaactggatcaagtctggaaattgattgaggggccatgtttctctgtttttataatccaaattggtcttttgtccatttgacctagaagttttctgcttatgtaaattaaggaggaatgcaataggcttcctattaattttaattctaggaacactgtgattaattagctaatgcccaaactctacacaagtcagagtatttttaatgctgctttgcctctgctgtttattacagtagctatgctcaccttgattttgatggttcagtgccaccacttggcttctgctgcctgggatccaattattcccactgtatttaaattttgtagttgagtgactgtggttcccaccgttagatctgacatatggagaagagcaattacagggttttttaaagatgcagatgctgccctcataaacttatttcacaaggcattggtcaagggtatgtcttctagacactcccagccgggatgagtatgtctaaagtgactaacccacttcatcatcccaatctccctaagtcttgggatctcttcctctacattaaaccaagggagatcagacattttcagctcactcagtgtgggacatattttaatccatattttagctaactaagcaaataaactattaggattttt

SEQ ID NO: 24546 - DNA, 1085 bp, Homo sapiens
tcctttgtttctgtctgagtctgagtattcttgccattctgttttccctagtgttctccatgaggtgaatttagcatggacttcctggaaagaatgttggaattctagggaagctggatgactgcctgtcattttcttcttcctttgtagaaactgtgggtcaggaaaatcctctctgtctggtattgtgccgacttggggaagggaataaagtggtttagttgaactaagaccattcttcttacccttctaagtcagatttaattctgttctatggaacatatggatgtttcagacatatttccaagtattggaattttcagaaggttattgtggtctgtggaaagttgctaggtgaactttctgttgggggtggggaagtggaacttgagactttctattttgctatcttgctgatgccactatttatttagtcttttgtatcagtattaatgtatatacaatagcgtactgacattttgattggaattgtgttgaatttatagatcaagttgggagtaatttattccacagtgttgtcttctaatccatgaaaacactatttctaaatttatttggatgtttgatttgttttatctgaattttgtagtctaacatatatagattttatacatattatgtaacatttacacctaaatgtttaattttttggtgctattgtaaatttaattgttaaatattaagagtacatttactaaatgtttattgccatattttgagttttgtgtattgtgactttgctatagtcacaatactatagcaccaaatacacaatactatagcactatttgctatagtcatttattggtttcgggaattttttttttctattgtagatacattgtgattttcttcatagacaatatgtcatgtgcaagtaatgacaattttatttctttctttccaatccattaaactgatctttctctttcttgccttattggtctgagatccagtacaatgttgactagaagtggtaggagaggaattccttgccttgattccaatcttgtggaggaaaccttctagtcttttaatgttcattttgttggtttaggtttttg

SEQ ID NO: 24547 - DNA, 1039 bp, Homo sapiens
ttttgtaactcatagaatatgctgttttaccctttgctttcaacctttgtgtgtacttaagaataaaatgagtctcctggatactgtttttaatccattcagtgactctctgtgttttgattgaataatttaacttctttatacttgaagtaattattgattgagaaggatttattattgtcatgttaattgcttttctgttttttaattcctttgttatttttttcctatcttgctgtcttcctttgtgatttttttcttttcatagtgatatactttgtttcctattctgtatcatttacagtttcctctttgtgattatcatgtgtcttagtctgtttagtgttgctaagaatacctgaggctgggtaatttgtaaagaaaagggatttatttggctcatgattatgcaggctatataagatgtatggcaagagagaaaacaagagtagggagtagaagtgccaggccctttttaacaaccagctcacaccagaacttatagagcaataactcacttattactgcaaggacagtgccaaacctttacattttttcatataatatatcatttaaaaagttattgcagctctagttatttgtaatactttaatcttaacttttatattagaattaaaagtgatttatataccaccattagagtattagaattttcttaatttgatggtatacttacctttgccagtgagttttatgcctgcatatgttttgatgttggtaattagtatcttttcattttaactagaagaactttctttagcatttctagtaaggcaggtccagtgatgataacctccttagattttgtttgttgaagaaaataattatctttttatttgacagctttagtggttatcaatttcctagtgggcagttattttctttaagcactttgaatatgtcatttcactttgacctgacatgcagagtgttggctgaaaaatttacagataatttcatgaagtttcctttgtttctgataaattgcttttctattactgctttcaaaattctctct

SEQ ID NO: 24548 - DNA, 1054 bp, Homo sapiens
ctcctcccagctcttccctgccccactcctgtatcacctacatggaccatgaagtcagccaggtttatttgggttatatttacattcacatggattgaatgacatatatatatatatatttaacagcattatgaaataaagtaacttgtccgtttgtgtgtgcaaacaaacatggtgtaaaacttcaggtttatctttataaattttttttatctttgttagccagcaattaggtccatttttatagatgtttctggtaatttgtttgttttagtcacatacatgaaatttttagaaatattatttaagttatttaaaggctgatcttgaaggacaaaggttttcagagtaaaaatctaaaagttttaaggttgttatcttgtgatttacttaaggcttatgtgtagcttgaaaaagatgttaaaatctctttgctgtcaagagctagtttcaatattttagaagcacatgacttaaaaatctgcactaataattctcattcacaacattgaaagttgggatttgttgagttctttaaattggctataagttccatttcttgagtaaaaagctattgaaaaaaataattagaatagttagagtaaatgtcacataaattaaaacattttgactaaactattagtgtgtgtttgtgtgtcagatcaacatagtcatgtgtttcttagcaaggaactattcacatatgttttgcttctgctcaggataagagtacaaatccctctggctctttctgaacaattacaacaaataattttatttgaaaatatttcataaataatttataattgttatacacacaaatattatatgtgtttattcttatgattcacttcaactttatctggcaatctcaaatgataactgatatctctagctgcttagttttttattcttgttaaatagaactcatggactcaggtttgcagacatccaagttgtgttgttcagttgcatctccagaattaggtcatctctccttggggggcagtagatggcctccctcagaactaaccagtctgcagttttgtttcct

SEQ ID NO: 24549 - DNA, 1076 bp, Homo sapiens
catgtttctatatacatcattctctacaaaaacttgattggttgtgagtatttttatttaacaaaatttaagacgttggtgaagatgtagttgttttatagatcccattttctcaatacgaagcaaatttcttgttaattttttattgattataacaaattatgaatgtgaaatgtacatggcttgcactcgaaaaatgcttcagatattgcccatctttttattaaaatgagattaaatcaagatggtctaaaatattataagtttacttttctttgttcttaatttaagacaagttagaactttcaaatgaaccactttacatagatttatattcatgcccatctgtctgcatataataattaagaaaaaatattaaaatgattcattttccctactttaaaattattttaaaaggcaaacacttcatttactttcatttctctctctctttttttttttttttttttttttttgagacagggtctttctctgttacccaggcacaagtgcagtggcatgattatagctcattgcctcaaaatcctgggcacagcctcccaggtaactaggactggaggcatggaccaccacatcaagctatttttttttttttatttttttagagatggggtcttgctgtgttgcccaggcttgtctcaaacctttgacttcaagtaatccttccgccgcagcttccaaaagcactaagataacaggctgagccacctcactagcctcatttctctttttattaaactactcaagttgcttcttacaaaaagacttttatattctctattattggggatttaaaaaatataccctatcatttgccttacctcttatgaatgggattcctgaagaacatgacaaataacaaataaaatgtaaactccagattccagcaatgaaattctcattattttgtatataattcacatttaacttcttattttgaaacatatgaatgagcaaagtactatttctggaggggactacatctggccattcatttagaaacctgcctaatgtgtttgaagggaaaataaaattgtgtaaattagtggaaagaa

SEQ ID NO: 24550 - DNA, 1050 bp, Homo sapiens
aatttcaattcaagctgacattttatgcttagttttaatgaagtgatcccagggaaattggtattttcctatctgatacaacgatatatatatttgaatgcaagattaaggcacattttaatatgctttatttgtttctaatttttccaattaatttttttacaattaatgtcatttaaaacttttgatatagcattataaaagaatctcaggcagaaatcattagtattactaaattatttttattgcattattattactactttaatatagtactgaaagaactatgcagcttgagacttgtattctgtgaaatgaaactttgaattagccaactttgaaagtcctttccagttccaccatgtggagattatgagctttactctgcagcatataccaaagaatgtctaccatacatttcagatgagacctttgagattgcctaccttaatcttattatgtaaaagatataaaaactgaggtgaaaagtggtgaaattatcctttttatatcacaaagaacaaattgtcttgtctcaagtagaatagattattagccaagttctatctatttgttttgttttaagtacttatccccacttccatcatttgttccttgttcatgttgttgttcttgtttgttttgaattgtttctggaaataacagtgagttaaaaactctgccagctttatatatatatatatatatgtaatattatatataacatgttagatattatttataatatatagtataacatatagtataaaggtttttttacacaaaactttaaatgcattttgttgtctaaacaaaagaaattattgtattcacatgtgttaagatgtgcagttttttcattttatgtgtctgaaattagcatgagtttttcaaacatggtcacagctgttcatatagccattgcttcatctagattatgtgtactctttgtactgcatgtattgagtttaattgtcattcactattttttcaaaaatattacattattgttcaatattagaacaaaaagttattgtctgaagagaacaa

SEQ ID NO: 24551 - DNA, 1051 bp, Homo sapiens
gcataaagtcttaaagtaacaatttcttctctacagaaagccacatcttcatacccaaacacaggttcagatgattgtaatagtgtgcggtatccaccaaacttcccatttttatcagtaaaaactttaattacattcagcatttaattattcatcactctgatagaaaagcatttgtgcctctgcttcctttctctttcctctgctttctattttggttatagtgcatagaataaggaagaaaggagagaaactcatagcatttcatttcctttgggttcctaaacctacaaaatgattaacctaataaagccattagattttataatttaaaaaaatcagacgtgaagatttcagctattcatgctcatatttgtaaatgtaaaaaaaaccttatttttattacttatctttattaattttataatctatggaaaatgtaattaacacagatctaaatactaacagtgtagatattgtgttatttgaacattataaataatagcttagaactaagctgtggtctctgaaacattcttaggagtttttcctccaaggcccttgattatttgccaagtaagattaaatagaatcctgatgtatccaaagaaaaaaatagaaggaatgatgtttccagaactttgagagaaattgtttatgaagggcagtccaaaaattcacaggaaaacatggtacataaacatggagcttgaaatcaggaaacatgtactattttaatttattttattttattattattatttttttttttttgagatggagtctcgctctgtcacccaggctggagttacagtggcgccatcttggcctaccgcaagctccgcctcccggattcacgccattcccctgcctcagcctcccaagtagctgggactacaggtgcccgccaccatgcccggctaattttttgtatttttaatagagactgggtttcaccgtgttagccaggatggtctcgttctcctgacctcgtgatccgcctgcctcagcctcccaaagtgctgggattacaggcgtgagccaccactcc

SEQ ID NO: 24552 - DNA, 1060 bp, Homo sapiens
tgaatgaagataaatactattatttattaatagttagtagactcaatatgatattaagatgacaattctccctcagatcaatatagattcactgcaatagcaagtgtattgtatttacttactattgcatatcaatatagattcaatgcaatagttaagtgtattgtatttacttaactattgcattgaatctatattgataagcaatagtaaataaaacttattttgttaggtagaaattgacaagttgattctatccatatagatatacaagggatgtataatagctaaaaatgcattaataaagaaaaaagttagagaattaacaaagtaggatttaaaatgtattataaagctataataatcaagactgtgtgttattaacataaagacagacaaaggaacagaactgaaaatctggaaataaacttaacacatacgtggacaactgatttctaacaaatatgcaaaggctgtttagtagagaaagaatagtagtttcaaaaatattattagaacaactgaatgtctatgtgggggggaaaaacaactccaatccataacttataccatgaaaatattaattcaaaatgtaaaaatataaaattataaaagaaaacataggagaagaacttgtgtaaccattgattagacaaatattccttagatatgacaccaaaagtatgagtcataagagaatggattggtaaattagatatcattaaaatttaaaaacttgtgcttttcaggccgggcatggtggctcacgcctgtaatcccagcactttgggaggccaaggtgggcagatcacttaaggtcaggagtttgagagtagcctggccaacatggtgcaaccccatctctactaaaaatacaaaaattagctgggcgtggtcgtgggcgcctgtaatcccacctacttgggaggctgaggcaggagaatcacttcaacctgggaggcggagcttgcagtgagccgagatagtgccactgcactccagcctgagcaacaaagtgagacttcgtctcaaaaacaaacaaacaaacaaaaaaacttgt

SEQ ID NO: 24553 - DNA, 1029 bp, Homo sapiens
gtgtagtctccacaaagaatgcagaccaatcttaatgatttggttcagcaaatgtttctcttgttccccatttggtgcaggctgaaccttaaacatattgaagaatagcttgaagttttagcttctgtgcctgcaactagtttttctgtcatctcggccaccactttgctttgaaccattgtttaaacatatattttcattcaaagaagggctttttaaatttaaaccacagaataaaaaatatttctagataagaggcaatgagacagtgctactaaagattgtcatatatatatttatatatatgtgtatatatatatatatatatttctaaagcacagggtgagtaggtgtcacagaataatatttcattatggttcctaatagaattctgtttatccaaaacaaatgtgttagaattttattttgaatattaactgctataaataactggctttgtatgctcctttagaaaaaaataagtgaacaacaggtaaattagacattaatcaagctttagaagaacattagcaaacattaacaaaacttgtattgctcttaaaattataatagcttaaggcatcgtaatttcaataactacattcctctattaatatttttggttcagaaaactggaatatgagaagagctttatattagcctttgatatgatgctttaccttgtaaacattcaatttggagacatgcttatagttttagaaacataaagcacttaaagttgtttagatgcactaaaacttggtattaatctctggttctcttttatattcatttaattatttcttaaactaattgaaaataattttgaggtggtcggtaccacccataattcgtttttaaagcataaccacttatttataccttttctattatttctaaaatcatcctaagagattactaacatgaaaattcacaattgaaatgattcaaaacaaagcaaccgagaggaaagatgaaaatgaagggcaagagaaataaagtaacaagaaaatgggataaactagtcac

SEQ ID NO: 24554 - DNA, 1054 bp, Homo sapiens
gggtgaacttcagagaagaggattgactttctttcctaaaatggaaagaagaaactaaggatatttgagacatttcgaggtagaaatgagtagaaaatcaggtgagctctttttgatctcaaggaaagtggaggcaagagattattttcagagaagatagaatttatatggagcttgataacaggtgaaaattttggattaatcacagcttcttcaacaagcatttgaatgagcatttgatgttctctatggagcaacttttaaatttcacaagaataacattttgaagtactagtgtaccaaggaaattatctttactggactttaagcatcatatctaaagaaataaactttgcactcccctctccttgtttgtgactgacaagttagcaaagcaatatgccaaatgttgctatttcatggttatttctttactcttctaaagtgtaatgtaaccttcattgactattaccaattaatttttttaataaaaaactgtcaaaagtagagtattaatttccttcttaggatgtttgtgggtttcttgaataagtacttgaggtgacattaacatggatatttttaggtgtttcacattggttcttgccaaactctatatagcaaaaaaaaaagtgcctgtaagatgagttttgagaggtactcatattttccattgacagcattagaattttagatatgccccctagggaaagtacttatttgaagcaaaacttacagctttaaaaaataatgtcttaggttcttgactagaaacaaaatgactctagctgattaaaagccaggagaaaggcatcctgtctatcacgatggtgggggtgagaaactctcaagtccccttcttgtaagcatgagagactgtttatttatttatttcactgtcaaatgcaaactgatgactagactttaactttaatatgcccagttttgacattcacaactagactggcctgtaagctactagagagctatgtattattattattctttttctatgccccagagcccagcattgtgcttgacaacacacaaagta

SEQ ID NO: 24555 - DNA, 1030 bp, Homo sapiens
gtcggagtctaactctgttgcccaggctggagtgcagtggcgtgatctcggctcactgcaaactctgcctcccggttcaagggattctcctgcctcagcctctccagtagctgggattacaggcacccgccaccatggccggctaatttttgtatttttactagaaacggagtttcaccatgttggccaggctggtctcgaactcctgacttccagtgatccgcctcagcctcgcggagtgctgtgattacaggcttgatccaccgcgcccgcaaaaacttttttatatataagtacctagaagagaaggagcagaaggagcagtatgaagtttcttattaagatccagcatcgctatataaagaatgggggcattgtatgtttaagtgtgtgattaggaaaaggactttttcacacgttttcaagcctcttctatgttaaaaagctattacgaggaacaccatttcatgcatagatgtatttccctttacagtagaaatctagtccatatgttcagagttgaattcagcaagagcatgtaatattcaaagcaaggcagtgacatttatataaccttttcattttcttttgatgatactttttgaattcaaatcattacttgtagaaatatataagttcaaatatgaataaaggagtaatggaggaaaaaagtgtgttatgtgtgattgcatgcaatgtacattcaggaatatgagtaattgagaataattgtaatcacatgtattatattcatccatgatgaatatttgtgaaaagtaatgtgctagtcttttgtataattttccactgaatgaaaaaggcagataaatgatggaaccatttctcaaattataatgaaatgaataactttagaatgtaaagcatgggaaaaaatgcctgctatctggaactaatgactttatgttgcacaatagggactgtttgtatatcctggaaagtgcagtttttacattacaataaataatatttggggttattgttttataaaatggatttatttaaatgtaga

SEQ ID NO: 24556 - DNA, 1036 bp, Homo sapiens
aatggtccagaagtaggccaggcagtagaaagcatgattttgttagccattagttacatagagcaggttatgtacgtccctacctggaaagtcataaaacattcctgaaaatcctagctggcatttccagcaaattgtgagagaacacagtttacattctgaagcccaagaagcattgtttttttaatattatgtaccatttcactacttaccatttcaagagtataaaataacaatagaattggccttctcattctgatattttagaaaattccacattttcacggttcctattgcaaacaagaataaaatcttttggcagagcctgactataaaaagatctagaagctattcttataatgtaaaaaaagagtatgtttttatgaccttgccaatttctctattgataaagagtaggaagtgtggatatgatctataaacatatttttaaatgacaggcatagataaagaattctctgaagcagaataatttatggaacaaaagcagttaaggatgaaaacatttatcatgggaaatgggaatactgtgagtaaaaagttcaagaataaagtatgatttatgataatagagattctcacaatattttcagaactatagttgaataaaaatatgtagtatttgattgaaaaccaaaacagtggattaatgtaactagaaaagtttgggtttgggccaacagcggacattgaaatatgagtatatttttagaataaacatctatatatagctccagtgaattcactttgattaaaagataattcaatggataaattggataaaatatgtaaaaaaaaaattctctggctctgatgacaaaaaggcagtttcacagatttgctatcagaaattactttttcatagaaacctacatatatttctcttttattctgatatgagcttctcatgtgagattagtcagtgtgaaggccagtatagctcagacaaagctgaccacagcatagaaacccctgccaacactaaggtcacacccctctctggggtgtgactgaccag

SEQ ID NO: 24557 - DNA, 1034 bp, Homo sapiens
aaagaaaattatttgtttttccttgagaaaatcagtggatatttgtgctagatactgaaatgaagaaccttggagatggagcaagttggagaaacaaatttttgacttgtcaaatttgagatgcttagtatagatcccagtaaaattattgggtaaacaattggataacctactttgaagaggtttgagttgcagataagagtttggggaacaagtaagattacatatcaaaccatggatctgaataatctaattcaggctctacagtcactaaatcatacagcacaagaaaagtctctccatcttgtagctgcacccactgggatacaagtcctcctcagtccctgtggcaaaggaaaagaaagctctcatacttgctttcctatctttaaaatcagaagtgacataacccctttctctcacagtttgttggccaggaccagttagatgtccttacctaactgcagggacctgagaaatgtggaggagtacatggagtgtttgtgaggactgttgtctcttaatatgtctcacttctaagaagaaaaacatggattcagagagaaaaagccattctcaccaaaatgttaagatagcccaccatatttttttgtacatttctaaaggtaatttagcataattatctaggattagaacaaaagcaagttgcagtggaaatgccagggggcggcttagaggtggcaggataagaaggcttttgctttattcagtaatctctataattccccattagccactttttgccaaatctgaagtggacaattaatgttttctctgacctcatataaaatggtatgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggc

SEQ ID NO: 24558 - DNA, 1897 bp, Homo sapiens
ttgtttagtattttgaaatgggaacatctctagcagttttgttcatttgggtcacagctgtgccatctatttgcatgtttaccaaatggttactgaataacacatgcctaagaaaactaagcttttgcaaaagcttgttaatatttgcagtcctcaactgaactcggagctcacaaatgggctttttgcaaaggagcctgaattcttggcaatgcttgataaatgtcagtcagtttctttagccatctgcaaataaaggtatattagacaatgatgacttcataacagtcaaagatgtataataattaatccagggacacctgtgcacagttccttttacaaagctatcacagtgtattatactataaaaatcataaaggattttttaaagaacagattttatctgatgtgctagcaaagctaaagacgaaataagctgcactgattattggttatcttttacagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatgtttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctcctagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccat

SEQ ID NO: 24559 - DNA, 1023 bp, Homo sapiens
gggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctcc

SEQ ID NO: 24560 - DNA, 1049 bp, Homo sapiens
ccaaaagccccttttatgacctatcccagcgaagcatgcaaactgaacagttcgagattgtcgtcatcctagaaggcattgtggaaacaactggtgagtaaaaacagatatgccataaagtttctttataccataatgacattatatgatatgcacaatacctgtcatgaattgggcgaaatgactcagagtttacaataatgaaagtaatgatttgcctttcatttctttgtaacattaaattgataccattttgaaaattaaaatgtactgttttgatggttacatagataatattaactctggaacactcactgtaaaaaaaaagtgggatgacttcttataaatgattatgatgttctattataattacaaacttgactttcttataatcatgatttttctttaaagatttaaggctcaaaaaagtagggtaattattgagcagcctgaaatcagcatgcatattctggccttggggatggtgatttggggtgtcattgatagagctttgatatccactatgtgcaacctcagtggaaaattccctgtgtgtgtgtctgtgtgtgctgtgtgtgctaaagcagcattttaatatcgaagtgggtcagcggatttccccagctgaaccttgaccaaaatttcatttcaaaaagatatttttttctttttctgctcctgtatagctatgtgctatatgtttctccttaacatccaatataacttggtatgccccaaatactatttgctattttctgaggacagttaagttgacaaaggaaataaacaatagttatgagcatattatttggggcctacacattgcttagtttggaagctactggatgtttgagattaataatgtagtttccatataattgtatgtatacgtatatgtgtgtgtgtgtatgtgtatgtgtgtattttgagttctatgctttctacaagtactgagaagacaataaatattttagcttttaattgttttctaccactatcatctgaattatataatactaatgattatgtataaactatagcaatataga

SEQ ID NO: 24561 - DNA, 1047 bp, Homo sapiens
ttctttttgaagtaattgtgaatgggagttcactcatgatttggctctctgtttgtctgttattggtgtagaggaatgcttgtgatttttgcacattgattttgtattctgagactttgctgaagttgcttttcagcttaaggagattttgggctgagacaatgggtttttttagatatacaatcatgtcatctgcaaacagggacaatttgacttcctcttttcctaattgaataccctttatttctttctcctgcctaattgccctggccagaacttccaacactatgttgaataggagtggtgagagagggcatccctgtcttgtgccagttgtcaaagggaatgcttccagtttttgcccattcagtatgatattggctgtgggtttgtcataaatagctcttattattttgagatacgtcccatcagtacctaatttattgagagtttttagcatgaagggctgttgaatttttttgaaggccttttctgcatctattgaaataatcatgtggttttcgtcttttgttctgtttatatgatggattatgtttactgatttgcgtatgttgcaccagccttacatcccacggatgaagcccacttgatcatgttagataagctttttgatgtgctgctggattcggtttgccagtattttattgaggtttttgtgtcgatgttcatcagggatattggtctaaaattctctttttttattgtgtctatgccaggctttggtatcaggatgatgctggcctcataaaatgggttagggaggattccctctttttctattgattggaatagtttcagaaggaatggtaccaggtcctctttgtacctcttctttacctttttttaatggactctatatactatcccaacattctgtggttatatgacaatgttgggatagtatatacagaaatgggtggaaggaaagctttatgaatcccaaaactaataataaattttgcttattggtatcattcctcctttgatagttttaatgaaaagttttcagtaaaaaattcaagcctt

SEQ ID NO: 24562 - DNA, 1026 bp, Homo sapiens
atatacaatctctacctagccctttgggttgccctgtgggatttagggcttggggaatcagcactaactgattaacaactgtgctgattcttctgcttctgtgacccaggagtcctgtgtctgctgtcaaagtctatggagcttgacaagctaatctgttagtttatacagttgttgcagtgtgaattgtcctgctactaagtcccctccccatatcacacgtattgaagtagggtagaatttcaacagactcctcttaggagccatgcagattattcaatcaatcactagtatgtgattgtgtttgccaggagaatcattctctactttttcatcaccaagcccaaaggcagagagatctatggcctcacagaatggttgtccttgtttattgttttctgttttagttatttgggtgtttttaaagaaatgactattctacctaaaaatatttgcttagtttatcatgctgtcaaccatacttcaatccacttggcaaactgttttctgaacaaagttgtctcgtgattataaatggagaccatggaggtaggagaaagataaatgtttatcacaaatccctaggatgaatcttaaaaaagatgtctacaacagttttatttgaaagaaaggccagagttgtactaattagcacattggaaagtgcttctttacatggtttgttttatgggaacagaataaatttaggccacaggctgatttaaaattttttccctccgaatatagtatagtttttaagtattcacatcatgacattcaaaagtgaaagacttcaagattttgtggaaataagtgggttcatggaaagtgcaagcataggtcataaagattatattatattggcgagtttttactgtattttttccctctctttgaggcaatccaatacttgaaatcttcttttcacgacttctctttgctcaccggaaaatattcactgatgacagtgaatattttgaataatcaaaggttactgcataaaccctatcaggtttgtgccttcta

SEQ ID NO: 24563 - DNA, 1034 bp, Homo sapiens
ggcttccttctcttcaccaatttctcccttccccctacttacccacctaatccaatctcttaagaaagaatctggaaaatgaattcctaacaagatgacttacaaaaattaccttgtcccccttatcaaaggcgttggattctatggggacagcgcattggggaccatttatgtgggctaggtcaaaggtgggcagtgcctacttctgagcatccctgcagccacattatagccactcaagtgtggctttggtcactgtctggacctttcacttttctccttgtcaaataaggtggctggactggatgaatttgaagtccatggagagcatgaaatgtttatttctcttgtcctgcctaaaaggaagccagtcatggccactgggttctgtttgcctctggaccctggcctagattttccttttattacctggagtttggggtttccttgctctcagcctctccaggtatagcattcacatctagaggctgccacattccttttatctctcttcaggattatgctcataggacctatcataacaagtatattttcacttttttctttcactgtgtttgctagtattaaccccttttccccatccccatccgccattaagtagctgggatacttatctaaaaaatatagattccgcagggggcagtggctcatgcctgtaatcccagcactttgggaggccgaggcaggtggattgcttgaggccaggagtttgagaccagcctggccaacgtggcaaaaccctgtctctactaaaaataccaaaataagctaggcgtggtggtgggtgcctgtattcctagctactcgggaggctgaggcatgagaattgcttgaagctgggaggtggaggttgcagtgagcggagaccacgccattgcactccagcctgggcaacggaacaagactgtctcaaaaacaaatacacacacacacacacacactaacataattttatttattattatttttaaagacagagtcttgctctgctgcccaggcaggagtgcagtggc

SEQ ID NO: 24564 - DNA, 1049 bp, Homo sapiens
tatttttgggtacatgagataatttgctacaggcatgcaatgagtaacagtaatatcagggtaaatgggtatccattaccttaagcatttatttctttgtgttacgaacattctcttagttatttttaaatgtacagtaagttattgttgactgcagtcaccctgttctatcaacttccagatcttattcattctaactatgtttttatactcattaaccatccccaccccaacctcactaccatctccaacctttggtagccatcctctactctctgactctctgtctccatgagttcatttgtttttatttttagctcccacaaatgagtgagaatatgcaaaatttgtccttctgtgccttatttatttcacttaacatgatgtcctccagttttacccgtgttgttgcaaatgaaatgatctcattcttttcttttttgagacggagtctctcgctctgtcgcccaggctggagtgcagtggcgtgatctcagctcactgcaacctccacctcccaggttcacgtgattttcctcctgtctcagcctcctgagtatctgggattacaggcacccaccaccacgcctggctaatttttttgtatttttagtagagacggagtttcaccatgttggccaggctggtttcgaacttcggaactcaagtgatctgcccaccttggcatcccaaagtgctaggattacaggtgtgagccactgtgcccggcctgatctcattcttttttatggctgaatactacttcattgtgtatatgtaccacatttttgttatccatttgtctgttgatggacacttaggttgattgaaaatcttggctactgtgactagtgctgcaataaacatgggagtgcaatatgggatgcctttatgtcttgctggagaatgcatgccccgaggacagcaaggctggtcgttgaaattactcttctgtaattgatctttgagctgtactctccgcccctccattggtcatgcttgtaagggatggagagaaatatgcttacttctatgctggcataagaatc

SEQ ID NO: 24565 - DNA, 1034 bp, Homo sapiens
gtgagaataataataaccaatgctatagggctttgtgagattaaatgagatgtctatgtcaagtgtttgcacagtggtaggcctgctgtaaacactcaggaagagggtggtattgatgaggggagaaaatataatatcctgttacaggtttgtttaatttaataaggatctttgtcttccctgagaagagataggaagatgtattctagaaggaaatttaacaattcatgcatcgttagcattggttttgattgtttctgcttttttttctttcttgtttttctaactgctccaggttgcttcagctggaaggttgctaacatttgcctcttttgcttcctctgtggtatcaatgtcagtgatttccaaagttctttactttttcatggaaattatctttgtaacagaataattctttatgagtttttcttgtacctatccacaaacttagttctcatctttaggctttctctcctttttaaagtgcacacatgtgtattcctgtcaccgaactctttttattaactgtttaatatttttatcaaaatatttttgagcaatgttcataacccttggcattgattcctaccagtgagaagaggggatgtcctggcagcatggagtggaatccgtcctcttgttacagaccccaaatctgcagatactcagtctatctcccgaaatcatgttgttgatatcagtgagagtggccttattactatagcaggtatgagatactaccttgttattttcttttcttttttttttttttttgttatagggacagggtctcaccatgttgcccaggagggtcttgaactcctggactaaggtgattctcccacctcagcctcccaaagtgttgggattacaggcatgagccactacacctggccttctgtcttgtaatttggatgtgctttagatataagtttgacttaaattgtcctgccagaatctcttttaactttattgaacaagcattttttttattctgaattaagttttacacaatcccatgtttgttacaaaca

SEQ ID NO: 24566 - DNA, 1019 bp, Homo sapiens
tgccgttagcaatcttcccaaacggtaggatgtgtgttgccatagatgatagaacgatagcacaaatgttcaataacaccttctaatggtttctgtcttaggaaatcagcaggaagatgttggaaatatccctgttgatactcaatattctgtcctcattattgaaagaaaatacaatgagtccaccattttgaagcataagcctgaagttgtttttccacctgaatgacgattttgagcttcatcaggtcatataatttcttctgttgaagtcaaatgtgttcatttgtgatatggcttttaaaggtagctgaaactcaacgtgtccacaatgaatctatgtttttttctcaaatatgttaatcctccaaatctccttcatcttggggaatggcaccctcatcatgcccaccatcagctgtctcagcctaaaaccaggcagttatttttaattcctccttttccctctttgccactttttagtctatatatatctgattaaatctacctccaaacatgtctcaagtctaaattctttccatttgtactatccctttgcttaaaaatctccaatggcttgctcttgtctttagaaccaaattcatactttgtaaaatggcctccaagcctgtctattattttttcccacataatttctccactagttccctctagttggaacatgctggccttctttgtattttgcaaatatgtcaagatttttccatcctccagggctttggcttgccgttctgtctaccagcttcattgtttcccttgctttcttcatgactggctttctctcatcattcaggacacagatcaaatgtcacatcttcagagaggctttctctgaccaccccatctacaatgggtcctccccatgtagcacttaccactagcttaagaatattttgtgcatttatgtttaaattgcttgtcgctttctctttcctaatcctagaaattatgatctgtgagaacaggaccttttcttgttcacctgtgtatcttctgtg

SEQ ID NO: 24567 - DNA, 1044 bp, Homo sapiens
acattcagatgaggcatgatagtacacatgatttacacggtcttgtcaattctcggatttgtcacacatcaaagtcacataagatgatttttccccttattgctatctaaactacttaaggaataagttgcaaagataattcttagcataattgctatgcagaactatttatgtaacttgatgttagaatttttataaaaaggtttttatgaacctgttagtaagattttatagtaaataagttctcacacatagatgtttatatttaggtttacttgttttttgactactgactatatgtaaattatcacatggctatgtaagttatgttatgtaagctaaggctgaataagtgtttgctttattaaatggacttttttgggccatgtaaatttgaagctttttggctaatacatacatatgaatgaaaaaaatttgatttaaaacttggcatattgtctgtgtatttcagattaagctaatattgtataagaggacacagtagcataaagtggaacaatgtacatttattggatagtttaaaaatatagattgatttgtgtctgtctaacaatgggcccaagaacttcacagttggattaaaatcggggatatatatattttttcttcttcggagacaaagacatcaagaattcaggaagaacaaaggagcctttctctgttcagtggagaaaggatgacaggtataaatgaaaggttttatatgtagtatgagatgtaaataagatagccagagaagctataacaataacctaaaatacttagagaaataacggaagagctcaattatgtgacagtatgtaaataaaactgttctgatgtgatgttaaaattagggtcttgtaattatgcaatttacatttaaatactttcttataatctatggcatcatgaataagttgcttaaactttctatgcctcagtttcctcatctacatcacgaagctagcattagtaagtacttcacagaaatgttgtgaagattacattacaaacttcataaaagctgattagcagccagca

SEQ ID NO: 24568 - DNA, 1034 bp, Homo sapiens
tgaaaattagcagaacttgccaatgatgaaatcggatatttagctgaggagagtaccaagcaaaatgttgaaggtgcatactgatatcttctttctgttcagagtacaaatgtgagagaaaatagatacattcaggaaggaactgttaagcagaattttcagtaatttgttatggtggccaaagtaaactgataaagctcttaagtgaagagaggaatatcttctcatattattcagaagtgctaatgcatggatccttagtgtagactaatattagtttagacagtctgatattttaagttagcattagatacctgatcactacatgaagatagtgaatcaaaatgtgttattttaattctctgtcacttgaacatttaggacatgctcctatcagctgtcaatttattttttttaatattagcctcaaataataagaataaattaactttatcttgagctcaagttcttaaactcaccaatcaatgatttgtgagtcattcttttgtttgttggtgggttggtttctttgtgttttcttttatttgtttgtattttaagacatggattcttgggccctcagcaaaccttgtaaattgattttctggggctgaggattggatatttatgtttttctaaggctttgtcaattattatgataaacaaccatctaggaaaccattgaaattatgaagcacagctggatttgtctaccatttcttaagtaccccctatgtgtcagatatatattagatgagttttacataatgtttatatgtaatcttataggtacatgtttaatttcagctttgtagttggcaaattgaggttcaaagaagtagtaaagctgttccaaatcagtaattagaaaaactgatatttgagcacatatctatttccaaagcccattctacaaaaaaaaccagcagtaaagtaaaaacattatttgttcatatttccttatatatcctatctaggtggatgatgtgggtaagtcatttaacttcccaagatttgaagaagtgtataataat

SEQ ID NO: 24569 - DNA, 1034 bp, Homo sapiens
ttccctgccgcattagaaattgaaaaccctgttcagatgtatggatcacacacacacacacacacacacgacacacacacacacgattggctgtgcagatagttttgcctgcttcaggtaaaggtaacctttcagttagaaatgctttctatttgttacagatattcaaagagtggaagtttttcaactagtgatcctacacaattgaaaataaccgaaattgtattttgaccaaagtgcattccctccccaccccctactattatgtaaggagagggtgctgcatctggtgtcttatgtattatactgaagagtctaagttgggaaagctaaatatccaattattttaatttttacctgtattgtttttggagggagataagggagcagagtattgatggaaaacaagggaagaagaaactaggggcagctagtattcagccagaaagtaaaattatatacattattgcagcagtaatgcatttataagctgaataaatcaaatctaattttgtgactagttctgacatgatatgaatttaaagaaactactaccaaattcagtttaataaaaattttagcatttctatgaccttgagtatttggattaggtttaaattagaatcgcagttttcttccttttcttgtaaataggcaaagtaaatttaatgtaaaaatttgaaactcgctttaatttttgaaaatgcaattattggcaatttttgaccttagtaatttccatgctgttacccagggatcaatttaaataatattcataccctggatgatgccaaccatcaggtaagtctagtctcttacctgactcttttgaaatattaaggtattttgagaatgctctgtaatctaatgtgtttttctttctgtttcaattgagcagtaattccctaccttgcttaattctaaaatggacatcatatcttcattcttaaatggaaggtaaaatagaggttactatagggttattttagggcataaatgcctatggtattgtatgtcagtttgggaagtttgcc

SEQ ID NO: 24570 - DNA, 1031 bp, Homo sapiens
gaatgcctgttttaatatttctccaatcttattcatagttacaaaatcaggacaatttatttcttctattaaatgccgtttattgaactaagcattatttcaaagaaaaaagaactagtcattgaaaagtaattccttttttagatacctcattaaacttaacaatggcatttaaacacttctgattattgaaaaattaaacatgcctaaattatttggtctcattctactcatagccaaaatttaaatatagcttatcaagtggtttctgaaaggtatagagtaaaaatgcattcttcctcagctctttttctgtaccaaaaagcgctatctaggaagcttagcacagaactgaaagtgaatcaataggaagatgttggttaaagaatatataattagttagattgaaagaatgagatcaaggaatctattgcacagcatggtgaatatcgttaatgataatatatttttgaaatatgctgagagtggatgttaggggttctcaccacaaaaatgacagctatgttaagtaatgcatttgttaataagctggatttaacattccacatgtatgtatacttcaacatcgtgctgtacacaataaatacatacaattttatcttttagtttctaaaaaatttaaaatgaattttaaaaagtagaattaggccgggcgtggtggctcacgcctgtaatcccaacactttgggaggccgaggcgggcagatcatgaggtcaggagatcgagaccatcctggctaacacggtgaaaccctgtctctactaaaaaaatacaaaaaaaattggcctagggcagtggcaggcgcctataatcccagctactcgggaggctgaggcaggagaatggtgggaacctgggaggtggagcttgcagtgagcagagatcaagccactgcactccagcctgggacacagagcgaggctccatctcaaaaaaaaaaaaaaaaaaaaagaattaaaaactatcttcaggctgaccatatcagtttttatgtcttttcaaccaaatt

SEQ ID NO: 24571 - DNA, 1034 bp, Homo sapiens
ccagtttttaaaattaattttttattttgtaatttaacattttttaattttatttttccttaatatagtcttattaagcttctataggcagactgtcacttttgtacttaaaatgagaatcatggtgatgtctttatcaatttggaaaggagttcaactaatagcaactgtattaaggaaaaaaaagctttatattctgtcattgatggcaggtgaataaaaagcattaataactcttgatttattctttagtctctggtttactgtatgacccagacaagcaatcctttttccaagtcatgacatggaaatgtgtatctaaagcatttatgattcctctgtttacttgacttaatattgaaatctagggcttgcccataaactggttccacagttttgcttctgccctagctacaaccggggctgctcatgtggcttaaatgtttgtatccttcgtcagctgaggaggatatcagaaaggggagattcatcttcttagacgttgattctgaactgctactgctttacaaagagcaccaaattgcagatctgtcccatatccctaggtcaggagtacacgcctgtgtttttctacccataagtcagtgccaactcacaggttttaaagatttctgttaaatagttccttttgtcttaattttaagtatctagcaactcaaaatttgcctcctatatggaatttatttatttagttatttttattttattttattgagacagagtcttaccttgtagcccaggctggagtgcaatagtgcgatctcggctcactgcaacctctgcctcctgggttcaagtgattctcctgccatagcctcccaagtagctgggattacaggcacccaccaccacgcccagctaatttttgtatttttagtagagacaaggtttcaccatgttcgccaggctggtcttaaactactgacctcaagtgattcacctaccttggcctcccaaagtagctggattacaggtgtgagccaccgcgcctggcctctgggattctttttttt

SEQ ID NO: 24572 - DNA, 1700 bp, Homo sapiens
accacacccgagatatttaatgaaaaattatataaataagaaattaatagaattttaaaactaagaattgaagtgcatattacaattgagatgtattctcataccataaattcactcctataaaggatacagttcagtgatttttagtacattcacaaagttggacaatcaccatccctatctaattccagaacatttttatcacaccaaaaataaaccccatactcattaagcagtcatttaccatttctctctcccctcagcacctgggaaccactaatctttctgtctttatggattcgcctcttctggacatttcatgatttcatgtaaatagaatcatgtagtacatgtccttttgtgtctcactttttttacttagcatgttttcaagattcatctatgttgtagcataaatcagtgtttctttttaaattaatttctttttaaaagtgatattatactttttgtttttaaatattgaaatgaggtctcactatgttgcctagtctggtctcgaactcctgagctcaagcaatcctcccacctcagccttccaaagtgctgtgattacaggtgtgagccaccacacctggcctcatttctttttatgtgtgaataatattccatcacatggttataccacatttgtttatccattcatcagctatgggcatttggattgtttccatgtttttggctgttatgaatcatgatactataaacatttgtgtacatttttgtgtgaacatatgtttttagttcttctaggtatatacctaggagaggagttgctgggtcatatggaagctctatgtttaactttttgagaaactcccaaactgtttccaaagcagctgcacagtttttactttcccactagcagagtatgagggttccactcctccacattctcaccaacgcatgttattgtctgtcttcaattatagctttcctagtgggtgttaagtgatacctcatagtagttttgatttacatttccctaatgactagatacatttgagtatcttttcatgtgcttcttgaccatttgtatgtcttctttggagaaatatttatttaaatcctttgccctttttaaaattgacgtatttcaagtgctattataagtactatgattacttttagggagagaattttgtagaattgactgataatatataagtaaaatgtacgtggagagttgactgccacataagacataaaaataagcaaaactggtttatacaggtgaacagtattcacctacttgtattattgaaatggtgccaaattattttataactttagtgtctgattttaaaaactgttgtaatgttagtgatattttactgtattctacttggaataatgttggtaaagtttatagagttttcagttgtgatcgctcatgccataattacgtacctgtgctgtctaaaatatatccactagtcacatgtagctatttacatttaaattaattaaaataaagagttcagttacttggtcatactggccacatttcaagtgttcagtagccacgtatagctagtgcctactatgcaggacactgcaaatatacatttccacatcatcacaggaagttcagtcaagtagtgctaagctagatgtgctatatcctgaaattctctctttaccttcttcctccctgcctccattctttcccttccttcctt

SEQ ID NO: 24573 - DNA, 1031 bp, Homo sapiens
ttgcatactctgaacttttaataactaaaatgcctggttcctgttgaatatacacgtagatgactttctcaaagagggccttacctaagaggcctctggcatattttctgtgataaagatgatgacaatcagcctttataccaagtggcattttatagagttgcagtaagtggattatcttcgcttataaatgggttgttagccatgaaactattcttttaagatgtggtaacacagtgtggtaaatagaagattgcatggttctgtaaatgctgaaaactgctcataagtggggtgcaagcacagccccatatggacttgttagaagggagtacttccagtaggaaaagctttgcaggtgacaatcagaataaatggtacaggattttgttactgtaagccatccaacctagtatactcatatctcacctcagtatacctcactcagttctccccaagtgccagatctttaaaaagaaaaagaaaaccatttgatgaggtcactttcctacctgaatgacttaactgttgctctgtgatagactgaaagcctcaccgtggtctacaaggccttttgtggcccacccttctctataattagaatgtcccaagtgacagcctggcctgtatacaaggccagatttgcagctactcttaaaacaatagtcattgtttattaagcacttactgtatggcaggcactattccacacattttatgtgaattaactggtttaatcacaacaactctacaagccaattattattagccctgttttacagacgaaaacacggaaacacgtaacagttaagtcattcagaagtacgtaggaaatggcagtgctggaatctcatccaacccacttaaccctagacccacgttactatctgagatgagattggctctccatgtaacctataacaccactgttcataatttcatatttgtcgaattatttgaagcctccccaagactctaagctgcatgaaccgtgcatgtttagagcccattacaagcacctgaagtgtact

SEQ ID NO: 24574 - DNA, 1046 bp, Homo sapiens
tatattctaggtagaccctttatgtttttcaatctgttccacctatatccacaaatttattactgccacctactaaattgtttataaccattgtatgatctgatttttgtatacatgtgttgctaagtaagtttcacattgtcatgaaaccaaattataaaaaaaattggaggcaaggggtgaaagatctaggtagtgtatgaaagtttaaccagtatttgttgagcctactatgtgctggggcatcctctttaacacttcctaggcgccataccctgactaaagttccttcagcttctcatcaacacttttccgcatttccttctgagatgactcttcatctgtttttattctgactgttgaagcttttccagaaatggtgccttgctaaattcccatatataccatgtgctctttttttatgtttattatgccccttgtattgtcccactacctctaaataatgtggggaagcagtcacagagaagagagatcattgccaaccctgttttgattctgtttgacactcactgtctcacttacatgcagatatcctttcaccagtaggtttatggtaggcagctttaagatagcctccagtgatcccacctcctggaatccatgccttagtgtaatctctgtcccttgagcatgcctgaatttattattcatttctaatgaatagactatttatttgggtgattgtatatcacttccaataatagcagtgttaacaatatctcagtgttaccaaggattatcagtgattgttgatagtgttcaggaaaaagagcttagaattcactcctgagtcagggaaagaatgaagtctatgggtgtttaaaagagagctgtccaaggagtggctggaatcagataggaacaggtgtgcaaggcagtgtgtcttcaaaagatgtgtcttcatttgcatcaactattttaacaaccttggggaaggcattacatctttcagagccgttatttcgtcatctgtacaatggagttgaacttgatgatgattgttttgataaatcttttcaattcac

SEQ ID NO: 24575 - DNA, 1033 bp, Homo sapiens
atcttcacagatttctctctccctaccctgcacagcctccctacctgagtttctcatctagcagctgcctgcatgccctgctgacatccatccacagcacatgcccagccagctgagctcaactgcagtgaatgtggctgtagtgccagtgaactggctgtgctccaggactttgcctcccctgccatgccatctgatgttaagtgttttgttgaagagggagatgtaaacgcctcagtgagggcacaccaaatttcacagatctgtgaaaggtgcatgattattatttcagtctctattgtgtgcctattttgattcactcttatactgtcttctgtctgcacatccacagtatcaccatgcagatgtttggctaggtaaggttttcctgtttaaggcaggtggccttgatcttcctacttttcagtccttggtatcattaagttttcaggatcatgtgtaagacctcagcagctttcctgaatgtgtgcctcaggagcatggtggttggcatcaggcagtgtctgaacagtatttataaagtgtgtttgatgatgcttacaacattattgaaggttttctgagggctggaagctcttatctaagtaaaatagagtattatgaaatccagttaattgactttgctttattgcattcatgctgaagagtagatcatccacttggatttttaaaaaatcatgaaatgattttttttcatgatcatgaaatcccaagatgttagtgagaacaaatgagccaatcatattttaggaactgttcttgatgatggttcctggaaataaagcactggacacagaagtgacctctagttccatttgcagcttagggtccataagaattctggttctggtctttctgagattgaagtcttcctagtcgcagtaggggagggatccccaaaaagtttccaaagaagttagagccctcattcccaaattagtgccctgggctggaaattttagcttaaattgtctctcaaatccatttgagctttgaatttcagtgacagaag

SEQ ID NO: 24576 - DNA, 1028 bp, Homo sapiens
agtggtagagagttgtggaacggttggcatgtgcaacattctcagccagctctgtcaattagagcagattctgactgacaaactgtggtgtgcccatgtggcatggaacacttactccaacagctgtcccactgtacacttgtgaatcaacatgtaactgttttcatcatgttctaaagtgactaatagatgtatattacccatcatgaccaaccttttgatttgtataggttgatattaaccctttcttaaatttttgaattggaataatcagctagcttattgtctgtggagaacaaccaccagtactgacaagacctccctaaagtcacatcacagaactttgaagtcactgcagtcctgagcctgtcctcagttttacagttctcagaacctggagtaatatataaaccagaacacaaatttattaattcataattatcaaaatgtccatatttgccaagtacacttctcctttctaggatcaggtgactgttgccattgtgaacttagaatcttgtcaaaggtgaagatgtgtttgcaagaagagttcatctcaggaccatctctgtccctgagagcaaagatccttcttgtaatctcacttgtttttacttctctggggagggcaggaatctgggttttccttttctgtgtttcatactaactatcctcttctctaattatgacagcaatcacatgtgataagtcataatcataatctgattttggtctacatgttaagagtctgttccttgatgataggttagagctcttgggggatacttttactgattcttagtttacgtccacccatttccggtcttatcctcattttattgatttttctgattttcttctcttagaagcagccttgtttcctttctcttgaggttttgaggagcagctccctgatgcatctgcctgtgaggatactgaggcgagcaggatggcaatacccgagtacatcttcctagtgtccttaagtagcccacttggacaaggaaggacaaggtttcctaggattc

SEQ ID NO: 24577 - DNA, 1025 bp, Homo sapiens
ttcaaaagaagctgttagtcctcttaagatttagcttcagatgttgcacaagatcacatctgccacattctgtgatcaaagcaagtcacatggccagtcccagattccaggggtggggcagtagatgctccctcctcctgcaattttgagagcagcaaaattgcagtcacctggagttactgtctacatatttcttccccctgagataaatgagaacactagtgtcatttcacttttatcagctcctcactcctctcatgttgagactacacagaaggtatgtaggtttaatcttcagttttcctaaatcatttgctttgcactgtttcttgtgtcctaaaccttcctctgtcatatttgttgttttgctgcagaatttccttttattcagcattatggttgggtgattttggttacagaacttccttttgttgaaacaaattctctgagtcctggtatgtcctaaaataccctttattttgccttcatatttgaatcataatttttggtcagtacttggaagctattgataaatctataattgagaaggtgtctgatgctaatttgattttatttgctttttccactatagtaacatatataattttttctttatccttggaacctagaaatttcaatggcttggtccagatgtagcttgtttcattcattttattcacttattgtctcattttaagtgatttgttttcagctctgggaattttcatttcttcttgtagtatttcttcttttttctcttttccaagaacttggagtaaacagatgtcattcctgcatctaagctctagtcaccaaactgttctttgatctttttgtaaaatctctctctttttttttttaattgttgtttctgagagaattatttaggtcactcttatgaaatactctgtttttaaaaattcattttgctattcatctcacgattaagatttcttttttatcctgtagctttttcttcaaggcttctggctgtttctctttcctacttacagttttcagtttta

SEQ ID NO: 24578 - DNA, 2020 bp, Homo sapiens
tacatctcaataagcattccacatacactaaaaaatatagattgccataaaattattacattgtataaagaactagccatttttatcagtgaggaagtgaggctcagcaaggtagaaactccccccagggcacttaggttttcatcctactcatctcatgtctcaggatccttctattcatacttgagaagatcctgcctgcagttcaaagtctatctaggccttatgtgccatgaaaatgagagattgagaattcacttgctagatagagcaggcaagagaactcatgaggctggggaaatgcacagataaactaatcagacccactatccatttatgcctattaatatggcaagaataaaacaaccaccagcagaaacctgaaacttagaccctctccactaacatttaagccaggagagtagggaagaagatgggatctcagagggtgtgtacatctccccttttacttacggattattattttggaaacagaagactgatactgaaatttgagggaatggggtaacaagtcccagatcaagctatagaattgaagactgtggaagttaattgattataaatgaataataatagtagagtagtttgcaagagaaaactgaagaatgttgagaaaaatatttatagtctcagatgtccctatttgaatatacagagtgacacatctaaacagatagggtctctcgggcatcttaagccttggcgggatttgcctaatgactggaatgagactgaaaatatatcatccttcattcatgtattcatttatttagcaaacattaattgaataccatttaatgtgccaggcactaggctagtttcatggtatgataaagactgtactcactagaagacagagagactgatgtgtaaatgagttattaaaattttaataacattttacactaatcatcgtttccccctattttccaaaactgtaggaagtccatatcaggtcagtaagtcttttgacaaacacactgctctcactatgtgttgtcttaggaaaggcattccatctgctgccaagaacctattctatcataagctatgggcctaaaaaatagattttcttttcaacaccacattcctagttattgttatctttgaataatcagattcttctaaagaaaccaagctagctataggactccaccaagggtgaccttgttgctagttattaatatgttatatttcttttaaataagcagacttttatttttaagccttctttaggttttaaactctttttttcttttctgttgcaaaaacctcttctgcaattggtaaaacattcttctcatgtcagttaacatttgtagatgtctttttgtgtgcatattactttgaaaacagacccctatagcaatctagaatgtttattatttagtttcttgataagttagtcatatttacttattggttacctgtttagaaaatttagcaatttcacaagtttttgatcatggtgtgtagactgtagtctactgtagttgctaggaaccatctgtaaagccttggttcctgcaagggagcccagaagaaagtgttaaccctttgcctgcttgattgcaggaggaatgccagctcctgagcaggcctcattggtggaggaggggcaaccacagacccgccaggaagctgcctccactggcccaggcatggaacccgagaccacagccaccactattctagcatccgtgaaggagcaggtacatcctcgtattgaaagttgcagtgaattatttctttaatgcctttaaaaaattaatctttggatatgttttaaatttgtgtaacgtccttgacgccttcacgttttctaattataaggtgtttacatccctgagtacattgggatgactggcatgtagagccgctccaggtgccagtcagaatcggaacatgcaggatacttgtgcgtctgcaagtaaggacaatctcgatggtgatcggtgtctctgtctctcccacattgcagagtgtgtgcatgcacgca

SEQ ID NO: 24579 - DNA, 1046 bp, Homo sapiens
ttacaaaatgaataatttgagagaaagcttataaatgtctgggaaacaaatgtggtgcccttccgggaatttacaacctaggcaacctggccttttaaagatacacataacagagaaagaagactacattgccttgctgtgttatttatgttttttaatataaaatatgtgaccatatattcaaattactatgcatgaatcaccatttttagaataagattttacaaatacagttacttagttgtcattattattttcactattaagtattaattattattctgtaatgtaactctgatttgcttttaggcttacgtggaaaagaatagtaagaatcctatcagacctgtggtctttgggtcaactttataaaagtaattagagctattaaataggcacacagttttatttggccattaaagctctagacagaaaaccccaaactgtttgcctctaggttgttagagaaaaaaacattaattagcattaccattgcttctctgaatcttccctcttccctgtagtggacagtgcaagtgggggtgccagttgctagactgtgaagcgattcccaaggtaattgatcatattgacagaaacttagctgcctgttgctctactaaaaccatctcagttagcattcccccttctggtattcaatcaccctcgcccttcctcaacctaaagactgaaacataaccaagagttaaaagagataacagccatttatttactctaactcctaagggaaaatagtattttcctaaagagtaatttctaaaataaaggcatatctgtttctaaaatatttttactttatgcagaagtattttttaaatctttgcaactatttatatttgctaatttaccagtacttattctacttagctgtaccatcaacctcatttttaaaattatgtttaaaagttaattatacttattcgtaagtgaaaaaatcaaaataagtatctcacatttacatattagcttcagaaaagtaattttgcagcttttgcaatattaagtagtaattttgaaacaactat

SEQ ID NO: 24580 - DNA, 1068 bp, Homo sapiens
gcaggggtccactacataatacttgcacagtgcatgtttctgttatgattatttgctatttacttgtttaaataatcctgaatattctaatatgaatagcttccaaagaatatatctcttcttaaaagccatgtttaaacattagtacatgttttatttagtgaaatgatattttctaattgttctccaggtagttgaggaagcttcccaggctcctaagaaggcaacatgcaacatcagcaaaaatgatctgtaccaatccctagtgacctgtaccagtcttatgtaaattatgagtgcttataaagtaattaaggtttgagttgttcagtccgttctttttctctgaagcctgtctgtggtgtctttgtaattgtgagccagctattctcctgcctagcaggctttagggacaccacctttcccatacatgtgtatattaaagaaatgttagctcatcttaataataaagcaaaatgtaattagatctgctacagaaacatcatactctgcactacaaatataagtgtaaataatttggagtagacacacaccactggatagctctattagcatcaataactaagaattggttgtataaaaatagccttacataaatgcttctctgttctttgatttaaatatttctgaaatgttttactgcctgcaacacaatttatacccaagtgtgggaaatgtttgttaaatgtcttgtatttggatgtgaagatggatggtaatagtacttcacactcatctggatttgcctttggttgattttctgattgtcatgggttttgtccatgccacctgtatcctcacctggtctcacttttgatcatgatataattcgtagggtggctgacagtttgagttgtacaacccacagacataaactggttttttcttctgtggcctatttttttgtttgttctcaaaataccatcccagctgagttaataggccaagtccaagtataatctactctgagactgagcttggttttttccatagcttgcttattttggtcactgctgatctaactcaagatactttaaaactcttgat

SEQ ID NO: 24581 - DNA, 1035 bp, Homo sapiens
ctgaattaagactttgggttgctttaaatcagtatctgaatattaaagagcaacacaaatgtacccaccatccctgtactggcccttttttttttgaggcagagtctcactctttctcccaggctggagtgcagtggcgcgatcttggctcactgcaacctccatctcctggattcaagtgattctcctgcctcagcgtcccgagtagctgggattacagtcatgcaccaccacgcctggctaatttttgtatttttagtagagaaagggtttcaccatgttggccagggtggtcttgaactcctggcctcaagtgatctgccctcctcagcctcccaaagtgctaggattacaggcgtgagccaccgtgcctggctggcattgatattttgctatctgcaggctggctatataaagaaatcatgcattttaattttgtaagggttgtaagagtgcctaatttgtgtaaatttcttgctttgaaattaaataaatagagcattatggctgtagcaaaaaggaaccactatttttctcactcatttgtcatgagtggtgcttcagccactacttccttcttgtgattttatgtaaaaaaaaaatggatcttctgtatatgaagtttaagaggaaagaacaaaaaatgacattgagaacaaaaaagggttattgagaacagaatatgatcagaagataaaagaggtaaattattaactaagtgtcatgataacattgtacaatgctaagagcttagtaaaaatggaatccaaggcatctgtctatggcagaaattacttaatttttttttctctacttaggaaatgaaaatatatttccaaatttttggcaagtgaacctcttaggaaagaacgtggtatattaaaaaaataaaaatttatattttactttatcatgcctaactctttaaaaaatagctcacagcatttagcattttgttcatgtacttcacacccaactcctctgatgtggttgttactcccattttacaagtgattaaactggggtttacagatg

SEQ ID NO: 24582 - DNA, 1049 bp, Homo sapiens
tggtgctttgaacacctggtattgatttttttaaaactaagaaatatttctaaataagattgcattaactttaaaaatgtcttcaatttactttgggtttttctagaactctatgaatctaccacacaaactaattactatatggaataatttactgtactcacatacagtaaatactaaatgagtgcattactgtaaaaacataatcatgattgttattttttatttaagtacctcttatgctatttaaaagcataattcctgtaaaaattacatgttccgaatagttaaatcactgcttatcctatctatagatttctttcttaataattacatatttctgtaaagcctactgtaaaatgctttcattgcttgcagttttaagtttgatctgcttacacttaggtagacatgcctgcaataacttttctctcagttatttctaacctcataattattctacttttcagtatcttgtgttactcatgggcaaaaaaacttcttagtgaatagaattctgtctgttgtttctgattgttggtatgaacattaaactattgggctggtaagttgtagtaatatgaatttttcatctctcttaacagttgtgtatattgatatgtttggtaaggcataaagtatataaataaaggtcgtcaaaacttttacaaaacaaatataagattatgtaattattttataaatatccaggaaggtttttatagaaagagaattataagcaaggtataaaataataaattagaaatttctaactcagactttgcaatacccaatgaaataattcgttaagttaaaactgtgaaaacaaaaattagctttaattctctataatattttttagaaattatccgtatctttagcaccaaaaagaacaactcacaaactcaataatatggtattatatatttctaaaaggtatgaaccaactggttttgtttttctaaccagaattatattttaatagaaaagtaattcaacatttaacagaattctgttagtacttcttattctggcaatattactaacta

SEQ ID NO: 24583 - DNA, 1032 bp, Homo sapiens
gtgtgtgtgtgtattgtgtatttcttctagacttttttttttttttggagaaaaataatagccagttattttaggatcctatgatgtgtagtctttgcttcagtccaagtcaattaaagattgatctacttcccagatttagttacattatcaataatggggctatttcagccacagagaaaattcaagtaaaattatcaaccataatacaagaactaatgcttacaaagtacaaaatgcaaaagtgtatctgttttctgaacaacattagcaaatgtctttcagtaaagacatttgtaaatgacaactgaaatagtattatatcataaatgaacatgaaacaaagggagaaattatattactgaatgaagtagtttaatcagaataagtctagaagttaacttggtagaacttcgcaaccactaacaaaatagtgacaaaccaatgatcaccaatggccactaaaatcatcagctggaaaggtagtgagaagttttacaatgaatggatcaggctgacaggacatgaacccacttatctatcttatgttaatatcacagaaagggagacagccagaaatcacagtcacctgatacgatgcaatgagaagtatgtaacgtcacccatgacatgttcttgccctaaaattatttaagcatctagatattaatatcagtttatggggaatacaggagacagaggaacatgtcagttgatactgtactgatacattcattagaaccaggctaaaattctacagagcaaatgaaattatttcaaataggaaaaagaagagagggggaggtaaaactatatatcagaagatttttagagacatagcaaccaaatgtaacatatggaccttgttttggtcctgatttaaaccacccaactgtttttaaattgaaacagggaatatgaatactgactagatacttgttgatactaaaaattttaatgttaatttttggtgtaataatattgtggttatgttattttttaaagtatctatatttagagatacatttcaag

SEQ ID NO: 24584 - DNA, 1051 bp, Homo sapiens
cacatgttcattttcttgttgaagctgggtaataaatacaaagagtgtttgttatactgttttttattgtatatattttaaatgttgcataacagtttttaaaatgttaggtgattcagatcttaattttctgactgaaattgcattttaaaaattaaccataatttcaatgtttataagattagtatggttatatttcttacaatctgagtaataaatattctttttgaaaatttaaataaatgtcatttattagctctaacttttaccatttagagattataaatttacataatatgttccacataccatgtaatacctttcctatcaatgatgttcactcatggcaatgaatgggacagggagaaaaaagagggaaagaaagattaagttagtcagcctctcctctgttatgttgtaaattgtcatttctttttggattcatgtttcttaaaagaaacctggacattaaagctagaaatttaaggcagtcttgaccaaccacttaccttttctgtttgccttgaagggtacctgttcaactcctgatcagtgtttatggatcacacactgtttatcaagaatgctgttttaagagactttaccctgtctctccattatcattatcatcattccttcttattcatcctcttaggcttttttctgcttcattcccctacagcagtagttaggaacatgtgggtgatagagaagagtaggaaaccagagtggtgggtaaggggatatgggatgaattagggatccatgagagttttcagagggatttaaaacattctagaaccacttttctaggatccagatgtcttactacatagaaacatagtatatgctatgtagaatattgactgtttccttatgggtccactctttttccaggatagttattaataatcctgggtctgtggactgtcccacatgtgaattcattcctccttctgcactaaaacagctattcatgtttcttgtccatgaatcaagagctgaaaatgctgttacagagagaaacctttctttttcaaaaagcaaggca

SEQ ID NO: 24585 - DNA, 1029 bp, Homo sapiens
aagaaagtgttcgagaaattgatggatgttacgtaggtgataaagaattggtgctcatgggtaagaaattagaggccaaaaaagattggaatctctaccaaaacaacaagtgagagaaattttctggttgactcagaaggcactgaggggttaatagatttggatgaacaggagagaaaatagtaacaattctgtgcagttaggagttttgatgtttgacagtaaatatggaagggaagaaaaaagaccatagtaaaataggaagtttaaaactgattctataacttcacagtgctgcattcatttattgtataacaggtattgaagtggtatgattttaacatactattcatttaaatcattactgtgtgaaatactggcattagttaatgtttactactaaatttaagactgtaggagctaggctgtgcattttgtttatgtatttaaattttgtttctaaaatgtatagatacaagtttcttccactgggatgagctttaaaaaataaaaataaaaaaacatcaataccgaagataaatgacaaatgagaaagtagtcctaagtcaatttatcttttcttttttcctccatctggtgcaagtaatttacaacacaaaaattcatcagcacatcatgagataagaagttgacttaaattgaaacactttatgcctcagtagaaatgtactgaatttataaaggagatacagtaggaagtgagtgttgtattgtacatgttcataaacaaaatattagatcagcaatcatgtataaaggactattattgaggattttggatgccgtcatttattatagccataaactttacaaatgacaaaactttatcatatatttcttcctgtttctcttctaaatataaggatgataagaatttcttttaaaatcagctgtagagtacaagtttctctcccttattttctacaggcccatttagccacacagtcttgactgcctttttaccaactgcagtgctatagcttcctgattgccactataaaagctctt

SEQ ID NO: 24586 - DNA, 1050 bp, Homo sapiens
atggaaagcaaaaccaaaagataaggatggactactgtagaataaaataagtaacctgggtacacgaagtgttaaaattttgatggttttaattacttacaaatttgaataaatatcttgtttttaccactagaatgaaattaataaattttgctattttatcatttatctctaagattcttatatttctctcagttttgttactgaacctcaatgaacatactatataagcagatttgtagtttcacttttgctgtttcttgctaaaaaattaacaaaatatttatgtacattaaaaacttaagtaccctttttagcactaataaggtagaattttaaaatctaaaagtaagcgatttatataattgccaaaaaatatagtccttaaaattaaaaatgttttacctttaattaaagtgtgatctcatggagaacatactaatctttttcaaaatgttgactttctagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccaggcgagtaccagttaggagtctctagaaggctacagtattgcaggagtcagccagttcctccattttgacttttttaagttgctaagtctattatactatcattatactatcattaattccatatatattaatacttccagttgtattccagctatataggtcattgaggttaatttcattttaaagatagattccttctttccatcctttcataataagttagagaaggcacagatccatgggaatatctgcagcattcatcactgaaatatttcatcaagacaacaacctggaatagcctcttggaattaaacaaggctttgaaagatcaatttaccctttgcccttatcctgaccgactt

SEQ ID NO: 24587 - DNA, 1030 bp, Homo sapiens
catccattatctccttgatggttcctcacaccctgagcctgggtagttttacctgcctccatcatgaacgtcttgtgaaagagcacgactaaaaccagagcactcagagcgaggttcactcaagaaggaaaatgcaggggcctgtccagtgatgatgtttgaagcacactggcacctttatggctgttgcttttttgcttttggcaatgtctacaaacacttgggctctttttaatataattaggaaacatggcataaattgaatgctgtctaaaaatgagtggtttaagattgtctttcatatcaaaaagaaaaacagttgtataggctgccatgcatatctgccaccagagaaatcgcattttccaaatgttttgttttttttaatatcctttaagaagtacatttttcaaatagttgctattattttaattaatcagtaaaatcagcttctaatttgactataaaattatcagttcgccattagaatagctataaagttagttttaaatgtgagctctttcaaaattgtgcagcataggatttatgtgaaatggtattttaattactttattcattctttgtgaggaaaatgaactttcatttctcatggcagtatttcattgtgattattggttactcataattatatgtacttgttcctgtgacagggaataagcagcgttttctacaataatatgcatgagactccctaatattttctaaattagtttgtatgtttatattcttagtcctcacaacaaatagctaattgctttaaattaaataaaacctcaagcttcctcaaccaaattctagtttatttttaactttccctttgagaaccaggagataatggagtatggtgataaatatttttgaagcaaattttgcattaggatgttggagttagaggttatcatgttgatggagaaggctaatcctacagctcttcattttctcatcagtcttactacatctgggagttggtgtattctctattcattacttactgccctagcaagattct

SEQ ID NO: 24588 - DNA, 1031 bp, Homo sapiens
ggtaaaggctttctctctggttcccctaggctcattctcagggtggtgcccatgctgctatttcctccaattctgtatccgcactagaatcagagccatcagtatttgagtatctactgactaaaagttcctggttgaggcactgtaatccccccaaactctctgccctcctggctgcagtgcagtccacagtccccacccccagcactaactgttgttgcacctctctacaccccctcctgctgctgctgcctgtggttggtctgtccccagcatgagccccttaccctctccctcctgtgcccgagtacagggcattctgctcatcatttgtcagctgtgacgaccatccaggatcctcctgggggccgaggaaagtggaaagaacaggaaagagggactgaaagtgtcaggacttccaaagcgggccagttacttggtgtcaggatggactggactaggagaggccattggaaggtgttggattgtaagggtgagcctgagagaaaaaaggatgaagagtgcctgggagaagagagaggaatgcaagggaacagccagtttttgagccttattgaaccaggagatctgcagatgaaattgagaggagtaagcaagttggaaagggaagcttgctagatagacaaatgctgaacttggttttagacactcaaacactcagttaaatgacagttggcctcccaatcagaggtgtgatgcagtcttttagggaacaaaagaccatgtacagaaggcaaatgtcagcagggaaagacaccgctgaacatggctcaaaaggagggtggagttgggagattgagaaggaggcagacatgggacttggggatatagttgtccccagggagggagttggggcatctgttgtcacgccaaggatctgcagtagtgagaagtgaggctcaagcatcatgggtgcagtctgcacggcagcagccctgaagagaaacactgggccggagcctcaagcatttcggtcggcatgaagtcaaatcctcagcaggactgagaag

SEQ ID NO: 24589 - DNA, 1050 bp, Homo sapiens
agggtcacagctacttagcttgtgtgtgaaggggttaaagggaaaaaagggagacaagcagttgctctggggatacaaagataaatacaagtccctcactatgagaaacagaaggctagtgagaaaaacagatggtgccagcacagtgtagaagccacaggatgtatgtgctgtggggtcctgaaagaagacatctaacccagccacacagtgtaagggaaggtcaggaaaagagcggagtaaggacgtggaggagatttcctgaaggggatgctgcccggcagaatctctgaagatgagtgaaagtaagcctgtagaggctgaggctgtggtatggaaggagccatccagataacagggacaacaggaggaggacagtcttgtggtgcagagaagacgtgtgggccaggactactggctgcccactggggcccaccatggagccaggcatcatggataggcctgaaggccaaacttcaggagctgaatcctaacctacacacaggagggactaccgaaagagtctgggcagatgagtgacagagacgggctaatatcatcactgctcccccacttccatggcagtgcaaaaggtggattcgaggaagggagagttagaagcagggattggatttgggagccagtgcagcaatacaaaggtgagaaatcttgagtggcaggacagaacacaggttgggcagcactgtggggagggatagaggacctctgttcctctcagaccgttacagacatgcctgtgtctaaggtttctgcatctttttgcaaatgtatgagtatgaaaactgaagacagtttccttttgttaccactgtaagcaagttctcagaactttctaaatgtcccccagcaacttcccagacagtccttgtctgagacattttcaacctctagtaatttcttgacaggtgtattttagtagagttactacaatgcttgctgtgggcttcttcccccaccttaaccccccaaaatgagaatcttttggtgatggtgttttcaagatagtgaaaagcattgataagcctaggt

SEQ ID NO: 24590 - DNA, 1033 bp, Homo sapiens
tatatggcttgtaaaatcattaacagctgagccctagtctccagtttcttggcatatttgagtactcctgttttgtgaccattctttttcagcaggaggcaagctcattaattagtcattgattagggaaggtaaattttcagaaaggccagcaattttagttgtaccttacaacactagtagggttaatgtctctcatttctaagagagttctctatatcctgagcaacaaaaaatcttaatctccctttccaatttttggactgctacctgctaattcaccaacactaccatactctaaataaaaaatcacatgaatgttttgtagctttcccctctcacattggtataaatctttatcccagagaagaaccactgtcccaacatcatttccaccctgggcaggggcaggactagggtgagctaagcaaggcgccaaaggcacaacattttaggaggcctttactctcaggtttgtacaaggtagggttggcacatgcacaaaccaaacagtgaggacctctgtacgctccgcaccccaggcagcttgcttgcctctgcggcattgccacatcctaggcaggatgcgggctaaagaagacatcagggacccccataaacctgagcttcgttcccaggatgtgctgctcactggccatgcaacctggggtatcctatataaccccgttcaggctccgtaattctatctagattggaaatgaaaggcaactcctcatctctgaaggggagctgttgatgcctgctgtcctaactgggtttgctgtaaagaggaaatgagagagctccatgccaagtcccacagctggtgacaggtcaggggagaaggaggggaaatgggacaagatcttatgtggattcatgtgaatctatagtaaacttaaaatacacctgccatgagagaaggagagagaaacaagggcgatgatgtttaccataaagaattgctgtaaggattaaacgtgatgacttacaatggaagcccttcacacagtgcctgacagaattgctattt

SEQ ID NO: 24591 - DNA, 1020 bp, Homo sapiens
agtctctgtgttttccacatgcatcagaaccgtcagcccagtgtcactttgcaggggccacatcttctagactggctcatctcttaaattcaaaccagagaatggagatcaatttcatttacattttcatggagaagagtttgaataaatagcaaaaggtataatgtgattcttctcaacgtgattattttttaagaataacaaaaataatgttacatagtgttaatatttttatatcctattcagaaagctgtgcatacaatttatttaaaggataccagcccaaagggttactaagatttcatactgttcccattctcaaccgtctggcgattataactactttagatgttccaaataagtcagtgtgagctaccccacaaaaagtactcttttctcaaacctgtctattaaaaataaataaaagctggtggcagctttactcctgctgggggggcagtctccattgtactgttgtctttgaaattgtgatttcacaggactatttactaatcgactgttgttactatggcaattaatagctcagaaaattgcagatgctacatttcaacaccaagctctgggcaaaaggaaatgcacataccaactgaagtgcatggttgcttccgatttgcagcagcctgctttatcttacagatcacctctttagcatgcatgcccttctgtatcttcttcgcttgcttcaataaactaatttgcctcaactacgtttcattttcctcattaaaaaaataaaaatctttgctagccttaataataatggaagggtaacatcatcaggagtctactatggacttttgaagacaattatctcattattaccaagttccttttgtattaaaacatacttaaatatgccaggtacaagactgtgcctccattgttgctccttccttgacctgagattttgaatcccagttgtttgtttggaaggcatggggcttgttcgaatattgtgtttcgcttctcctctctgacccactgccgtagctcagagcc

SEQ ID NO: 24592 - DNA, 1073 bp, Homo sapiens
ccggtgttctcaaaacttactggacttattgtgtaaagctccgggaggaaatgtggcgttggccaggtagaaacgcggcgctgcggccaaggggcggaggacgccaggctcggcaacggccttctcccagccccctcctgccagctccagatccgcgtgcctccagtgttgggaccgttctcagtggcgttgttccctgctggagttaacttgggaggtgaggagggaactttcatcttgaacttgaccccagaagcagcgtcgtccgtacaggttacaaggtaaatggaagctgagtcttaacgtgggttggaccgcaaactctggctggcgcggaaaggaagttcctggttcagaatctttgaggaaagggctcaagattgctgagatcgctcgctctggaaatgccagacacaccagactgcagaagttaatgcgtgtttggaggggtgggggtgggagaggaaaggagaaacctggttagttggcacagagggctggtatttctctgtagtggaaatgaagggagtctgcgtctctgctttcaccagatccgctaccctcttttttccttccttggtcatctttattcctgccaggctggcactcctgaggcaggggaggggaaggagaggaaagcagttgtgaagcttcctgggtcagcctggaggtatttcagatctgctactaggaagattccaggattttaacagctgcttcttgattgctgggaatgaaggagtttatgagcggctgagactacttcattatagaagtagtctgagtgttttactcatctaagctacttaaagacctcacaagggaccttccctagagtatgccagtttctgcagtttgtgtcagccagaatgcttggtgagtgttagtcaaaaagcatcataaatatatcctggtggttctgaaatgaaaagtatgtggcagtaaaggaagtatggtatctgatatccttcaggacttcctcctagggttgttcctgttacctgccaagtgaacttggttcaggcttccggactgttgtgatttgacaataagagatgggaaatagtgtcatc

SEQ ID NO: 24593 - DNA, 1049 bp, Homo sapiens
atattaagcaatggggtttaaacctcaataagaagatgtatcagtgctcattggctgggaaggaggtgtagtatatctgaaattgccgccatttccatgagtgagagaagagaacattatgaagtgctattagctagagaagttgggacactttgtaccaggagggcacaagagcagcaaaggagaagaatgattcttggtttttaataatattatcaggagcatggatttggaatgatagaggactttgaagaaggctttcagaggacattatcttgtggagagtgaaaggagttctcctggtttggtttagctgtgttgctgatggaacttgcccttctagggtcggtgttgtctttaggttcccctgcaggtgggtgtgatcaaggagaatgttctagaaagaagagttccatagacagaatgtcaaggacaaaagtgttgcagagggatgacatagttcctggattttagcacagattttttcgctaacatgagggaatttattaggggaaaccttccagttgtagaggtagacagatgcgaacccatcatgttcagttcacatagcccagagccacagtgactcaacctcttccctgccccacctcagcacacctagggttacgtgccagtcatgaacagtggcttattacctctttgggtaggagatgggggtggagagtagggaagtctctcagaagcactcagctgtgaccttttcatgcatgtatacccatgcaaaaatgggatcctctgttgcatgagcttttgaagaaatatgaaaaagatcatacgtatacggctgctggtattatagctctcaagcctcacatccagaattggcctttttgatgttagttccaatttgggaaagccctggagggaacccgaattggcttgatgccagccaaaggagagttacggttagacccataaaatggggctgtggggagacaaagtatcccacaaagaagagggttattgttaatggaagagggagggagctggatcaacaaaagagctagccagggcagtgtacatttcca

SEQ ID NO: 24594 - DNA, 1035 bp, Homo sapiens
aatgacttccagcaattaactgtgttgaattactaaacatagtagtttctttcaataaatttgtggaatatgttcatcttattagtatctgagtaatttacttcgtggtccagaactgagctaggtgtcagggatacacgtagacataagtattgtagtactaaggataaaacaatgcgtataccaataggaagggatgtcagctacttaagtaaatagactttaattatttagataaaatagacatgaaagaactttagtgtatgcaaatttataaaacatcaaccagcagctgttcatacctctccatgtgtggggtgttgggagtggggcactgagatgcagactgtggcaaaaaaaaaaaaaaaatctacctgctttacagactgtgggaaaagaatctacctgctttacagttgcatgacatggtcacttaagagagtggggacagaaagacatggacctgggtagctttggaaaatggtgttttgactataatctataaaaactacaaaaagaactgcataaacgctgtactctagtgggtaaagtttctcatgggacacaggttgacagttccaacgctgctttatatatgtacaagggttaaacaaatagtgaaggggtggtggatggagagagccaagtttcccacagctggagaggaaagtcaaaggtatgcaaggaaggaaagctagaacgaaccttgtgggactgtattaaagtcagaaacctcaatgtgaacttaggtttagcttgacatagatacagaaataattatattttagtgtgtattcatggattaggacacacatgtatttcctagatctgttcactgaaagagcttagaaacaataacaccccagtatcttggttcctaaattccattctctaatcacagtaaccaggactccttgaagaaatggataattataggtctggggcatcttgcattgtcagaaaataaggaagtgctcacgaaacaaaggatgtgggcatgtctgaaggccataccagccaacctcaaagagctcc

SEQ ID NO: 24595 - DNA, 1039 bp, Homo sapiens
gtgaggagagcaccaagaaaacaatacaaccaacagcgtgtattaaaaacacctgtctcaaatatgaaatgtggcattttgtttttgtacattgtctgtcacagtaaatatctagagtctgtctcctgtcatgccaggcctggtttttgtagatagtaatttggtggtgatggacattcttgataaatagggcttttacagactattctgaaaatgaatcatgggacttgcctttaattgctagcagtggcgtgtatgtgacatactcgctcctgctaatgtgtgccaatcagtaagttactgtttaattttctgaattttatgggatgatgcggtaagaaggcactccccagaagtgggcccctcgatcttggacttcccagcttccagaactgtgagccaaatagaagtttataaacaaacttctattgtttataaattaccatctccatgatattctgtgacaaaagtacaaaatggactaagacaagggatctgtgaacttgaatgggtggagaaaaactcaactgtattttcactaacctctagccaaaatatagccattgcttcaatcatgaaagtgggcaaccaaccatgtaagatcaacaggacatgtaactttgtcacatggaaattaactgatttttgtatcatattgtggaaatagtttaaaatacatttatgcccatcgctgctttaaaaactgcagtagttataaaacctgctgctgtgtcttatttatgcgttaagcatactttagtgtatcaggtttgctttttgaacattttgctatctgtgtttcaatataattagttttctttgtaataagactgtctacttaaaaatcattcaaaaacactctgagggtacagattgctgaagccatccatggaacttaaaaggttacagattcatgccttggatatggcacccttgtgtctttctcatcctcatttgagactagatttgttaacattaaacctgaattttttttttttaagtcttaacatatttggcctttgttttctagcatgccttg

SEQ ID NO: 24596 - DNA, 1035 bp, Homo sapiens
ctttttccccaaattaaagctcttaaacgtgtgaagtggtgagaatgttagagcctgagctgaccggttgtggggaggttctagctgtgatccctgttcctcagggttaccttccaggccccagtctcccatctgagacagtgtgattgcatttgatgctgtgcgatggaaagcattttggggtaggtgggactgtctgtggtgtgtaaatgttccaatggaaacacctgccagtgaagctggaggaggtaaattactagtcattgataacatagttttcataccctggagaggttgcatcgtcctacctggcatttctgcctgcagtaacaggaagggtgattgaaatgtgcttcccatcacttaatcaaggtggggaataaaataggtcatagttaaaagaaaacagtatctattcaagggttaagaaatatgccagctgtgctggttgttgcagtgaaacatctttaattcctcttaaatgtctttaagcttctgctgaggaatgttacatctactggagaatctctggtgtcttgttgcccagaaccaatattgtattgttcacgtggatgcccctaagagattttcactttctgcccgtggcatcatcgtgatgctttctttgtttgaccgtattccccttgcccttgtgcagttaaagctcctggctccagagtgctagatccacccagctttgtgcttcctgttcatacataaaacttctctccctactttgtgcctttctaatgaaaggatactggaagttagagatcttttattgcctctgaaaaacaaaccaaacagaacaacatgtttgagagtgattatagtgagatggtaaagtaaacttgaaatggaaacccccctccccctccctcttctcttaagcctcgttttattgcagcctgcataaaatcatagtgctggagcccagctgctccaaaggctgaaggtcctcatgcttacagcatgctttggaaactcatctgcaccacatttgcaattaatgaaaatatttgctttgcttgttat

SEQ ID NO: 24597 - DNA, 1033 bp, Homo sapiens
actagttccagccaagatactctttcttgtatatattttttaacattgtgattacatcctttctgcttcttaaggttctgtctaccctagaatgttgttagaaatgcttgttccctggtgccacaaagaaatagcactcaaacataaatttaattatctcagcaaggcagtttttactttctgcagaaagggtgctcatcacagatggaacaatggcgagagcacacctggacaggggaggggcaggagttcttattcctgacgcaggtagcccctgctgctgtgttgttcccctattggctagggttggaccacacagtctaagctagttctgactgactgttttaaagagggcaggggcatgagccagaatggcggggtttggtgggaaggacggtgaggaacaggtaactaaaggtgacttaggtcagagcaggtgaccgggatgagtcaggacagagcaggtaaccagggaacagacgtgaactactaattaggattggcgggaaagttgttgactgaaactagaagcgagaagccaaagagaaccaggaagttaaactttaaaatggagaatcaaagaataagagctgaacatactgacatactggtttttttgaggagaaacttggggtttaccatatttaacaatgtttaatttcctaatagtaagcttgtttgttcccaagcttgtttaggggtggagtgtcaagcggaagctgcctaataagtgagcaatgtttccagtcccatgactggtttggggctgtttgagttttaggagggtggccctgtgtcatggggagtgttgagtagatgggatgggagccaagggatggtgctggggaggaatgtggatgtagactacactctcacttagtcttttcttattagagaggagcagtggaggcctgggagttctggaagggttggtatctgaatctgttttactgatactcatgtaaggctagtaagccctctccttttccttttctgagatcaaagcttcttgtggatcattcatacttgacct

SEQ ID NO: 24598 - DNA, 1028 bp, Homo sapiens
tatgtgtgtggaccacattagtttttgtcttttttcaagaaaatatcctcaagtttttctccataggaatgaaatttatttttgctaaattctttgcaaggccttagaatagaaggttaatagttctgaaacatacaagcttctggtggatttgggatgttctctctattagatgtttttggtccaaatgataattaaataaactaagcagatacatctctaacggagcagtgcttgttcactgcccaaatttgtacagcaaattagtgtctcacagtggtaatttggcttcattatcttggtaattttaattggaaaagtttagggcagagatgctgtttaaaaatggcagtgactcaatacatcaaatgatgaacagtattttttttcagtgtctaacacagatttctgcttaaaccattttgttggtaaaagtatccagagctctaatgttctacctgcctggttttaataatttaaaaaaaaaactgacatatggttgtgaatgtgtactggatttaaaaagactcatctattttaaaagctagcactgttgctgctaatgatagagtcaatacagtgtgtctgcagcacccagaggtatggagccactcccctcctctccttccacgctggccccacagtgggtcatgctccagggtcgtgccatcattcagacatgtgctccgaaactaccttgatgacttttgttctgatttgtaagatgccccccacccctgccaattcctctcttgttcaaggttaaaaaacaaaaacaaaaaaaccaaacttgtttcagttgtttgtatagaaactcttcactaattgatgctaatccagaaactgttagggactggaacaattattcttgcaaggatcaaatactacaaacccctgtaagaagacactctgaacaacacagcctgtaataataaaaatatgtatgttaatacaattgatgattacttcctggatcttgggaactgtgggccagagataatttaattaaccttgcaataatgtgaccc

SEQ ID NO: 24599 - DNA, 1054 bp, Homo sapiens
ccattctgagtagcatgctgaaatccagctctttccagcccaggacaggaatcttcccttggcccagtgtccatgtgctgcacacgctaccctcctgttaatcactcagtagccctctcagttgtcaggctgactgtcacagtatcacaccacatgtattcaagtcaaccttattttacttaactgtggccccaaagcacaagagtggtgacgctggcaatttggaaatgccaaggagaagctgtaaagtgcttcctttaagtggaaaggcaaaagttcttgacttaataaagaaaaaacattgtatgctgaggttgctaagatctatagtaagaatgaatcttccatgaaattatgacaaaggaaaaagaaattcatggtagttttgctgtcatacctcaaactgcataagttactgccactgtgtgtgataaattcttagttaagatgaaaaaggcattccatttatgggttgaagacaagaacagaaaatgagttccatttgttggcaacatgttgccaagagaaagcgttgagactatggagaaaattctgcaagagaggtcccctgaaatgagtgacacaaagccatttagtgcaagcgaaggatatatgtataggaaaaagcatagtgtgtatacagggttcagtactatcctcagtttccactggaggccttggtatatatcctctgcagataaggaggcactgctgtacagtgagtaggcactgtcctcagacactggttctgctggttccttgatctgggacttcccagcctccaaactgagaaataaattgttgtttaagccacccaatctatgtttggttttgtttctttaaattttttgaaaaagatggggtttcaccatgttgcacaggctggtcttgaactcctgggctaaagcaatccttctgcctcagcctcccaaagtgctgggattacaggtgtgtgccatggcacccagccttctgtggtatgtgaaaagtagcagcctgaactaagacataggacaagtgaaatttaaacaagatgtagactgtaaagtgtagg

SEQ ID NO: 24600 - DNA, 1011 bp, Homo sapiens
ttgacttcgatcacctggccaacgtagtgggtgccaggttgctccaaggtgaagttattcgtttccttccctcccccttccatatattaacatgaacgcatttgtatgcatgcatagatgctgtatgtggagtgtgctgtactctccagaaggcaggaagtcgctgtgtgcagcccacacttaggggtatggtggtgtacaccaccaccatgagagtggaggatctatgtaaattgtttggaatttttctgcataggagatttgtcttgtttcccatttattttcatcagtatggattcccgggaagatgaactcccagtgttgtacttgggtgtgattcaggagtatgcaagcctttctgccccactttgttgccttgttaactaagggaggctgagataagtcctctcaggtgcagtcagagtctgtcctaagatgggggtagggagttgctgtgcctcagtggtttactttctcaatatagactgttagccatatgtgtgttacctgaaaccttaaggagaaagcatttttggccggcctggaaaggacacaagcaaatgtagccttgatggtggagaaacgtctctagcagggctgtgcatctgaatcagcattgaagcagcgccaccttgtggttgatgctgaatgagctgtgtattcggccaggttctgtgattcttaccctgtctgcatgctgttcgagtagctaaagtactttagaaaagaagaaacactttaaactcttaaagaaaaagagaagctacctcctaactttgcctttgtacatgactgggtacacaaacagcagacatcttaaagtaaaaaatctctgtagttactttgtttgacatactgttaatcatgtattttctggtaagcctttttgtctctgattgttcaaaattgttcaatagctgaggcgtaaaagtagaataggttataaccccaagcctctgtcatatttttctttggtataggcagattgggcagttattttaatattcattc

SEQ ID NO: 24601 - DNA, 1089 bp, Homo sapiens
gcccccatatgtggtccacaagggggtgagaagctgaatagaggcagtcagaagtgattcaagaacttccctttacctttctccatgcagtcagcctttcacgctatgtaatactgagggttccatgaatgtgctgctggggggagtattgttctccacttgcctaatggattcccagggcattctctcatctccaaataaagccatcatacagccgtcagatatttaaatctgtgaaatgaaaagtgaagtcttctctccagccctcatcccactggtattgggtaatgtacacccattattgatcagcgatttaatattaactacatgaatgaaaatagacttgctatttagagtggtctgtttgaatttgacttggaggtgcttttgtagtaactagcctaaaaccatctggctgttcagatctcagtatttagtgaacagctatgcaagtagacatgtatttccatttcacagcgtgtccatgtgagttcctaagcaactcatcactcccaagatggctcagtgacacttctcccaggcggtccttctgccagagtgagaagttcagtgagagagggctctgtgcattagggaagggagagattcagacagcttcattggattaaggaattcagactgaaggggaccttttaaggggatgatcactgggatgacattttagaagacagaataatatgaaaagacaggtgggaagcctttggaagaatacagttgcagtgccttaatggatataaacatgaagtaaataaaataacgtctgtccattcatcccaaccccgggtaagggtttagaacttgggtagcagcaaagtccaggttgtgcagttaagagaacagttgatcatgaatttgggtgtcccttttcctttttttttttttttttttttggagacagaatgttgctctgttgccaaggctggagtgcagtggcacaatctcggctcactgcaacctctgcctcccggattcaagtgattcccctgcctcagcctcccgagtagctgggattacaggcatctgccactacgcccagctaatttttgtatttttaatagagatggggtt

SEQ ID NO: 24602 - DNA, 1048 bp, Homo sapiens
ttttttttttttgctttgacagttacaaacttttcttgagacagggttttgctctgttgcccaggctggagtgcagtggtgcaattgtagctcactgcagccaaacttctgggctaatgcaatcctcccacctcaggttcccgggtagttgggactacaggcatgtgccaccacacttagctcattaaaaaattttttaacatatttcactgtgttacccaggctggtctcaaatttgtggcctcaagaattcctcccaccttggcctcccaaagtactgtgattacaggcatgagccgctgtgcccggcccaaacttttaataactgagagccacccattcgtttatttctctttctctctcattgagatacagtgccacaatttttaaggtattctaagcagaggaaagaaatggtgctggtttggttttttgtgttgtcaatgaaatattaaactgcaggaggttcttaatacttaatctcatacagccctacccagtagctgactgattagacccctcttacatgttccccatagtgtctcaatattccccttcagtgtatttgttcttgttttgttatttaattttctctccagatgtaaacaggggtctcattaatccagctatctactaggttcctagcatggtgctggaaatgagaaattaaggaaagagaagtgttgccagtgtcgagttgcatcgggagagggaacgttcagtttataaagaagctatgcaggatccccattccacatgggctttgtcaaacctttcaatgtctgtgttgtaacctctgccatgatgacagagttagcacatttcatgacattgaagctgtgtttttcctctgctcaagccaacattttcccataactcggctgagcatgaaaagtggcaactgtaggtgaaagcagaaggaattaggaagtggctggtaagtccctctcatccagaagacctcagctctggagaccatgcctcccactgtgttttcctgcaggttgcaagggctgtagagggatgagagggaggcactgctgttgac

SEQ ID NO: 24603 - DNA, 1027 bp, Homo sapiens
gaaatgctcaaaacagacatgtaataaaccaagatttttccttttccatgaaggtatgagttggggaaagtatgaaatagggcaagagaaaagatgcattgaggagtcacattcataagactgtattcttcttataagtgggcagaaagctttactcctaagtttcctgatagctagtggaaagagagaaaacacatgtggaaggtggtgtttataaagacaaaaatgtccattgcccaaaatggtaccgggtctggagacgcatacctccttgtggaccccctagaggggagaagccaaggttgcagcaagccccttgctcttttcacccttgtcttctctgtagctcaaagagaaggttctgatgaattgtttgtggcatatgtttggtatctctggtccttagttcctgaacaattctgggctaatgctgtagtcaggttacagttagctttcttcttgatgttcatttaagcctataacttgatttggatcccaccaaactacctatagggccctggaccgacactgattttatttttcttttgctgattctattttaagtgtccattcaacatagaaccttcagaaggcaaggggtaaagttggatcctagcactttaggaggccaaggtgggtggattgcttgagctcaggagttcaagaccagtgtgggcaacatggcggcaccctgtctctacaaaaatataaaaaattagcaaggtgtggtacctgtagtcccagctacttagggggctgaggtgggaggatcgcttgagccttggaagttcgaggctgcagtgagccgagatagcaccactgcactccagcctgggcaagagagtgagaccctgtctcaaaaaaaaaaaaaaaaaactttgggaaggtgaagaaagagtgcagtcgtatttcagagccttgcagagcaaagcatttgatgactgagtggatgactttttaacaaggcagacttcatgaacttttagccacagataattaactccttttatgtaatgagcaccatgca

SEQ ID NO: 24604 - DNA, 1035 bp, Homo sapiens
tgagtttgttaatatcagctcgaggatcttcttaccaaacttacaaacttatttttgtctaattgaggccgattgtacaggcaagagggccgaatttctgtacaatttagttaaaatggagctcacggcttaaaatgtaagcagtggaagtaggagctctcaatcaaggaaatgaaaatattcgagatagacatgctttaccgagatatgcagcagctggaacaaagaagaaaccacaaaggctggcaactgtcagtagtcagactggtcaccaggtgtgtgtcaagcaaggagaatacagtcagtcccctgtatctatagttctacatctatggattcatccagccatggagcagaaatacccaaggaaaaaaatcgataaaaaataataagaatttaaaaatacagtctcacaactatttacattgtattaggtattataagtaatctagagattatttaaaatatataggaggatgtttgtaggttatgtgcaaatattataccattttatagtaggaacttgagcatctgaggatttcggtatcctcagggggccctggaagtgatctccagtgcatagtgaaggatgactatagctccaggtgggtggggaaaggagctctctgcatctgagctgtggggcctgtttttaaggtttctagtttctaaactccatgccctgtgctgagtttagaagaggaacttgttacagtcattctttgttatcagtgtagcacttaacatttctcttctactactgcagggacccagattctccgctcctacgtcagagaatttctctgtgatttatactgtgctttcaggatgcggtgggtcactctggtggttgttgggtgttcttttacaatgggactctgaagtagctgataaataagtggccctaatggaaaagtgctgaggcacaactctaattcactttcaaaggaagtgaaatggccttgttccagaagagggatttggcatgtctgctggagagaaatactagagaacattatacgagttgactgatag

SEQ ID NO: 24605 - DNA, 1098 bp, Homo sapiens
ttgcctcccttcctgcccctgaagttgaatctcagttaagaggaaatggcaagatttttcaagtaccattgaagagtaagattcaggttgtatagactctatgcagcactatttagtgattagaaggcaggctgctacaaacagggcagcagagaacactcagtgttagaagaatcagaataatatgtgaaggaccgtatacagaaatctcttagaagtatttgcatgttatgatccaggtaaacaaattgccttttggtgggaaaggtgttttggcatatgaggattggcaggtaaaggaagggtgatgccagacctctgttcacagcctcctcatggggctggcccctaggggattgggtgcagaagttcttcctaaggtcctttattgagcttgctacagagaatgaaattgtctgttaaccatgtagtacagtgacaggtttttttatttttattttttgacaaagattataaaaataagttggctaggtttaaagattatttcactatacagattttctttgtaaagatatttattagagtgggattggtttggacaactatatatcacatcaaaatgcatgacatggacacctctttcctttattaaaaacagacctagaagcctttaaaggtatgttttaaatcagaaagaagttgggtaatgggttctattttttacctttcaaaatactttctgagtggattatagaacactgtgtttaattttccaggaaacaagcatgattgctatccagttttcctaaaactggtcattgccctggacttattggcatggactttccataggttagaccacaactttagcaaatgttcttctttgttcagcttagagatgtctccctctgccttgccccaccaagcccaccctcaccaaaaaacggactttcctccacatcttgaaatgtgcttcttatccagatgttagatatggtgtgtgtgtgtgtgtgtgcacaacaagtgtataattaatttcgctgtagagattctagcagtgggtttattgtagcatgaaattattgctttacctttgggtttttggggccctgagtagtgtctaggattttgaaagcg

SEQ ID NO: 24606 - DNA, 1070 bp, Homo sapiens
ttatgaatatggctgcctgccccttctacctgtgccttggtgggtgcattcaccatgaggcatgtgaggagaagggtctcagtgctcaggcaggagcctagaaaatgttccaagctgtgttactgtagggaggtaagaaggtttggggaagacagtgtagtcctgttagccctccgggagattttatacaccctacttatgaagggcctagagagaagctagacgctgtccttggattaccgtacattcgatccatttaaaatccccaacaagtaattagctgagtctttctaatgggaaagatttgtgtggtagctggcaaagtgcatagaatattcacttaaatgtgtatacactgtggatatgcaccaggaggatacagaggcataggtgcatgctgtcgtgaagtcaaggtttcaggtgtttcttgctcgctgggaggatgagtaggcagggcacgtgttggattgccctttggaggatgcagcgagaggggatatgccaacacagtcaggcctggagccacccaggtggctgttgaatgaaggaatgagagaggatgatatggatagtgaggaagagaaggactgagatcttagtagggggaaatggaagggtgcaggtaggacggatggcactggtcggcagctggatgctgggtcagagcctgttgggcagccagagggttttcagaagacagatggcccaactcgacttctgtcccctgcaccttggtcccactgaagatgtccccagtgctaagaaggctttacccaggcactatgtctccctctaggctctcatttgccctcaagtcactgtatattttcttgtcctgaaagataataatctgactaagatcaacagtacttcatgttgggcttaacccataaaccaaattaggttaattttagattttcctcaatgtaataacaggaggggtttttaaaaggcaaaaacgtgtactatgtacttgcttctaagatttcttgagaattagcaaaattattttgcggtagttgtttttgtaatctaactcgtatgaatgtttgaatagatctttaattttt

SEQ ID NO: 24607 - DNA, 1072 bp, Homo sapiens
gctcctggaatttggtgcctgcctggacggaacgtcagagaacggcatgactgccctctgttacgcagcagctgctggccacatgaagctggtgtgtctgctgaccaagaagggagtgagagtaagcggcagcctgctcttttggggctggggcagggaaatggcttcatctcattgctagaattgttatttgctgggccagactctcttgtctctgaaaccacagcatacacagaaagggtcgggctccagggattggtcactttgtaatgtggcagcctcagagaggtttgttttgctcatacacagcaactctgcttaatgttgtccaggggaaggcagaattccagggagaccctggctcctagccgcatgaggagggccagcctttaaaaagcctgcaagtatcgatctagaaagcaccaagattggtttaaaatattttaaatgtttgcttttttcccctctcttcttcttatcccattttatgtccttttaaaacagtaggatgagttccatgaactcatgaagaagccatgtgcctgagctccaggaactagattgcctggaatcttcatctttccacttgccagccctagggtattgggcaagttattgagcctatatatgacttcaggcttcttatctgtaaaatgggcataacagcagtccctaccacagggctgttgagtaagcattcagtcatatatgaagtaagtatgtattgctatacaagttactctagagcgatcaacttttttttctgttttgacagtctcactctgtcactcagtctggagtgcagaggcatgatcttggctcactgcaacctccacctcccaggtttaagtgattctcctgcttcagcctccaagtagctgggactacaggcacatgccactgtgcctggttaatttttgtatttttagtacagatggggtttcaccatgttggccaggctggtcttgaactcctgacctcacatgatctgcctgccttggcctcccaaactgttgggattataggtatgagccaccacgtctggccaggagctgtcagctttaatagggtg

SEQ ID NO: 24608 - DNA, 1050 bp, Homo sapiens
cagatcacctgaggtcaggagttcgagaccagcctggccaacatggtgaaaccccatctctactaaaaatataaaaatcagccgggcttgggggctcgtgcctgtaatcccagctacttgggaggctgaggcaggagaatccctgaacctgggaggtggaggttacagtgagccaagattgcaccactgcactccagcctgggcaacagagcaagatcctgtctcaaaaaaaaaaaaaaaaagggggaatttagtaacagcaaatgttgtggtggttgggtggggggtgggtattgtgtttgttacaaatttttaaataagctgcatttaaaaaatgaaatttggactaagcatttgcggaaactttggcctcttcataactctggtcaggctcaactctttagctttctgcaggggaaaactgaagctcacagaccttgaggatttgccaaggtcatacatagcaactgggactagatcatatcttcaggtgtcttgtcttgtgttacatcctggaccttgggactccagagctgagcagtctctcacctgctgagaaccatggtgcacaggccccctgtgccctccactagggtgactcactgaacacacatgttggtaccagcactgacttctcatgaggaccttggctcggcttaccagctacctccttggagagctgcaagggactatgtcccagtgcatgtgaaggactgttctaccacagagaactgaagttgttacgcctcttggaaaaatattgtagcatcaggtgtcagagcatcttgacagctggcagatgcctgctccctctggtgctcagataaggcctggggagctgggaatcagctcctgacttgttacctcctctggtccaccaccgctttagtgctgtctgctgcaaacatagattaagaggcttgaggacatccaacaggacagagccctttaaatgcatttttctggagaaatgtggtggcctcctttctgaaaagaaacaggccatcatctgggtggtgaggaatagggcgtggaacattcggaatcagc

SEQ ID NO: 24609 - DNA, 1030 bp, Homo sapiens
ttacattttcctacaaaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacg

SEQ ID NO: 24610 - DNA, 1071 bp, Homo sapiens
agtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctt

SEQ ID NO: 24611 - DNA, 1102 bp, Homo sapiens
tgggggaggggaggaaacgaagaggcctggggacgcggaggccgcttcctctcaggatgaggtggagaagcttggtccggggccaccggggccaaggggccacagcgcaggcctcccttgccaggggcctttggtcgggtggtggagtttgtggcgggtgcaggggacagattgtgtgtcttcctcagggacgtgtggcgggtgacgggaagaagcctgagccctcctttggcgcggggcggcctcctcttgggccgtggggcggggggtcttcggagccctgcgggccgcgggtgtcgcgcgtgagctcgccggtgagcgcggggcaaaggcgggcagggctccggctcggccagcccggcctcgagtcgaagtgacttcggtagccccttagattcggccaagattgtcttattggtaacgtcagtttttgaatatcgtgacgccctgagagttatttttgtgttgtggtgaattgtgggttctgcaactcgaagtaggtgattgtattaaaaatggacctgttggcctaagaagtaaaaatatagaaggcgccgggagtaggaaactccctcattttggtgaaactgcgtattgaagatgtgtgtccaccccctcaccccaaaatgctgcacttaatactttttctcaagtaccaaagtaaatatattgggaaagtctatctgggtaataaattcgtcacgactaatgttgtttgttactattagttaaatgtgtgaaaactgaaatttggcgaggttttctcccccattttgtaggattgattagctatttttctgattacatgttattttaaatctccacctttctgtccagaaccaagatgtaggattaaagatgaattttcgatttaaaaatccaatagtatacagttattaagaaggcacacatgtagtgtaactagatcttttacttgaggtagcaaaaagtttgtttgagaaatgaggtcagtataatatttttatttaacagctctacagcattttgggagacaggactggtgcatgaggcagtagcaccagactcagaagacctgggtttgagtcttgatttttgccatagttatttaagttcacgagat

SEQ ID NO: 24612 - DNA, 1100 bp, Homo sapiens
aatttttagtccgctccatacccaccttacacaactcttttatctgctctatgttcaagaatcgtctacattttgacattttattgtaggaaaataattttataatgcaaaatctgtcaaatatcttaaaacttttttagataatttgtaatttgttgtagtcaaattacaaattatggagagcttcacattacaagaatgagcttgacatggcatctgccctccacaactcactgtttagtcatcagactaatgtataaacaactattattatcttaatatgactgtacagtggttctgtgggagcataggggaggggtgcttaatcttggaaattttacaggatttatttatttattgcctgaactaagatgtgaaggctcactaggactttgataaagaaactgcaaagtcatgatattatggtttgttttaggaattcatgatttgttcctgtagctgaaacatacattgaatggtaagttagagcccgacataaaagactttctgtactgtactagaaaattagtgtctgggtgtggtggctcactcctgtaatcccgtcactttgggaggccaaggtgggaggatcgcttaaggctgggagttcagccaggccacaaagaccccatctctacgggcatggtggtgcgggtgtagtggtgcgcactgctactactagctacttgggctgctgaggcagaacgatcattttgagctcacgagttgcagagactgcagtgaggtatgatagagctccactgcactccagcctgcaccacagagtgagaccctgtctctaaaaaaataaaaataaagttagtgctctatgctgcggaatggagagctattgtgttccttaacaaaataaaaataatttttagataatctttgctgatacatccttctgttaccacagataattaagtgccagtaataaagaacaatgggacatgaatgaatgaaatgcacagcgttgcattagactttacttttaaacaacaaattaactaatgaagcttttaactgttaaataagtgaatcaactgatcacattagaatgattacaatttaaaaagaatcggattttgagttcctac

SEQ ID NO: 24613 - DNA, 1516 bp, Homo sapiens
ggtactattaataattattctgggataataagcataaattagaatttttcagcacataaactgggactgttctgggcaagtggggaaatatggtcatcctgcttctaaggaaaagagcagtccttttccttaccctttaccccatctctagtcccactttgcaaaggcagtgcccctctgctatttagctatttcttttaggacttacatactttcatttttctaaacagtgtgcttatactgttatttcatggtttttcattgtttcctaccattcttatttccactgcccacttccatctcacaatatgtagcaaattgattcagtagtctatatttacattattaagactatgtaaatattaaagagctcacctaataacaatcatgcctttcatgaacagctaagtttttccaagttaaaaaattaatttttaaaattgccttttcttctatatacacagttttttcaagttgtaccaccatctctaccacatgccaatgagatgtagtttccatgtgatgctttttcttttcttacaacttctgctacctgaggtcctgctccagtccgaattgtttgcttgccatgctttctgcatagcatcccccttaagttcccctttatcgctgcttcctgggtttcatatcttgttatttcctgcctcacactcccatttttctaggacacgctgttcatttagcttcctctggtagtgtttttggtcgttgtgttttgttgagaccttgcatgtctgaaaacatgttctgttctccacttcaaatgtacttgctagattggaattcaaggctaaacatttttctcagtattataagcattatttcattgtcttaagactttattgttgctgttaagctgttctgattacgttctctttgtatgtgacccattttttccactctagtaacttataggatcttcccattacttctggttttctgcagtttcaagatggtatattgtgcttagtgttggtcttttttctttgatgctcttatgtagtcttgagccctttcaatttggagagttctgtccttcgtttctagaaaagtttatttggtaattttctctatatttttctgtaaccacagtcaaattataactctctagataattattttcatgttacatttgctatttcttttggttctgctttccaggaggtttctgcaacttactcccagtccttatgttgaatttatttcagtatatctcattttaacaagtatatggcattttgaatttccataagctctttataatgctgtctttgtattctcacacatcctgttcttattttatgaatgaattttttttatactttaagttctagggtacacgtgcacaacatgcagatttgttacatatgtatacatgtgccatgttggtgtgctgcacccattaactcgtcatttgcaatagatatttctcttaatgccatccttccccctccccctaccctaaaacaggccccagtgtgtgatgttccctgcc

SEQ ID NO: 24614 - DNA, 1033 bp, Homo sapiens
aatccttgcctcagaatattttaaaagctttttaaggctgggcacggtggctcatgcctgtaatcccagcactttgggaggccgaggcgggcagatcacgaagtcaggagatcgagaccatcctggttaacatggtgaaaccccgtctctactaaaaatacaaaaaaattagctgggcgtggtggcgggagcctgtagtcccagctccttgggaggctgaggcgggacaatggcgtgaacccaggaggtggagcttccagtgagccgagatcgtgccacttcactctagcctgggcaacagagtgagactccgtctcagaaaaaaaaagctttttaaattatagtagtaacgtgcttatagtagcactgttacaactcccaagtggaaacaatctagcgtacattcatggtagaatgggaaaataaattgtgtgccatatggtggaatgctatgtaaagaaattagagtgaactgaagactgcatgcaacaacacagatgaatctcacaaatatagtgttgagcaaatgaagttggacacaaaagagtacttattgtatgattccgtttatacgtatttaataatcaggcataggtaatcattactttcgtcgtgggtttagaaatgtttagtgaggaaaacttggaaattattaatctataaagtggaaagcactcagttccacaaaataacattttgtttttttcttagaagttttattcattttatttgcataaatagaatcatactgtatgtgtagttttatagattgacctttttacttaaaatgttactttccaatagtaccataaacaatctttgaaaacattttgagaaacactttattagctgtgtgatcatgtgcaaattgcttaacctctcagtgcctgttttcttatttataaagtggagataatatagtacctgtctcacagggttggtctggagagtcagtgaactaacagataatcagaaggtctttactgtcagaccttgcatataatacttaataaatatcagctattgctattat

SEQ ID NO: 24615 - DNA, 1047 bp, Homo sapiens
agttcttcattccacttttaccatgtttgtttgcttccttttatggacgataggaaacctttgatgaacttctgctttgcggaagagaagtggtgatcatttcacaatttacgttgtcagatatggttaatttgtatggttaattttttatttgagctgatgattaaggaggattaagcattaaaggctttcatattttcccaaaggcaattaatgaaaatttttatttcacagaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcaggtaacatttttatttggaatatatgtatacagcctttttcaaaatccctagggccactcttttgggggtatttaaaaaatgtgttagctggatctgaggcatcctgtaatcaaaaccaatatatatgtagcaaaatgaataacatttttcaaactttttggacttcagaattatggataacagattgtaacctcatataaaatcatacttttgcgctgggaacggtggctcacgcctgtaatcccagcactttggcaggctgagactggcagatcatttgaggtcaggagttcgagaccagcctggccaacatgacgaaaccccgtctcgactaaaaatacaaaaaaattagctggacatggtggcacacacctgtaatcccagctacttgggaggccgaagagggaggattgcttgaacccaggaggtggaggttgcagtgagctgagatcatgagactgcactccagcctgggtgacagagtgagactccatctcaaaaaaaaaaaaatgctttccaaagacttggaaaaccttgtacgtaaaaacataagtataaatttaactaaactggtcaatcaatgtgaatggctttgtcagaggaacaaaaactgtacctcctttccctctaagatcacactgattca

SEQ ID NO: 24616 - DNA, 1031 bp, Homo sapiens
acaaggaactacagagccccaaagaggttgtcacagccctggttcagggagctcctaggtctggactccccaaagggtcagagctcttccgtccttgtcgccggcagcatggtgagtggggggtaggaagggatgtttcagcactgtttgtgttacagctcttcgagtcccaccatttggcgggtcccgagttcttgtcccacgtccagagagaatgaggtacacagacagttggagggttagcaaggcgaagaggggctttattgagcagtagcacagctctcaggagacccaaagtgggtggctcctttccacaggcaggtcatcccaacgagtgtgtagctttcagtggagaggagaccagacaggagtgggtagctcctgtccatagggaagtcagcctgacatctggctgagtcagattttcatgggcttcagagaagaggaagtgcatgctgattggtccatgggaggcaatgggtgggcctgggataagcaccataagttctcactccggtccgtggaactggcagcccagcctccaggcttcaggccatcccaggcttaaaggtagggtttcactagggacctgccccttttcacccaggagcatgtctgcctcctgctactgttcatggcacccaggctgtttgtgccaagggatgcctgcagacccatgccaagccaccctcagttcccccttggcttccctttgtgcttgttggtgcccaaagtccagacgggggccaaggtagcagtgggctggtgtgtcggcactgccccaagcatgcgcatacacacctggatcgtgacagtgcccaagcttggccaaaactttgctccaaaatcggagcaggaggcgggggcgggaagggaggcttctcaggcccctgagagcacagggatacccaagtctacagccacagctgggtcagggagcacagggctcccaccccaccaacttggaagtggtcagggctcccacctgttgctgactctgtggagcgcacagaccctgccacgcctcccct

SEQ ID NO: 24617 - DNA, 1022 bp, Homo sapiens
gaaaagtgttttatgaagacattataaaactaagctttatttgtaatttaatttttaccaggttcttcattagaagctgtaaccacctgtgaactatgtaaagagaagttggagcttaacctggaggattttgatattcatgaactacatagagctcatgcaaatgaacaagttagtatattttgcctaatttggtaagtgtctattctatgcttcaaggacagctcttgaagaaaagattaaatcatggtcagaaaccttgcattaaaataataataataacagtgataatgttcttaacataattctgttactgcattaggtgttagaatttcataatttttttttttttatttttcccttaagcttaggaaagttgttccaaaatagggatgccaaccttatttccccatagctgtaagttttttgagatgcataaatgatacagtttagaatgaagagctcaataatttcctcctttttctttactgaaggaaaattcgggaggtggggcagatgtgtatttaaggagattacaagggtgactttagagccaaattgttgaagtgtggttagcatatttgtttaaaaaaaacaaacaaagatatgctgtaaaaggaatgcatgaagtgcttgaaaaacactttttggccaggtactacaatggctcacacttatacctagcactttgggaggctaagacgggatgactgtttgaggccaggagtttgagaccagcctcagcaacatagcaagacccggtctctacaaaacagaaaacaaaaacactttttaaatgtaggggtaatgggcctcccctcttttattatattgaatgagatttacaaaacataaaaaccattttgtgcagccgccatctctgtttagttccaaaacattttcatcactccaaaagaaaaccctctacccattaaacagttgctccccattctgtgctctcagcccctggcaactaccagtctgtgttgttttatggatttacttatcctggatatttcata

SEQ ID NO: 24618 - DNA, 1126 bp, Homo sapiens
aagaacatagagttcttaacgtctgatgaaccagttgcccaattcagtttgtaaatagttcactgtaaaaattacaggacagattagattattaataatactatatttatgatttgtattcatggcttgaaaacaactgtggggggaaaagagaaacttttaatctgaggaatatgagcccctttaaattgtcaggttcagagaggtatttaaaatgtaacagcattctcatctcactctcccttgagctaaatacgccacttgctttggggcctctagactaactagtgccaagtagctataaaatgtcatataccctatagttcaatagtgtatagccaatcactaaccaatgttatttctgtaaaccaatgttgagaattcagaatgaacaacttttgttatctctcccttcctgatttgtccttttttctttaaaaatttgagcctttcttttgttctctggagcactctccccaaggcagcttggaagtgggagcctggcagcagtcctgaaccttgactaaaataaactctgttaaatttcgtctcagtttcttccttttaggttaacacaacagaacagttttgaattgaagaactgtttttaccaactacaaatttctgtgtgaatgattaatctcttacctttattaattcattcttttatttatgcctttatgttcatcatattacacagaaaaacacttgagctatcagaatagattttagttacagcagtatattggcatagctatagatgaaatgtaatttttaactaaatatatatagctatagccatttgtataatgaaatctatgagctttatagaaaaccaaagcattcattccaccatcaaattatttaaaagttccatttttatataaagtcattacactaaagaagactatgtgagaataaaaagtaaaattttatgaaattataaagatattctttttttctcaataaatggcattgtgtcccttattaggaactggatatgaatacatttcctctagtttatcagtgtactgtgagtatcaatctcaattctactaatttttcattctctgtatttttcttttctcctgtttgcttccctgttgaaggctgagtatgagtttat

SEQ ID NO: 24619 - DNA, 1022 bp, Homo sapiens
tgttgacatcttatttcctttgggaagcttttattttttaaatgtttcttaaaaataaagataccgtagatttaatggaaattgctgtcttctataacaagcagcctgattttctcataaagttattttagagaaagaagtaattttctagctctcaaaggtaattggaatgtatttcattgaaaaacagaattggaaacatcgagggaaaatgggctttttattattaaaacaaaacctcagtattatcacttagaaacctgaaattgaactccaaaagccaaagagtatgggaaattaacttcaatttatttgttactgttctacaaaagattaccagtgtactaatttttaagtgtccatattacaaagtattttagatatggaatagttggttgtttactgtgtgtgctattagccataatacaacattttggccagctgtatgttaggtatttataagtaaatgatgctctttgtgtcagtgtaccagaggaaactttatgctttgctgtctgggccattttgtgtagcaagggctagggtctctatgtatctgccattattgtagcattctgaacacttcatgtcttgaaatgtgttcataagtatatccttcaaactttcttacatgttaacttcggtgataaaagtgtagtagagttcatgtaatgtttttattttgaaaattatcaaataactgcaattcaatgtatgtaatactccttctaaattagtaaaaaatttttctttattttatcatgtggacattattccagtgagctggttaacagataattaccattgaagagcattcatattatctatcaagagcattcagaatttgagcaaagatctcttgacttctaagtactttacaaattgtgagcccctaaaaccttaataccgtaaaatgatttctaaaaaggtaccttaagtcttcaggatgaataaaccatataaaacatttaagaacttctgaattcatgtgtttttaaaagttcatattaacaagttttaca

SEQ ID NO: 24620 - DNA, 1046 bp, Homo sapiens
ttagaaattgggtccaaacacctttttgtactgaagaaaaagaaactttggtcccaaaagatttagtggcccttaactaagggtcagtcagtaatagaacaaagcaagggactagatggatttccagttcgaggctcttatttgtctcagatctaaaggtacaggtgtggtttatattgacaatttttcatgacatgcagctttttaaggcagtgatagatagcttagccgcttagctacttaaaacctctaacttctgtattagtttattatagtatattatagtccctgtgactacctatacttactttttctttcctctttgcatatttatttttaatctcatgtattttttgtaagtagccttagtatgttttcgaatgaagcagtgtctaaaatactcaaaatgatgctttttattaatgctaactgcttatgtttccatagtgtctatgtctgggccaagatcctagcaacattaattatcgtaacaggatttcaactttttcatctatcagaggtagcagtagaaactaacttcctaagtggaatgcataaagaattgccatttcttcagtttttcagaaagtaatgacattgttatccaaaaccctggaattgtttttattgagcctggtaaattacttaaaatgtatttagtatcttaaaatgaaagactttggctgaaagattacttgcatgtgggtattaaaaaaaagttgtgatttatgatcagttgatttttggcaagggtgccagggctattcatgggaaaagaatagccctttcaacaaataatgccaggacaattggctaacctcatgcaaaagaatgaatctggacccctacctcacaccttatacaacattaactcagtatggatcaaagactttaatataaattataaactacttaaaaagaaacaattgaaaatcttcatgaccctggattaggcaacagttccttagatatgacagcaatagtacaaacaacaaaagaaaaaataggtaaattggactgtattaaaattaaagacattgtgtgtc

SEQ ID NO: 24621 - DNA, 1045 bp, Homo sapiens
tagttttgatattataactgtggtacagttatatgttatgtttatttaaatgaacacttgcaggatatgggaaagtggactttcacatatactatactatatggtagaactctaagtttataaaacttcctaaaaagcaatttgccagtaaatagcagcaaaagcttttgaaaacatctatgccttttgaaccaaaaactcaagtcctaagactatatcataagaaaatatttgttcaggtactcaaaaatatatatgcgaggatgtgtatcacagtataatgtctaatcatggaaagctagaaacaaatattcagtagttacactgatctatatgaatagctatgtagccaagaaaagtgatgataataggtattaacttgtaagaatatgtggacgatatatagcaaaatgaacaaagcaggatacataaataagtgtttttttcatttatgcagaaaaaggtgattcttgtgtgaagttatatgtataggaaaagaagaattctgatagaatatataaaccaaaatattaactggaataattcacaggtgataaaaatttgggtagcatttactttttattctttttggctgtctgcattttctaattttcccataataagcatggagtcataatacaaataattatcttaaataagaaacgcatacctgaaaatgtgaatataaaagttgaattgttgctgacagatgcaaagagcatatttctagttttctaaattctgcatattttacatactgctggcttttggagagcaggggttttgtgtgtttgtttagtgggaaggaaaaaatataaatggacaacttgtcaaagtaactattacctaaagaattttctaaaactcctaccttaaaatgtattctctttatggttttgagtttgtattattttttgctttttcaggtggtaccaaaaataagggttttctgctaatgtccaagaggtttttgtcttgcagataacaattatggctgtgttcctctgcttgaagacagtgaaacaagaaagaataatttgactct

SEQ ID NO: 24622 - DNA, 1070 bp, Homo sapiens
agatatttacaagttctaggagtttgaactttgggtcaagatgttgattccttttaatgtgcgagggtgaaggaggttttattttgctttattcttttggatattatgagatgagattgtatccagtcttggctgtaacctataccataaatgcagagctgcaaccattatttctgtctctttctccttttatcacctacacttctagagatattactttcagttttattgcaaatcatctgtgtctttagtttaaaccattatttttcatataccccaggcacatttcccttataatgagacaaattttagattattaatgttccacctaaaaggatactgtacacttttcattgccaatatgggctttgaagcttaaatatcaacatttttataggaaatttacccatgtcaaatttaaatatatttgcttatatttcttggaaaaaagattttggataactatcaattaagcagccaattccatttggggtgcagaaaattttgagccccttgataagaaggaacaaaatttttcctctaaataaccaactctggatcagaaaaactgaacttttctaaatatttattattaacaaaacttttttttgtctgattccactagaagcattctatgttgtgaacactataaagttatcctatgttgtgaacaccataaagttatgagggaaaaaatgtcaaatctaaattttatttagaagtaacatattgtttttctggacttgcaatccaattcgaatgcatcgttagacttttctgttttcttatgattaaacaacaatggcttaaaatgatagcaagtcaactgaaaagttgctttggaataaaacaaaagtgggaatgccaactttcttttcttctctataacttcattaacatggttgtatagacatttgcatgtaaaatgtagctaacaaaaattacacagaagtaaatttagtcctctagtgcctacctctatggtgaaatcagaccatttggcatagtttgaagtcttccaagaagcctggtttccacctggaaaataaattactaaatttgaatgtgtt

SEQ ID NO: 24623 - DNA, 1048 bp, Homo sapiens
cactgagctagttatattttctaagtctcagtttcctcagtgtcaaatacaataattgtgaagactcaattatatagatgataaggcagattagctcctacccctatcattctttcttttaaaggattttctgactattctctaccattttttcctccagatgaatggattttagattccatcacatatgttcatctttttaataagtgaggaaaatatcttctcagtcatactacttttagactgatgagcaagttgttccagagccttaccaagaggaggttcaggaatgacttggaacctgtaataatcaacatattttttgtttattcaaaaaattcaaaactatgctgcaccaatttgcaaatgatattgaataaattggggtggttagtatcctggaaaaataaactaaaatttaaattaggataatgatcatatttttaaaatgaggctcaaaagaagcaaatgtgaggtgtacacataaacaataacatatagaattgtgcaggaatgtctaggcaaaaagcacagagaaaaaagacttgagggtctatctagagtacacgaacggtccccaatgcggatgaaaaagagttttcatgatttatgaaatatcccaaacaggcaggaaaccatttttcctctgtttcatgtataaattatacttttatatatatatataaaagtatatatatatatatttttttatttttatttttttgagatggagtctggctttgttgcccaggctggagtgcagtgccgtgatctcagtgcactgcaacctctgcctcccgggttcaagtgattctcctgcttcagcctcctgagtagctgggattacagttgcgcaccactatgcccggctaatttttgtatttttagtagagacgggttttcaccatgttggccaggctggtatcaaactcctgacttcaagtgatcctcccacctcagcttcccaaagtgctgggattacaagcgtgagccaccgcacctggccctaattatactttcatttgaaaattatttcctgctttgaacc

SEQ ID NO: 24624 - DNA, 1024 bp, Homo sapiens
tttttgtgttttcagtagagacggggttttgccatgttggccaggctggtcttgaacccctgacctcaagtgatctgcccccctcggcctcccagagtgctgggattacaggcatgagccactgcacctggccaaaaattgatttattttaaatccagcatggacatgatctagcaatatcaggttctaatcagacataaagtgagaaagaaaaagtggaaagtaatcaacttttgaaagtactgataccttttttgtactatttttaccagttaggattctaaatattattgtatgtatgacattatgttaggtataaacactttattcatattgtctgataatattttccataaagttaattatatcatgaatgagcttttgagtcttctactttttgatagctgtaaaaacttggtttagatccatcgacctttttattgcttttatttctaagaattgaaagtgttcccttttatgttaagtataacacattcactttgtgagtctttctgctaaattctgcgaaatgcaagtccctatctccagtgtgatttagtaatgtgaaatatgcccagcattttgaaacccagtaagtggcaaactatgtgaggaagaaggatctgtgttggtagccatgctcaggatggggttgccaatgacagtagctagtgtttattatatgcttactatatgataagcattgtgttaaatgtttttttttgtgtccattgtttttgttaatctaaacggctctgtgagatagatctccattttgcagatgaggaaactgaggaggagagaggtaatttactcaaggacagggaacttgtaagtgtcagagccagtatttgaatctggcactctgactgtagagtcatagtacttgactctcatgtaccaggcaaaatagtcattagtcatcgccatttaccatctaggtccagtagaccataaaaggatagtgaaaaaacaactgtattagaaatgttagtaaagcttaaacatagcaaatacaaatttt

SEQ ID NO: 24625 - DNA, 1050 bp, Homo sapiens
cgatctgtgcagtcatacattgagttaatactaattaacaaaagaaatgactatgtgtatttctcttcctaagacttttatatatgcaatgtattgttttatgaccaaatattagaaatatttttatagtcccttttaaaatctctttagtttccagctttcccacatttccttactgctatcagtgacttcatctttcttcaaagtaatctgtgtttactataagaagcagtttttgtttcagacttcatgaaattttcagtgttttagaagaactttcataagaactgtttgattaggtctatcatggtttatgacttttataaagttgaaatctttttgtgattctgtattgcattcttggatggatttcagttgtttttcgtttacttttgttagttttgatgatttctcatgtttctttgttgtcagcctatttcttcatgattcttcatttttataacacctgtataactcattctctcaagaggcctaagcctctttgaacttgatcctgaacctgtttccattcttttgtaaacattctagagagcttctagaatttctctaatttattctgaaattagtagtaatagtgttcaggcatgtgaaaatgtgagaagtgagcagaggtggtatgtagatagtgcagatttacctgcaaattataggtgaagatgttgccttagaattcttaaggaaagttgtatcaaatttaaatataaaaataactttccttaagcatagatacaataaattacccatcttggaaatccatgctggaaaacccctggacatgaaataatggttttactgaccacaaattgagctacattatatgtcaatggcgacttcaaagctttatatcaagtgaaaaacttaatgttttttcagtaaccttattggtttctgattaatcagccattgtgtccttagtttgtactcttttttgaagttaaaaatctgcttaagaatcatttcatctcaattagatgataaactctaatttgtggaactcttatttttatggtatctcccttatcctatact

SEQ ID NO: 24626 - DNA, 1049 bp, Homo sapiens
gagattattgtattaaaaacatatgttgccataatttggctacttcgttgtctttataacaactccacctaggtcttggcatctaaacgatttccaaaagcagtggaaacagagcccaagagatgagaatagccaaagcatattctgtactttttaaaaattttgatttctccctgggttcattttagctttggaaatagtcaatataagcttgaaagtagatggaacttaagcaaaatgtcagtggcatttagtaacttgtcttcagttttaatttgttaagtcaatattttgagtttctgtgtatcaggtattatatactataacgaattccaagacgaacaagaatatcaatgcctaatccagagccttacattataatagacacacaagcaatcatgttttaagtgcctagtacacattaactactttgaatcagtgaaagctaatgctcattgtaaataacgtgatttgtaagtacagtggaggttagtttaacttcttttgggaaaaattagaccaacttgggaaaaatgggaaaaatgagactaaggagatgatgtttgagctgagttttgaaatatgtgtcaaggcatattcaaaaggctagagaatagatacataagaaaatactgggaaaagaagttggtaaaggagtctgaagttggttatgaaaggtgttgaatgccatacttggtgatttttacttttttcccctaggtgttgtagtttcatgaagattttctttctttcttttttttttttttgaagtatgaagattttttttttctttccagtagacttgtgaggtaatttgatctgtgtttttgaaaagtaattctagtggtagtttggagaacaggtaaaggggaagagattaaaggcaaagtcatcaattacatgaatatttgtgactttcaaccttccaggcatataacaggattatatttttctgtcatctttgaagttagccttgccatgattttgctttgaccaatggaatgtgattggttaataggtcacttttaggtgaaagctttaagaatcag

SEQ ID NO: 24627 - DNA, 1056 bp, Homo sapiens
actgctgtgttcagttgttggcagggagctgcccaggagaagtatgacctggtgtgaatgcccagtagagccaaaggtgtaaaagctggaggttgtgagtcagtcatgcgctccacagcaggttctgttgaaagatctgagctgggcaactccatcagtgccacagttagtaacactgaaaactacagtggcagaaacatatatattattttattaccaagtctatgaggcatcgtcattcatgagcaaatggagaaattgaagggttaaataacttgttagaggtcccttagctagtaagtgatagacccagaattctaacttaggcaggattgactccagagtgcctcaagcatttaaacctctacaccatactgactacatgcatatgttgaaaagttttctgtgaaactttatttttattataacttaagtaaattcttttcccagtgtttcatgaatctaaaaatgtctaattaccttttaccatactagtttctaaagatcgatttgttttcattaaagcatatacgttcaaaacttgtggatttactctttgaattttgatgcatgtcttcacttgtcaaaaaaagtaaattatgcaagttacaccccatcccccttttctcccaatatactgaagttgtactacagatctttagctacagtaagcaattctccgaggatgaagaaagaaaatgtacatacacataggaatttcttttccagagctaaaattgacattttataaataatttccgtgttgcaaacttgagactaagaaatcacagcaattcagtgatatgcatttggcatgagtcagttttagttcttagtgattttcattggaaatggcataaaaagtaagatttctctgaattttttatgctgtgggcttacaagagacataagatgtttttctcttatagatgtctggcagtgcatggcagcagaagtaacgaaatggtcacaaaccccagcagtacttcccaggtcacatgcactcttaatttttaaagaatctagaaacaacctaagcagttgataacaggtcat

SEQ ID NO: 24628 - DNA, 1048 bp, Homo sapiens
tttcctggttttacagctagtctataagctctgtgaattcagatattgtctcattttatctttagtacactgccagataaatggtagatgctcaataagtatttattaaatgaatgaaattatgctatacttgtatttttctaccaaaaatgtaactttattaagtggccaatcataagcactgttattaactaatattaacataatataaactaaaatttaaggaaatgcaatgtcctctaaggggcacctttcttcctaatcttcaactgttctctatcatggcaccctttgcccctctcccttccttgaggctaactggataaaatataacctcctacgtcattgatcatttccttccacctgcctccagtattctcggagtcataaccttttcatgacagagtatggcgctgatgacaatttgctgtttccagcttgttaaaagagatgagtgatttattttcttagtgcactgagtcttgcatctctttcagttattttccttgtcctcttgccttcacatcatacctttgaacttctgaagtctctttttacttccatggccatacattcccgtggttcccctgactttttggcaactacacactctgctgcctttgctatgagcatttccaagattcagcccttgcctttctgctcttctgtttttatacctttctttaaaagtctgttttcatagtttagcaatgccaacaactttgaaatctcttcatttcctctcatttgaaatgtattatcatctccactgtctgagacctttccagttacatgttcattacttcagatgctgctgttcaagagtaagcaatattgtctaccctactttctactttttcatgacagttccctctaccaatttggttataactgacactcatttttctaggcatcgtgtaggtttgaaactttggactcatctctcttgctcttcttccacatccagccattctcccatggtttttccctttccctgttactactaagtatcacatgatgtgttcctccctaatgcattctttatact

SEQ ID NO: 24629 - DNA, 1023 bp, Homo sapiens
ctgggaatttggaggtgggttcgaaaaagtgagtaacaataaacagttaactttactgcctcatatttagattgctggtatttatgcagctttgaccaggacctggtaacagatgtggatggacttgaaccaccaactcagcttagaaggaagccaagacttaaagtttcctagatcccagcttgtaagttccctatattctttaatatacaactttcctttaataaaacaaaacaaaaaaatcccccaacaacttatttttgatatagctgccattcttttcttggattcaatacagcaagttttggctggagcagctaggaacttaattagcaactaatgtaccaacttgtagtaaacatcaacatttgtctatgtcatgagagaaaaaaaacatattcacactgaaaaatggcagcttcattttggtacagaagccacataaatgtgagtccttaaggttactactcattctgaaggcattctgtagccacatgtgactgtgggtggtaggcacatacgcaccataactagaatctcatggtccagaattatataaaggatggagagatcatttaggttatcaaagagacatatttaggaaaaataatctgttagcaaagtacattcaataaagtctgtgtaggccaggaaaacctgatagtgctttgaacaggataatagaagtacagagtcttggtgagtgtttactaggggcatacaaaatatccaaatgagcactttatggtaacatgtcttattttattctctaattatcttatgtagcaaggctttttctacccctgaaggattgtaagctgcttgaagaagggatatatttacatagtaactagtacactactcacaactggtgggctcttgatgacatctctcctgggagttgtatttgagttgaccatagcagctggcataatgttaaatacactgaaagttgaagtaaatgaaaccttgggcttgcaggtaggcctgatttatactgttcttttctgtttcttcacagaa

SEQ ID NO: 24630 - DNA, 1005 bp, Homo sapiens
ttctgtggtatgatattttgtaatatgcctttgttgtcagtaattatctctagaattttgtagttaattatagagtaatgtttcaaagaatgcatatgtcttgattggcctagaacagtcaattgacattttaatatgcttttatacaactgcacattaaattaggtcataattatttttaaacaggatggtgaagtggatgctgaagaacttcagagatgtttgacacagtctggaattaatggaacttactctcgtgagatcttttttccccttttgttgaaattataataggaagtttattttcttactttttttgtccctgtaattaaaatgtttaaaaaattatcacagttatacatgcacatagtttaaggagtcaaataactgtaaaactcgttatgaaaataactgttcattgtgtattcctgtctccttaacattaactgctcatagaggacacttcttttgacttttaaaaatctgattcttttgaaatttgcttccagatttcaagatagaatatttttttcacgattgatttttggattttatgattatctattgatatcctgctatgaaagatgaggatttcactttattttaaccttaaactctcccctgtctctgcactccacagaggaacatttcccatcctcctgtccttccaatgtagttataatatatagtaacttttgttaggtatgttagtctttaccttatttttactatctgaatgctgcttatagctgtatcttatgataatgtatgattacttttcctttttatataatgttttgcttttcttgaaatcactagttgtcaggtattatcctagaactctgggatatgcagttttttatgtgtagctgtcatactgggattctttcaccatcattctgaagctggtttccccgtttctcttgagttagatctcctttttactccatctcttgttgtcctcttttaaaaaattcattatcttattttagtgaaatgtatagt

SEQ ID NO: 24631 - DNA, 1050 bp, Homo sapiens
atactgaggcctgtaagaggcgggggatcggggaaagggaacatcaggcagaatagctaatgaatgctgggattaatacctaggagacagaatgatctctgcagcaaaccaccatggcacacatttacctgtgtaacaaacctgcacattctgcacatgtacccctgaacttaaaataaaaattgaagaaaaaaaggctgtggtgtgttgcaggctaagagaagaggtatttcaaaaggaggacttgagtgataggaggtcatatcttgatggtcttctatgttcttgaaattcagtcttttggagttggggatatagcaaattgttttaagtatgaaattgtattttggtgtccagagcacacagacatgggctgtgttagtattagtgatgtcttaaagaagagaaataaatttaaaagatatagggtctatttatttgactgaagagacaaaagcacatttagaaagactattctatatctctctttttttttttactatttacttaggttttataactttatttaaattgttagtggctgtgattctttttttttctttgatgagcttctttttattattattattattatactttaagttttagggtacatgtgcacaatgtgcaggttagttacatatgtattcatgtgccatgctggtgtgctgcacccattaactcgtcatttagcattaggtatatctcctaatgctatccctcccccctccccccaccccacaacagtccccggagtgtgatgttccccttcctgtgtccatgtgttctcactgttcaattcccatctatgagtgagaacatgcagcgtttggctttttgtccttgcgatagtttactgagaatgatgatttccaatttcatccatgtccctacaaaggacatggactcatcattttttatggctgcacaatattccatggtgtatatgtgccacatttccttaatccggtctgtcattgttggacatttgggttggttccaagtctttgctattgtgaatagtgccgcaataaacatacgtgtgcatgt

SEQ ID NO: 24632 - DNA, 1102 bp, Homo sapiens
gggtttcccaatccggcttgaatgcctgagtttatatcctgatcattgtccctccccctgtgcatttaggtgatagatgatttgactatttcttttttcaccgaattggtattttagtgagctctctttactacctaatgggtcgggtgtgagctgagttacaagcctcgtgtttaaaggtgggtgtggtcatcttccccagctaggcttaggaattcttagttggcctaggaaatccagctagtcctgtctctcactagtaggattagaattcgaccttatcattaaaaatgagataaggagagggtattagtccgatctcatgctgctaggaagaaatacccaagactgggtaatttataaagaaaagagatttaattgactcacagttccacatggctggggaggcctcaggaaacttacaatcatggcggaagggacctctttacagggcggcaggagagagatgtgccagcagaggaaatgccagacacttataaaactattagatctcgtaagaactcactcactatcacaagaacagcatgggggaaaccaccccaggattcaatcacttcccatcaggtccctcccatgacatgtggggattatgaggattacaattcaagataagatttgggtggggacaaaaagcctaaccatttcagggagaatatgacaattcctgatatggagaataagaaacatgtatcactggggtaaataaaatagtaaggagaaaggagtttttggaatcaaataaaggtagattctgattagttttattatcatttctcattactttttagtttataatattgtcttttattacatgctttccttctgttaactttgggggtaccacgggcctattgctagacaaacagtagcaaaggtgcacaatttgcaaagatgtaaaatatatttttgagatatgaagcactatgaatgtttcatgagttaaaaataatatgtcatagtaagtggcttcattcttattagcggttgatttctctatatcatccatgtgagaaaatgaagtgaaagcaagaatgcaacaatgcatgtttcccccttgatttcttggtatctctacctttta

SEQ ID NO: 24633 - DNA, 1047 bp, Homo sapiens
cctcctaaagtgctgagattacaagcataagccaccgtgcccggccactatttgtactcttaaatgatgtatgtgcatgtaagaaaggataattatatatgtacacacatataaatatcacacacacacatgcataaattaaatcggtatgtctggatggttggctatgtattagatttattgccttcttggtatttttcagtaggctccaaatttcctgaaaacacatctaattattatttttaaaagtaggtatagaatatgaagggatggacaatcataaacaacataaagagataaatggccaactacttaaagtatgtttatttcatagatgacagtggagtttgagtagccttattatttaaagacatccacaaattaatgagaagatcaacaagaccccagtagaaaaatgggctaaaagaaaacaaagggcaatagaaagaaagagacagggagacagagagagagagagaaagagatatgagagaaagaaagagaaaaaagagagagagagagaaaggagagggagaggaggaagagctaataaataataaaaactttatactgaacagtagtcaaagaaatagaaataaaatgatgtaatattatgtctataaattagcaaagtttttttattacatatttgtttcccagtcatatactgttgatagaaatgttgagtcctttgcctatcttttaatcaggttgttttttagctattgagttttttgagttccttacatattttggatattaactccctatcagatgttttgattgcaaatattttatcctaatttgcatattatttcttcatcctattaactgcttcctttgctgtgcaaaacttgtaagtttgatataattccctttgtctatttttgcttttgttgcttgatcttttagaatcaaatccaaaaaaataattgcccagaccagtgtcatgtggtgttttcctatgctttcttctagtgcagttactgtttcaggtcttaggtttaagactttaatccattttgagttgacttttgtaacgaatat

SEQ ID NO: 24634 - DNA, 1050 bp, Homo sapiens
cattgactcacacttaatttgaggccttgggattttcttctactttactagaccaggttgcctcatctgtcttccttaactataccagacatctatctggactgcagagctcttctctaagctgttcatgtatttttacattgttattcttttattaatgatattttaatctaatttgtttacttttttaattaataaaagaaaatttcttgtaaccatggcatgcaaattaaaaatacatttagctagtaaagacagaaacataaaagttaaacatatttacctacaatcttatgaacatttaaatgatatattaataagatttgaaactggataaatagttattaccacatttccaatattatttagttgaagcttttaaagttcaaatacattgttttctatctatttttaaaaatttggcatgggagatgaggaataagacatctcaatcatcaaactaaattcttttctttttttcaagattatgttaatactctgctaaggaatgtagaagttggttataatactaggatttagcttagtttttcatttttaattttcatgggcacatactaatagtaggtgtatacatttatagggtacatgagatgtctcaatacaggcatacaatgcataataatagcatcacgtaaaatggggtatccatctcctcaaaggatttagcttattttgaagttgcaataaaatcagtggtttccagtcattcaataaatatgactgagcttcaactatatgcaaagcacttttctagggccttgaacacatcaataaaaaaagagatcaagacacttgccctccagtatcttaactttctagtgacgagagatagacaaggttaatgaaatattatattatgtttgtatattttatatatatatatacacacacaatgtttgaatataatatatattctgtatatgtaaaatatacagaatatcatatagtatgttagaaagtgatatggaataaaataaaactggaactaagtaagtggaatctgaggtacagagtagaggggcagagtga

SEQ ID NO: 24635 - DNA, 1033 bp, Homo sapiens
gtttctgcagaaactcacgatctaacagtattttagcatttctctaacacttactgtattctattttacattggaattatttatgcacacatcttatcttttcttgggatttatagaacttaactgtgtatacttcttgctacctggtgctggttcaattactgttaaatgcttaataacatttagctttgtaaagtcttgtcttctttagtacaactaagccttataaagtaaaaaagaaaaaagagatgcatttattagaagacttcacaatggtacaaacattagtggaaataaataccaatttacaagctaactgtaatttataattttgatgagtgtcattgtgatgtatcaggatcctgatttattacttatcatatctgaatacatgtaatgatgaactgtgttttaaatagtgtctcactataattatgcattcttaacatgtacctttctggtttcatttgcttatatatagctttaccaggcagaaacatcactgtttaattggatgctgtgcagctatttatgcaggaactgtataacacacttgagggagtctgagttgttttcaccttcaccatcctttgaattggctaggaaaaaagggcattactaagtcaggtcactaacatcatataaatacagttcatttagttcttgtttgatttgttttaaattcaggatcaggacctcacatttagccttaaaaatagtaacatttgatttagctctttatttcagcctactgagatttttaaaaattatttctgtcttcttatatatttgctttttctcccacagtcacgtcttatataaatgtatctgaaatctgtctacttatctccatttgttttgtaccatatcaccatcctctttctcctggactgctgcaggaaagagccttccagacgccctctctgcttcctctcttgttcaagcctcagcctcttctctatgctggcatctttcaatcattttcaattcatcaatcactttcaattgaactcattactgtggcttccagaat

SEQ ID NO: 24636 - DNA, 1052 bp, Homo sapiens
ggtaccctggtacctacacagtcccttgctggccagctgctctcatccattgttatactggtgcctcataaatttcccctgagaggtccctcttctacacaaaagctgcctgggttttcttctcttaactaagaagccttcttttcatcctacagcccacgaagaaagcaaagcacactgaggttctcacccttacttcccctgcctctccctatttcctcctccttcccatcacctctttcctttatttattctttcacttcagcagtctcagctggcatgcatgaggagtctgttaggtgccacacattgtattgttcatctctacaaccggtgagatgggttttctcattttacaaagaggaaacaggcagagagagggtaagaagcccgcggaaagtgggaaactaaataatggcctagccaggattggagtcccagtctgactgtgaagccggcaactgcatcacactgcccctcagatatatgtgccacattgtgtttttagagaagtcatgcagaacaactgaaataatgtgacagtccaagagatctcatttcaaatcgtgactcccatcattttggttgtgtcctaggcaggttactaaatgagctcatttcctcatctgcaaaatgggaccagtgagcctttctttcattcagtaagtatttactgagcacttcctatgtgcctggcatacttctaggtattggatatggcagggagtgagacaggcactacccggttctcaaagaaccaacatttgggtaaggagacaggtaacaaatatacataacatgtagttgtaagtgctctttaaaaaaaaaagtgccaggcacggtggctcatgcctgtaatcccagcactttgggaggccaaggtgggtggatcatctgaggtcaggagttcgagaccagcctggcaacatggcaaaaccctgtctctaataaaaaaaaaaaaaaggaaaagttagctgagcgtggcggcaggtgcttgtaatcccagctacttgggaagctgagacaggagaattgcttgaacctgggaggca

SEQ ID NO: 24637 - DNA, 1071 bp, Homo sapiens
cacacaaagatccccacccttttgcagtttatattctattggggtgcaatagatcataaaaatatagtgataacttatatagaatatttatctcctaccaacctgtttattctaagatctagatctcatggaccaatctctttccatctcattttctcttgaacttatatgtccccactcatatatacctacacaaattaatgtaagaatggaaaactaatacatattgatcctgaagctatgtatgagaacaataacactgcgtaatatgtgagggttaaaggcaaaaaagagagatctaaagatgattattcagcaataacatgatatgatatctgtcctttaaaatatctttaaaatcaaattataatattttcagaggaactagaggacaacattatcttttaatgtaatggttccaaattaacaacatttaaacaaaataacagtatttatgactgtgcaaagtcaaatctacagaacttcattcaaaagggatgagtgaattttagtagttaggaaagattcaaaagcatgtttgtaatgagaattcttctttctcttccacattgaaggtatcacatttatgtacctctgtaaaaactgattaaaaaaaaaaaactaggttttgaggtcaaagtttccttaaagtttatgcatcaaaaaaataaaaagactcatgatctgatcatctagtaagaaatgctgaaacaacaattttcaagtaagcttgtctttaattaaaaatagatttgcgtatgcagtcagtccaattacagatcaaactttgctaaattttacctagatcccaggttctattcttttatgcaaaaaaagctgtacaattatgattccagtttcactttctgtgcttctgtttcattactttctttggggtctttagcttacatctcagaattattacttatcctcatatgaagaatggaacctagcttgactttcaaaaaccagtttgcgaacaatattttcatattagacagaagctgaaattatactccgaagaagttatagcacataatgaattagtgccaacttattcacaggtcgtat

SEQ ID NO: 24638 - DNA, 1065 bp, Homo sapiens
aaattaccatacatacagttcttttttcttttttattagcttaatagttgaaatttataataatatttatttaaaattttccaggtatatagatagaaaatctgtatctttgaaattctctacttgttttgattgtcttagttcatgacattagttcatagtgcaaggcacattactttataatagatggtagagtgtcaggctgataatcatgagtaatcaattatttatagattgtccacatggcaacaaaaaatgtgcttaacattgctgcctgatgctggcttctatttgttattgtttagaaattttctgtggtaggttttaatttactcatacttgaggctttttaatgttaaatttttgatatattagatttgaacatatttatgggatacatgtgaaattttgttacgtacatagatgtgtaatgatgaagccagagtacttagggtctctgtcacctctttatcatttctatgtgtcgggtacatttcatagcttttctggctattttgaaaaatgtagtatatcgtgttaactgtagtcccccgactctgctatcaaacattagaacttacatcttccgtcttactatatatttgcatccattaaccaacctctcttcatcagtccctctgcctcactacccatccatccttctcagcctctggtatctctcattccactctccacctctacgtggtctacttctgtagctcccacatatgagtgataacatgtgatatttgcattcctctacctggcttctttcacttaacataataatctctagttccatacatgttgctgcaaatgacacgatttcattcttttgtatggtcaaatgatatccacattttaaaaagtcccatttatccattgataggcattaaggttgattctatatcattgagattgtgaatagtgctacaataaacatgggaatacatatatctctttgatatattgatttctttttttttgttttttggataaatatccagagttgtgttttagtttgttcttgcattgctatggagaaatatctgagactaggtaatt

SEQ ID NO: 24639 - DNA, 1063 bp, Homo sapiens
ttttttttcatttttttattatactttaagttctagggtacatgtgcacaacgtgcaggtttgttacatatgtatacatgtgccatgttggtgtgctgcaaccattaacttgtcataggtatatctcctaatgctatccttccccgctccccccaccccacaacaggccctggtgtgtgatgttccccagcctgtgtccaagtgttctcattgttcagttcccacctatgagtgagaacatgcggtgtttggttttctgtccttgcgatagtttgctcagaatgatggtttccagcgtcatccatgtccctacaaagaacatgaactcatccttttttatggctgcatagtattccatggtgtatatgtgccacattttcttatatatatacacatacacccagatagaagttgtgctttacatttagcataagtgttgatatgaactcatttcttctttttctttactttgtcctttccagtttgcatatcatgtatattgcaagactatgtagaatcaaaatatacatgagatcctcctaaaacccactgttatctctgggagtgttaaatattgcttcaataaacaaaatagagggccttaaagtgcttcttataaatgatttattggtaggtggacgttttctctgtactttaaatgtttgaaatataacagcaagaacaataaaaatgtgtactgtaagaatccacttttccgatgggtgttgcgttttctgatttgtgatattaggtcaccagcagactccagaacagtttgggaattttttgactacacgtagtttcctgggtttctcagaatgaattacagtcaaggatatggaactagagacttgcatttaggctctttgcccacctctcttcatagatcagaaactgaagtctgagaacagtctcagagtgggaagagatcagaaagaattatgttcttcctgccctttcagtttggagcatttggtaaagctgcctgaaaacctggcttttaaaaccaggcataacacttcaggttatgtttcatttattctcactaaaatatgaagagctt

SEQ ID NO: 24640 - DNA, 1029 bp, Homo sapiens
gtcttcgttggattatgttaattcggaaactttgtctttgagctctgaagttctttcttctgcttgttcagttctgttaatgagactttccagaacattttgcatttctctaagtgcatcctttttttcctgaagttgtgattgtttttatttatgttatttccctgaagatttctcccctcatttcttgtatatatgtattttttatttccttgaagtggacttcacctttctctgatccctccttgattagcttaataactgaccttctgaattctttttcaagtaaattagggatttcttcttgatttggttccattgctggtgagctagtgtgattttgtggggatgttaaagagtcttgttttgtcatattaccagaattgtttttctggttccttctcatttgggtaggctatgtcagagggaaggtctagggctcaaggctgctgttcacatttttttgtcccatggagtatttccttgatgtagtactctcccccttttcctatggatgtggcttcctgacaggtgagctgtagtgattgttatctctcttctggatctcgccattcagcaaggctgccaggctccaggctggtactgggggttgtctgcacagagtcctgtgctgtgaaccatctgcaggtctctcagccatggatgtcagcaccccctccggtggaggtgacaggggagtgaaatggactcagtgagggtccttagttttggttgtttaatcctatttttgtgctagtctgcctcctgccaggaggtggctctttcaggagaacatcagctgaggtagtttagggaggatcaggcagtgggcagtgccctagagctcccaacagctttgtctttggctaccagggcgggtagagaaagaccatcaggtgggttcagggtgatgtatgtctgagctcagactctccttggacagggcttgccgtggctgctgtggaggatggcggtgtggttctcaggccaatggagttaatgtttccagggggattattgctgcctttg

SEQ ID NO: 24641 - DNA, 1048 bp, Homo sapiens
atttagaactgttgtacaaaaatacaaagttgagcagaggaagggaaatgaggggggatgggcaacggttacagtattaaatatgatggttagaagagtctccatgaagcgggaggtatctgagcaaatatctgaaaaaagtgaatgagctagtatcctaagggagagtattccagacagaaggaaaaggaagtgccaaaactccaaagtgggaatatgccaagggtgtctcagcaaaagccacattttaaattttaaatcaatctttaagcaagatgctcaattgtaccgatcaccaactactaaaatagaggattttttctgggaaaggatgttccttcttagaagttctgcttcaggctagattgaattgggacaaaagagataaaaagaagagttattaaggagtcagccttgagccatgcccatagctaaagaacctgagggagattggagaagtcagcaaaaccaggattgtgcctgtccttgaaactatatgaagaaggcttggctaagaaaaggagactctgaggtgacaaatgcaacaaaaagattaggaagaagaaagactggagaaacaagaacccagggcttacagaggccattgatgaccttagagagaggccattgatggagagcacaggattcccaagtacccaacatctcatgttttctatactagatacagtgaaaaatctgtacttttaagaattagtagtatactaaccaaggagtatatgagttttcaactacctgttaaatattaacaatgttttgaaatctgtctttggttaaaaaaaagtgccaacaagtttgaaagcctaaagttaaatgtgttaggcttcatacttaaggtgtatgcaacttctgttccgttttgctcttaccatctgctctgattttataacaaagcccagtactgacatgttgaagaactgaggtctacacacgctttggcaaagtgatgttgcaggattgctcaatttacagaaattccctggcctgaagtatggcttttgtcaggtcatcaccaaagcttgtgctttat

SEQ ID NO: 24642 - DNA, 1029 bp, Homo sapiens
tttttatgagcatcaataagtctttaacgatgaatattactaatcatcttttggctaatgttattgagactttcaattcatgtgctaaattacttactcctggggtaagagtagaaaaatctttggaagaatgattaatgggaagaagttggtgccaatgaggtaattaattattggttatttaataacctttgattgttagaaccataatcctttactgatagcaagtctaccatactatctgggatagtgagaccattaactataaattggataatttggctttttttcattggtttgctgttaaattcctagagtagaacaatagagaacccatttaaaatagacatttaacgaatcaatgagacaaccaacttcaggatgtattttaataaattaaaatacagccataataaaaatgactattcttttaactaaccgtataagatgttgtgtggtagaagtaaatggaaatggactttgaattcacaaatccagaaaactctttaaagtgggtatgttgaactcctaattgatttttattagtatgattggggcaaaatttgtttttttctttctgattgtgtattattaaatagcaaatgaaagcaaataaaaaatgtgtattaactcagtatttaaaaatatattaatatcactttataattttaaataatttggtaatgttttagctataataatacataagatgttcaattgcaattcctagtgttcaaatctcaagttttcagttgcttccacttaagcttttaaatatgctttttaaaaaaatttctgatttttgtttaaagtttaaacttaaaagacagcaacaaaaccaagataaaaacaatacattttatttacaaaacacaaaaaagatttttatcattatgaaacaatttgcattagacttctagttgtaatgtaaatataaaatcaatttggtcatttccaaattttgaaaactttttgctcctaaaagcagttctcagaaatgttaattcacacatctacagtggcaaaaaa

SEQ ID NO: 24643 - DNA, 1132 bp, Homo sapiens
aacctcttttctttataaattacccagtcttgggttctttatagcagcatgaaaacagtctaatacagaaaagaataaaatagatttagaatcagcttaattttagatataccaaaaggatatatttttgcatagatttttttttaattaggaaagtcttccaaatgttagcaagaaattgtcactgaatggtaggttttccttttcctacttttctgtattttgcaaattttctacataaattatgtactcagaaaaatgtcatctaaatagaagatgaaaatgaatttcatgaaaaaataactaataagatggactcagattttaatatataaagaacatttttgggcttgttacttttactctcaaaatacatttattattgggcatccaccatgtgccaggcacggggaatacagcaatgaatacaaaagacaaagtcccttctctcttggggctcacattctgacaacaggagatataaaaataaatatatgatatgttaggaagttagaaaatttgaatattttcttcaaaagtactatgaagaaaaatgaagtatgatagagggcaaattgtcaaattcatggcacactttgtatcacagtaaaagtataatttgaagtaaatgtaatattgagcatccttttctcatttccaacattagctgaaaaaaattcagtattccaccattaaaaatgatgcttgctaaagatatttttaaagaaattctttatcagttatagcatatctcttatattcctaggctgctatgagttatgaatacattttgaattttgtcaaattcttatatgtctattgagattatcctatttttcatcattattctataaatataataaaatgtattgaatgattttataatgttaaaccaacaatgctttcctgaaataaacccacttttgtttatgttaattatacaagtctgtaatttatatatttgtattttgtatttatattatacatgcatatatacatatatatgtgtgtgtgtatatatatatgtatatatatgtatatatatatgtatatatatatgtatatatatatgtgtatatatatatatgtatatatatatacgtgtatatatatatacatatatatatatatt

SEQ ID NO: 24644 - DNA, 1060 bp, Homo sapiens
aagttgcatgaaggcataggcttcctataactcccttgctcctaagatcagtgcttggcagccagtaggtgctcgctaaacatttctaaaggaaagaatgaaagaatgaatggtcttcttacaatgcagtatatacatgctgctggaatagttccttaaataaaatgttaatcctcttttgtgctggattggactgaataatccactttctttgatgtttgatgttaaagtgatgccataaaacagctattaaaaaattgagaattaaggatcgaagagaatccaaatgctcagctgacttagctaccaccctgtagcctgcatggcactgaggcaatcatccatctttattgaatgcttgtcttatttttacaactctttcagccattcacaaccttgatgggaaaccttttccaatatttaattattctttcaattgaatatctttttttaaatcaagtcagatttaatcacaccagtttaagctcatttcttttgtagatcttctggggaaatagaaaattacttctgcatacaatctgcttaggtagattagcctgcatattcagtacaagggtacataataggtgcactaatgcttgttgtatgtagttgaatggattgcatgtgaacaagaaagaactgtttagccatttcaagtactttagggtttttatcttgagactgtttttatccatttaactatttttgttatttggctttaaatactgtttcattctcctaccaaacacagacatcaacattcacatagcaaatgagcaatgggaactttaaaatattaatcccaaggtcttgaatgtcaaagtaataattacttcatctcagtgacatgtgatgcttttaaataatagctcttctgtttgtctggtgatgggcataaatctcagcataaatctgtgtgagggtggattggggtggagttggcaggggaaaaggaaaggggatagagcagaaaggatactgtcaggaaattaaatgaaggacgggacttctttaataatgtagtcttttctttttttcataatatgttagagtaacc

SEQ ID NO: 24645 - DNA, 1023 bp, Homo sapiens
aggaccaatatcaccaaggaatgagaactctcccttcatgactctgggattctaaacctttctctagaacaatgacctagttaatttattaatctaatcttttaaatgttaaccttttgaacctttcccatttcataaagtcactgggcccagcttcaccagtctgcttttactcatgatagaattatagaagttcaaatcagttaaataatttagccctcattttacagatgagaaaaagcaagcagagagaaagacagcagtcttaccaaatgggtggcagggctggaatggaagcccagatctaccttcttcctgcctctttcttgaatgtgcatgtgctagttttctccttagagaaggaaatcaaaaagagaaatcaagcttaccagtgacttcccaactccacctccattatcactcccacctaatacccatgatctctttctctctcataaatgcctgaagactctagttcccagatgcttggcatctcagtatggacacatgactaagttctgatagtaaaaagttaatggaaatagcttgccatttctaggatgtctttttaaaagagagggtgtgggcccttcttctccttttcctccctcctgctgcctggaatgcataggtgtggctggagctttagcagccatcgtggacaatgaggcaacagtgagaatgcaagcatcaaggtagaaagaacctggcttctgacactgagcagatgccataccagccctggattgcctgtccagacgtgtgtgtgagtgtgtgtgtgtgtgtgtgtgtgtgtgtgtgtatgtgtgtgtctatgtatgaaataaaattttatcttaagtcttaaattagattactcttatttgggttttctgtctcatgcagacaaatctgtccaattaaatttcaagaagtaaagcaaaccaaaaagaacttgagttgtctttttttattatttgtcttttttaactaatatttaatctcttctgttcaggaatatatttaacctggttcaagttctac

SEQ ID NO: 24646 - DNA, 1044 bp, Homo sapiens
tcagttgaagaggagtcttaggggccagcaacattttgcttgaagaagagaaaaatcaatatggtcctgtcttcagacatttggagaactgccctgaaggaggtgaaatgagcctgtcaatggagggaactgtaagagaccatctccaaggttctttggcaatctgtgattctctgttgtatttcctcatgaatccaaggagtagagtcagtggaagctacatgttagctgagcatgagaaagaattttctgctagagtaagctgatgatggcagttgtgcctcagacttaacccatcagtggagtttctagcataggccagaaaaacacttggtgggaattttgggaaggaaatttaaatatagaatgattgattaaactagatgcctttcccggacctgagagccgtaaactgacaaataaatgctccatgatgacaaaccccaagactatctgctgaagttcctcagagcctgagatttatgtttcttttgctcttccagagaagcctctcattgaaagggaagattagagaaaagaacttacaatgacagtagtgcaagctctcagatcttacacttgagttctaaaatgacagacaaggttgtaagaaaatccatgcaagaactgatgagataactcctaagaaaatgtttcgagaagcacaaaacaccattgaaattatagggaataaaagtaatattagcaagttagggaggcaacagtcctcattgttagggaatctttcttggttaaatgtcattgtgcatctatatatggagtgggccaaggagtggaaaattcaaattaaatgaaagatcaaaatcatttttaaagtgtagtaaaatcagtcagtattggacagaatggcagtgacaggacccactcagaaaataccgtgaaggtggaatcagtttcatctttagtttttatcaaatgatattttttctaaagacaagcacaaacagttgttagaagtcaccacaatggagttcttatgttttttcctctttcaatctcaaatactactagtatcttctgtgt

SEQ ID NO: 24647 - DNA, 1061 bp, Homo sapiens
gtgtaggagataagggggtgcattgtttccaaattatttagaatataataataatagagatttgaaatttgcatactttttattatcaccatgcatgccaattctaaacaatgccagtgataaaaatactcctccctgccagggtggaccatgccactcccttcaggtccccagcccttgtaaccacaatggttgttaaataactatctataaatcacactaaacatctttgaccttgaagttcacctttagggagaaataaactccctaaagtatgctgttctttgatcatactgggaaccaaaatcttgactacaataatggagttgagctatctagattttataatgttggcaacagagagtatataattcagtgctatgtgaaggcaacttcataacttactgagagtatatgaagatacataagaggataaggaatataatataccacaaggtattaatactgtaaagtgggagttgatatgaactttcaatttgcccttactgagaaactgatgacacctctcagtcaggtgtgcataacagactctaacgactccaaatgactctagaagtttctactaaagtaatttaatttactgatgctcttctgtgcatctacctttccaggtgtaattgaggagtccttaccggaaggtcactttactatatcagtgtttttcactctcggtttttgatgaaatacttgctttaagattgctttaagtgtagtctttatccattgtagtatgagagacagttgcttcaccattattgtttgcttggctgtttcctgcctgatggatgcagagtacactgcagtgtagggacaggtaatgtgtagtgggagttctgaagctggtgaagtcagtcctcactgggcaaaagagcatatctggttcctgagagatgagaaatatttgtgtagaaaatctttaagaaagggaaggcattgaaagcttaggaaacagtttaagaaaaaaacacaagagcataaaaaatgtgtattcagtaaagacagtaaaaaagcaagtccaaaatatgggtgtgtagcggcat

SEQ ID NO: 24648 - DNA, 1098 bp, Homo sapiens
tgaacatacggatcatttgtaggtgagcttcacctctactgaaaaacatgttggtctatgtagacaaatactcttgttgatcgcatataaatacactgagtgttgatggcaaatcatgttaattaacacagaccagcacttctcagcgatatgctacgatcaatactgttctattatgatattcatctctaattaattttggctcggcaggctagaacagcagactgtagctacccggggaatggaatttgaaatatgcattgctttacttgcggaccaaactagtgaatggctaagcttccgggggtggataattcatctcacatcaccgctttctgttgatgtgtttcaaccagagaacctctgcagagagggaaaaacataatcactgcaggagaagaatttcagaggcagaaagagaaagaaactatgcggatgtccaagaaaatcttgggacttagagtagaagtcgtccagaaggactggcccatttactgccatttactgcagaagctgaacactcatctggtttcattccactatctttgtaagaggatgaaatatctctttttagtgttaggaggtggtgggatggagcaataaatagagggggttctcaagtcctcaagtccaaacgagtaaattcaaatcctacctctcctccacttctcaaccattttgtttgggacaagttacttattctctcaagcatccttctcctcatctattatacgggactaataatagttattatcatccactacgtcagaggaagtggtacagaagaagatatgcctgaagaagcctggcactctatcagcattcaccaggtgtaagcagttattaggttgaaggaaataatttgctgccgtgccccattcagttcagtgtaataatgggctgtgtgtaatagcatcccagcccacccatccagacataatcattactctgtatgccaactctgccacccccatgatggtgggtgtccagggtgacaaaatccactgtttctcaaagctgcctttcagtgacctcaagtttctgaaagtacaggtaccttgcaatgttcaatatttggttaggtgagcaacttctaga

SEQ ID NO: 24649 - DNA, 1090 bp, Homo sapiens
aattcttacttaatttgaggcatcggaagacaggtcactacatcacttctagtttttttctgcagcctaagcagaaagatatcaccatgtctttgtggctttgtcgtatagcccttttctcctgatgacagtcctgagctcattatttatacaagtatgtagagaaagttagaagcataggtttcagagtcagactgatgtgagttttaaccctgactctgtcactaattatgtcatactagtatgttccttaacctctctaaccttggctttctcaccaacaacacgagcatgatatctgctttataggattgtcttaaggattaaatgataagagcataaataaagcctttggcacactctatggttcataaattctagagaacggtggattccaatataataatgatgatggtgatagttataataataacaattattattgaaaggatgttgccacagcaaactgctgtgttcattattgaggtaataataacaccaataccaaatgccaatgccaatacccaataccaaaaaaaggcactttcctttagtacatactgggaaagaggaatgttattgtagatccctccagagttttccatccctttcctcctttcctcccctacagcttctccacctttcctcctcccccacagcccccagctccaccatggatcagcagtcacttatgcccagtggttacagtctggaaattatagacacgggccccttggaacagtgtcttcaaatctgcagagagaagggtgaccgtgcggtaggcccactcctcttgtccttattcttttattctctacacaaccaccaccccgcaaagacagacaagtggttcaaacttctctgggggttagtaataactaaagacaattacaagagacaggagttttgttttgttttgttttgtttaacctaattgtttatttcatcagactatcccctagtccgataaatcttttcactgctgcaccttgatggcacgcttaactcctagtcttgctctcttcactcaggttgtctgcctctccttttacatatctactaccatgtcagccccgcttttgagaaatat

SEQ ID NO: 24650 - DNA, 1096 bp, Homo sapiens
gtatctcattgtggattttgttttgttttgttttgttttttgagatagagtcttgctctgttgcccaggctggagtgcagtggcacaatctcggctcactgcaagctctgcctcctgggttcatgccattcttctcagcctcctgagtagctgggactacaggtgcccgtgaccacacctggctaattttttgtaattttagtagagatggggtttcaccacgttagccaggatggtctcaatctcctgacctcatgatccacccgccttggcctcccaaaatgctggtattacaggcgtgagccaccatgcccggcccctcattgtggttttggtttgcatttctctaatgatctatgacattgagctttttatcatatgtttgttggttgcatgaatgtcttcttttgaaaagtgtctgttcatgtcctttgcccactttttaatggggttgttttatcttgtaaatttctttaagtttcttgtagactctggatattagacctttgtcagatggatagattacaaaaattttccattctgtaggttgtctgtttgctctgataatagtttcttttgctgtgaagaagctctttggtttaattaaatcccatttgtcatttttagcttctgttgccatcgcttttggtgttttcatcatgaaatctttgcccatgcctgtgtcctgaatggtattgcctaggctttcttctagggtttttatggttttgggttttacctttaagtctttaatccatcttgagttaatttttgtacaaggtataagggaggggtccaatttttattttctgcacatggctagccagttctccctgcaccatttatgaaatagggaatcctttccccattgcttgtttttgctggcttagttgaagatagatggctgtaggtgtgggtcttatttctgagttctctattatgttctattggtctacgtgtctatttttataccagttccatgctgttttggttactgtagccgtgtagtatagtttgaaatcaggtagcatgatgcctccaactttgttctttttgcttagaattgtcttggctattgaagctcttttttggtttg

SEQ ID NO: 24651 - DNA, 1027 bp, Homo sapiens
aggacaaacctgaatgtgctctctttttaaaaatcacaatcctaataatggacagcctttactgagtgcttactctatgctaagcactgtgccatgagctttgcatatatgatcccatttgagctagaaacaaccaaccctgtgtggtttgttctgtaggatcttcattttgcagattaggaaacgggcctatagaggttgcagaacatttccaggagtaatatgtgtgtgggactgaaatgcaggtcttgacattaacactgtcctgtctctaaaattatcatactcaaatttcagtacttggtgactgtcatcataagttgtcatgctgtccctcacaactgactgccacaatctgtgtactataacagagagaaacgtttaccaaaagtacggtctggcttttatcaaaactaactttttgcttcatggtttgaaccaaattgtccaatactgatttgagttactcgggtcttaaaaagcaatacgttaataactgtctcttactgattgtctataatgtcctactcactatatcagacatttttcaaaaattatttctaataaaaatagatatctaggccaggtgcggtggctcacgcctgtaatcccagcactttgggaggccgaggtaggtggatcatgaggtcaggagttcgagaccagcctggccaacatagtgaaaccccatctctactaaaaatacaaaaaattagctgggcctggtggcgggtgcctgtaatcccagctactcagaaggctgaggcaggagaatcacttgaatctgggaggcggaggttacagggagccaagatcacgccattgcactccagcccgggtgacagtgcaagactccatctcaaggaaaaaaaaaaagaaaagaagaagaaagaaaaaaaaatagatatctaaagtatgataaataaagttggagcaggacagaaaggggagccaagtcttcccccacttatgagtttcatttttcaggctccagaggcctttcatgtctctttttcccactcttgaa

SEQ ID NO: 24652 - DNA, 1072 bp, Homo sapiens
ccgggcgcacgggaagaggactgagagccctgaaaccccagcggggcaggagccagcattctgagcatgtgcgagccagccagggggctagggcggatttggggggtcgactttaggtcgtcgccctaagcgcaaagcgaaagagcggtgagagcaggggcgggcgacactccccggagcggtgcccctgcgcccagggcgcagcgactgcgccctgccctgcgggtgtgggcgagttggccgcgtgtgtgcctcgctgtttgacgcgaagacgagccaatcagggcgggcggcccgagctgccatgtgacgggcaaggcggcccctttccccagcgcggccagagggaggagagaaccggggctcgccgcgagccttcgagagcagcggccgcggaggaggcggcggcggcgggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagaggtaagaagggctgaagcccctcctcccctccccctgcgcacacacacgcgcgcacacactcgcgcgctctctggcgcacgcccccgcgcccccaacgctcgcgttcacgcctcccaacctttgtgttcggggaggggttgctgacccccctgccccgctggctttctgggagccagaaagggtctggcttgccacggatttcctcccgggcgccggggaggagccgcggagcgttagggtcgccccctgccctcctcctgggccctgctctcctcccggcaagggcaggcgaacaaaggtgagcggtggtcgggctcaggacccgccgcattccgcggggctcgcccctctccgccggcgcgccac

SEQ ID NO: 24653 - DNA, 1050 bp, Homo sapiens
catgatgtaatgtcatctaggattatgaaattaataccctgagttcacttatgacttctctgttgaaaatatttgaattctctatggacagggctagttttctcttggattcctggttgtaaagtgtttcagaagtggttgctcttctgtgatggggaaggacaggtggcagcagagggaaaatgggatttcaggtgagtttcctccatcagcataccagttccatggctttgtcagacattgctgcaccatcctcaggctgccctcttgtattttactaacttgattaaaccttgttggtgaacactagaacctaggcccatgttgtatattaaaagtttcaaatgttattgcatacacttacatttcttcctcttaccaccaggtgaaaccagattttttatttatttcttacatagtcgggactttcaaaattttattattttttttccttgctcatcttcttttgattaatttcttaaacacttttgaatcagaatactggagttccagattgtatgtctagttgtgtcacttaatttttcttaggaaccattttttcatttcgttttttttaaaggtaaacaggattgcctcgtatagcacagtgatcctttcatattagcaatgccttgagaatctttattcttaggattttattctttggtttcttccccctggccaccttttaaaaatgatttcataagttttttttggtctctctttcctgacaccataatctttattgacatctatactgtagcatgattgaacacaaaaggatgattcttttatttatttacttgttttttgggacagggcttcactccgttgtccaggcttgagtgcagtgccataaccttagctcactacagccttgaggctcaaacaaccctcctacctcatcctcccagtagctaggactacaggtgggtgccaccatgcctggctaatttttaatttttttttggtagagatggggtcttgctttgttgtccaggctagtctcctggcctcaagtgatcctcccatttcgacctcccaaagcac

SEQ ID NO: 24654 - DNA, 1028 bp, Homo sapiens
gtgtataagtttgttgacaaactggatcttgttccttgaatatagatggtctcactcaatttgtcatttgagacaatggaaacaaaggtatccgatactttggatttgaaaaaaccagatattttgaacacaaaatattggtttgtgacattggaatactttgttttgcaaataatgtctttaaaacttgcagtgcttgcatttgaaacattatgctcaccttaaaaacgtatcttttcatctcaatttttcttatttaagctttttgttctgtctttggatctatcttttgttccttttatccttctcttcttcaggaatatcagttatacatatgttagatttcctttgtctgcctttcatgtctatcatcttgtctataatcattttaatattattagttttttccatgtggttttattaatttttttcacacctgcctaccatgtatcttttcactcatgtttgtttaagttttttcttttgttcttaatgtttctgtaatcttaaaaaaatttacccttttattgtgctgctatctctgtttgcatttttttcagttttataatcactttactaagtcctagtatctctacaaaaagggcacaacaacattcttccaaattattcatgtttaagatgattgttttttcaggctacttttaaatggaaattctgaattcttttcggttttcctagaaatgtaatgacacaatatataataaatcttagtgcattattgtgtcagcagtaaccgtttgttagtttctagggcattaattttaatttgtggattaaaaaatgtttcattatctaacattaatgctacaaaattgtgtttgaaatatttagaatatgatacctcttgatttaacagttattttaaaaattactaatgatatgtctatagtctcattaggaaactccccatacacgaaaaaaataaaaaaataaaaaaacacacagccagttctccattttcactgtttcttctatctcactttcttccctgatgtgtccagtattag

SEQ ID NO: 24655 - DNA, 1087 bp, Homo sapiens
gaactttacaccctgacctccagaggtatctggtgcctacagttgtcaaacatttctggcattctctagtctaaagcctctctactcaaagtgtgaaccatagaccatcagcctctgccccatcaccagggagcttgttagaaatgcagcacttcaggctccaccccagatctgttgacttggaatctgggcatcaccaggtgattctcgtgcatgtgaaagtgtaagacatctttctttgatttccatccctggagacttttatcactggagctggttaggcttcagctatctccacttggcttaatcagttaccctggcccttctgtcttgggtgacatctcttatttgttatcatcatcattagtccttttagaattttaccctgtttaatttaatctttagtgacttaggtctcaagaggtcttggagataaaaacatttactttatttattatgtttaacaaaaattctctctgaatatttcattatgttttttgttaaatttttgagccatcttgaattaattttggtgtgagagatgagaacttcgttaattttggtgtcagaaatgggaactccagattttgttttcttcccccagttggctggcaaatagtcctaacatcatttactaaataatccatatttttttctctgatttgaagtgctacctcgatcatattctaaatttctaccatatgatgacaattttaattattgtaactttataatttatcttactagttagtactaatttctattcatttttagagacagagtttaaaactctgagttaaaataaatgacttctgtatttcccatttattttcatctgtatttttatttattccattttatgtttacttgttcaaaatgatagggtcattgacatattttcatttctaactagatttttaaatatagcaagtagatatgcatgtgtgtgtgtatatataatgtttaaattacagactttattttcttttttcacatatgacaaatttgaagccattcctaggagaatccatttctttctatcttttgggaagggcacaatgtaagtactgttaaatgcaatagaaag

SEQ ID NO: 24656 - DNA, 1027 bp, Homo sapiens
ggagcttgcagtgagccaagattgcaccactgcactccagcttgggcgacagagcaagactccatctcaaaaaaagaaaataaccagatatgtgtgttgtaggattgatatggatagtcagtaaagattaaagggaaaggatcaactgtaggttggggtgcacggggggtttgctgggattagaactgggtcaatgtcagtggcctttcatctttctgttgtatgatatagtattgatgaagttttgttttgaaactctcttcttccttggtttctgagttgccactagattctcctgcctttccaaggtcttttgtttgcatcatttattctgtgtttgctgtgtggtctttaatgtgttaatgacactccagatttagtcttcaatctcatttttcccttgccctaccttccattctgtgtgttaaaatcatttcctctcaccagtttcttccaaagccatgtgtacagtgcagatgtttcttctaaggcatcgttctgcgggctccaactggcagttctaatttgcttccactcctgactttatttttcctattgtttttatgcttccgttttgtcataggctggaaactcaagtcaatcagccactgagttctattaattctttgtaaattcgccattatagcccaatatgctttcatatgtctccttattttttttatcttgcatacacatagacattttgtttgctaccaaaaatcccaaattatttttctaaaatactactatccccatgttgtgacactttaaaactttggtgattttaaggcaactataggataaatattaggtccctgagcctgataactagaatctgtcttttgcttgtttaatgtcagtcacccaaatgacatcttccttctagagggttgtgtttttactgtctgtgccttcttccttcctgccttgtgtatggtgttccaggccaggaacttcctctgccttacccatttatcccctcaccattcttcaaatcccaggccctctctgaagtgtggcctgacta

SEQ ID NO: 24657 - DNA, 1048 bp, Homo sapiens
cagagggaaccatcaagcctgtgttgctcaaagtaaattgatctactgtttactaccagtctgcaatgagataagaagcttgcacctgaatgtaaagcagctcctcctgatttttgaaaaagtctatctatgaagaaaagttagctgaaaacagtgtgcttagtgatccagttaatttacctcgagtgtaagctccttatgttgttgtggacttgtaacagacatttcaaggactgggcctcacccattagcaccccactgaggtatagtggaggtagtaatagcaggaaggcactgccactgtgaggacaaggggattacagaacatagaggctcaaaggaagagccatggagccagagaagacttctgacaaggggacactgaccagctggtgtccctgagggagcatgaggggcttggctctgggaatgtggaaaaactacaaattggaaccagctgctgctgctggaatgaactgctactgctggagtgaagatgcactgctgggtgggtgtggaggcaggggatgaacgtgatgacaagaactagaagcaaaacagaaaggagcaagtcccatcttcctcttgcagccttccagccttcctcaagtgcttctaagaagctaaacttggcaaggcaccagctccttaaagccagcagaagtgcggcttgcacagtctctgctctgagaccggcagcagtatctcaataactagcccaattgtctcatattgctgcattctgaaatgtactctgataaatcttattataacctattttattacatttttaaaacatgaaggttgccccattacattgacttcatgactaactgctgggtgaaaacttgtggttgagagtgccccgtcagactgagtcctttgcccactcccttagactttctgaatccaaccttaactaaggtgcagcctttcattcttcatgcggtgttctcaaattcaacacacaaagccacgaagtgttccctggtttcatactttgagatgttctcttttgtttattgcttagttcggaatctttctgaaa

SEQ ID NO: 24658 - DNA, 1076 bp, Homo sapiens
atgaaaaagaatgaaatcctgtcatttgtagaaatatggatgaacctggaggacatcatgttaagcaaaatacaccaaatacagaatgacaaatactgtatgatcttattcgtgtgggatctattttaaaaagttatcatagaagcagagattacagcagtagttaccagagattgggaagggagggtggggagacgtttgtcaacaagtgtaaagttacagttagatggggggaataagttctggggctctattgcaaaatagggcaactatgcttaacggtaggatattgtatattacaaaatagaagagaggcttttgagtggtttcaccacaaagaaacaattacatgcatgaggtgatggatatatgaactaccctaatttggtcattatccaatatctacacgtgttaaaacatcaaattgtactccataagtatgtacaattacaatgtgtcaattaaaaaataaagagactgtatgtatatccagatgtgtctattaggggttgttaaaatagaatttcccatcttttctctctttctcatctgtggcttctactcgtaatctcgctctgtgtgacaaaactgtatcttagtcatgaaaaacagtttatttgaaaatattgttcagggagattagtacctcgctcacacacagataggacatggttcagagaggcttggaatcaggtcattggccaacgctgtcaattctctttatagtgtttatgaggtttacgatgagcatctcatacagcaatgcctgaaactacaagtgggacttatattgtgcctgacatcaagaaaagggccaataaatattagtttactctttggttacttgcctcttttcactgatccacattgttcttatttatgagcaatatcctttaagctgcagcctcctatgtgcttagaagtctttttaaacgttgatgactgattaggaaaatcaataccaaagagcatgaaaccgcagggaagcatgataagcacttcttaaatattggaagtaatttacgaactacggcattttcaaagagtctggagttctgtggagagaaagactcaca

SEQ ID NO: 24659 - DNA, 1044 bp, Homo sapiens
agggagcaaaaggcaaaatcaggagcctaattaagatctcggaaagaaaatgaatagtgcttgaatgaaagggaaatgtaaagattctggaacatagttaggtttagggcagtgcatggctttgtacaggaatctggctccctaccttgagattgggtttagtttgatcagactcagagacagggtgcacagtggttatgtttgggtttgggaccagagagtctgagtttgattttcaactttggcactgcctagctattgaacctaggtagttattcacagactcggggcctccatttacctatctataaaataagaaaaatactagtagctactataaggattaaatgagttaatatgtgtaggaggctttaaaagtatataggacataaggaggactcagcagatattagccacctgaagctaattgtcctcattcctatgatacagggctgatgaagatgttggcagattaatcttaagaaacatatagatgtatatcaaatgtatatagatgtatatcagaaagtgctgagagctgtagataagggatgcaaaagaattataacattaatacttcttttgaaattattttgaaactatgagaaagtttgtgctggtcttattggataattcggctgtctgcttgaattcataccaacccctccctgattattacaaatgtttggaatctgtgtgtacacttagattttcctaatcatactgtgtcataaggcaagtaattcctcaaattaagaatgattgttttgtcataaaaagacctggatcacaggtcaggagttggcatgtgctgtgagggttagtcttaagtgtccttcttaagaagtatacctgcatgtcactgaaccctggtcaaggcatgaataatgtcgcttggtaaacattgagtctgaggagtttcagggcagtttatactagctgtcatcaatgtttatagataagagtgagatggaggatttatatctggtttctgtgagacccctgcaggcccctgctgttgaggctggttatgtagcaggaata

SEQ ID NO: 24660 - DNA, 1044 bp, Homo sapiens
aaaactctcttgtttttagtgggattatgtgcaaaataaatattcctgacttccactgcctctctgagcctccccccgaccctgagcctctgaggcagttaaagcaggtatcactcccattttacaaataagtaaactaagacccaagttttatacctgctgagctgtagagctgagacgtgatccgatatcctggctgggtgcctagtctggtatctcctggcagccttcctgtccctctgatcttttagtaaatatttttgaataattctttctgatatttgaaatgtactgaacatttttttctaataacaaaaaaaagagctttctgattaatgcagaacttaaatctatgcctcagtgacccatacagcattccagttcctatcacctactgtcttgtccctatacttgcagcagttgtccagggttattctttgtctgtattagaattttttttcaggttgcttaaggaatcttgcagatacttgtgacaaagaatcataaatgctgttgttaaactgaataatgaattgagtcccaaatgttcgtgctaattaatgctttttgagttggagatgaaatgagagtaatatcatcaagctgtggattaaagttatcctcaaagccccatcatctacaaaaagaataggacaggaactgcctttgtgcaggtgcaagaccatgttacttttgagcagtgagcttgagatgtctgggatacaaattgggttccctattaactactaatcattccttttttttctttcaccttcagccactcacaactgaccttcactactattacatcctggagctgtcgttttattggtctttgatgttttctcagttcactgatatcaaaagaaaggtaagagcggttatgtcgtaaagtgcttgcaagcatgcatctttaatggcccttagcaggtgggtttagactctcaaaggcactcacccctgttctcctggcagccctaggttagtacgacttgctgcgttattacagaaagttctctatttttgtttgtgctgttttatatt

SEQ ID NO: 24661 - DNA, 1023 bp, Homo sapiens
gtgtctatttgattcttctctcttttcttctttgtctggctagcagacatctggccagaatctattttgttaaacttttcaaaagaccagcttctggattcattgatttttttttttttaaagggttttttgtttctcttatttccttcggttctgctctgatcttaggtatttctcgtcttctgctagcttctgctagcttttgaaatttgtttgctcttgcttctctagttcttttaattgtgatgttagggtgtccattttagatctttcctgctttctcttgtgggcatttagtgctataaatttccctcgaaacactactttagctgtgtcccagagattctggtacgttgtgtctttgttctcattggtttcaaagaacttaaaataatttcgttatttacccagtagtcatttaggagcaggttgttcagtttccatgtaattgtgcagttttgagtgagtttcttaatcttgagttccaatttgattgcactgtggtctgagagacttgactgttaggatttccattcttttgcacttgatgaggagtgttttacttccaattatgtggtcaattttagaataagtgcactgtggtgctgagaagaatgtatattctgttgatttggggtggagagttctgtagatgtctattaggtccacttggaccagagctgagttgaaatcctgaatatccttgttaattttctgtctcattgatctgtctaatattgacagtggggtgttaaagtctcccattattattgtgtgggagtctaagtctctttgtaggtctctaagaacttgctttatgaatctgggtgctcctgtattggtgcatatatatttaggatagttagctcttcttattgcattaatccctttaccattatgtaatgccctctttctgtttttgattttttgaggagacttcattcggttttctaataatggctgtaccgatttacattcccaccaacagtttacaagagtgtccttttcttcacatcctctccc

SEQ ID NO: 24662 - DNA, 1032 bp, Homo sapiens
actcctccacattggaggcaagagatgcagagagctcaaagaatgagggtatcaagtggtgaaagatggatcaagggggataagtaagatttaactattattatttcaaatgtaatgataagtgtttgcttttactattatacataaagttattgtcattttagttattgctgaataccttaagaaaagtagaatatcattttagctaataatatctacagttcttttcctaataacatttccccaattctttttcttattttttaggagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaa

SEQ ID NO: 24663 - DNA, 1045 bp, Homo sapiens
aaatcgtaagagtaatttttttcagttgatgtactgattgagcttgagttgctgttatacagcatttgacaggaactataccttggaaaatcagattgtgattctcagttctgtgttgcttttggtttgaagagttttgggaacgttttaattattaattacccttctctaaactttaaaaaaaaaaaagcttttctcattaaaacataccatttgtgcaggtccttaagctatacagattctaaaaattgttagtattgagacattaacttctaagatttctcttttttggcctccaacctatatagaattgagtgttaactctgcatggattttgtttgttttaattgaactgacttctctaactctcatagctgtgagttccaaatggcaagaaaatgcatcttttctatatatgtatcacgataggctatagcatgtttatgactctggtttctttctcttcaggtggttttataccattactgttaatgttattttaacttggcatgtataacattgccatatagagtagagtagaaagttgcaaattttgatagtttacagagttaaacactaaacatatccaaagtccatttagagttttgggtgttgtattttgccatttttgtgatgtgtggccttttattctgtaatctcttctaaataaaacattgaacatccagcaaacataaaacctgcctcatttgaaaaggaatttcaaaattccaattaataggattctctagagagttttgtactttaatatttgtcagtgtagtgtcaactctgttaccaaggtagcttcttggtaaatccagtagctactcaatgctatttgtactgaataaagcaattattaacatgatacttcccactattgattaatgcaatattgatatatttggcgttgtggtagctgttgcagaatgaatagtgtaatgaccataagattgcttggaaaattgtaatacagatatccacaatgaattctttccaaaatttttttttccgatgataaaagtagtagatgtttattataaaa

SEQ ID NO: 24664 - DNA, 1065 bp, Homo sapiens
aattttcatggttattttgtatgaattatttttctgggtaagccatctgccacagaaattgacactatggtgagattaatgttaatgaaatgagcagtagagaagctactggattgctttaaaacattctttgattaaattactacatagttggtaagttcatagttttaagttacttaattgaagccctcagaagttgcaaagaatttatctgataaatctgcctttgcacaaatgtgatactgatgcatggacggctttgcggaatgacctttgatatttgtgcctagtggaaggtatggagctaaacaattaaagaactcttcattatggataggcacatattggatctctggtattttgggtagtggtattaacttgacaattctaatttattttagttagtatatgtagcaagttagtatgtttgttagtagtttattgtacttcattccagttggtaatatagttttcatcacactaaactttttatactaaatttctgtagaagcttgttgggtttgccttcaccagaaggtactttaaatacctaccatagctgatttgttataaagaaacaaaatgggtgttcttctgtttccttttgattatgtttactgtaattatttcattttggatttatacatttacaattgaataaggattataggttgataagctgtttattgtgaaaagatgtgttttgttacaaatacttgttttaaaaattaataagcccccaggaagtacagcattgactggcacaactgcccatagtgagcttcccaactaactgccttcagtggattcgggcaagtgcaaagtctttggcctattgtgtgacaaagaggtatatattaaaggaaaagaaaaatgacatgaataagaaaattccgtcaacaaggttggagtagggagttgttgaggggtttagtttgttttaaaaggtatgtgagggagtggtggggtggatttgtgtttctgactttttttctttaagcaaattccatatgttaccaaaagcacatgctgtatattttcttccccttttgtgtgtatatagta

SEQ ID NO: 24665 - DNA, 1056 bp, Homo sapiens
ggtgtgaacccgggaggtggagcttgcttgcagtgagccgagattgcaccactgcacttcagcctgggggacagattgagactctgtctcaaaaaaaagaaaaaaaaaagataattattaaaaactttacaaaattgaaagatagatcctgaggcaggacttgggtaaaacaaacaaacaaaaaaatacaaaaaatatatttaaaaactttgtaaaaaaattgaaagacatcaaacttcagattcaagaacgcttataaaccccaaacaggataaataaaatgaaaaccacatgaaattacaccattgtaaaactgctgataaccaaagatggaaaaagtataaagaagccaaaagaaatattactttgaaaggagcaacaattaagctaatagctggcattttttctttctttcttaaatgcttgatagaatacaacagtgaaactatccagacctggagttttctctgttgaaaggttttaaccacgaattccatttcttttacggatataggacattgtgaagcttttcttgagcaagctttggtagtttgattgtgttaattatctattgctacacaataaattattgcaaaacttaacagcttggaaaaataaacagttatctcagtttctgtgggtcaggaattcaggagcatttagctcagtagttctggctcaggatcaagaatgggtcaagatgttaactaaggctgaagccatatgaaagcttgactggggctagagtatctgcttccaaggtggcccactcgtggtttttggcaagaagcctcatttccttattggctattgacaggaggcctcagtttctcactgatagaaaggctcaaggtattgctgattggcagaaggcttcattttccaactacatgggcctctccatagtgctgatcaagtatccttaaaaaaagaaaaggtagctgttttcttgccaagtgagtgagccaagagaaagggcaaagaagaaaccacaggccaggcgtggtggctgatgcccttaatcccagcactttggaaggccgaggtgggtggatc

SEQ ID NO: 24666 - DNA, 1482 bp, Homo sapiens
aaccctttaaaattctgctattcaactttttcctctcaaaatacgctgatcagctctcaagaggtccttcattaaaaccttggaaggtttggtccctacaggatgtaacaaagtacattcttccaggaactagagacaacgtctgcttttgcaattcagtcctctctgagaggggcagacaccatactctccctcatgtggcccacagaacccggcacacccctgggtctcggtatctgtctgataaacactattttctgctgtgtttggcgatttgtttgccttgctctccttctctcccactggaaaaaaagttaaacgggaatcttatttcattgtatttattcattggtgctgaggagttgtacaaaaacaactggtaggtcgttaccaaatttgtatcattttgtcccaaatgtttcttcccaggcttttctgtttcttttttaatgctagtgagagtgtgggaatttgacctggtctggaaatctgacctggtatgatccttggatgacaggcaggaagctgagaggcagaacagtcttgggatcaggcacgctgcctctgaagctaaactgcctgcatccagatccctgctttcctcttacttgctgatgagctctggcaaattgtttaatcaccctgtgcccccgttttgtcatctgtataatggggatgacaatattacctagtctcggatcattgagaggattaaattaatctatgcttgtgaagtgcctagaacagtgtctgacacagagtaagcatgctataaatgttacgcatgattgtcctgaatgtcggtattgaaggacatgtcagctcttatagagcagaaattgatttcatgtgaagttgtgaccactgtcacaccagggtgggagaaggtagcagaaagcccggtgctgttgctcccctggtttttgtctttgcctgagtctcaccactacttgccgattccaggagggctctgaatgtcctgacccctcttctgcaaaagaaataagaaaagtccatatatttaaggagctattgtaaactagcatacatttctgattctgttttttaaggatgatataacagtttcaatggttttgtggttcagagtatatttctttttctttttctttttttttttttgagatggagtctcactctgtctcccaggctggaatgcagtggcgtgatcttggctcactgcaacctctgcctcccgggttcaagcagttctcctgcctcagcctcctgagtagctgggattacaggcatgtgccaccacacctaggtaatttttgtatttttagtagagacggggtttcaccatgttggccaggctggtcttgaactcctgacctcaagtgatccccccaccttggcctcccaaagtgctgggattacaagggtgggttcagagtatatttctttgagaatgaaagcttattactttactgaaattttaaaaatttatatttagaacagtgc

SEQ ID NO: 24667 - DNA, 1482 bp, Homo sapiens; identical to SEQ ID NO: 24666

SEQ ID NO: 24668 - DNA, 1482 bp, Homo sapiens; identical to SEQ ID NO: 24666

SEQ ID NO: 24669 - DNA, 1482 bp, Homo sapiens; identical to SEQ ID NO: 24666

SEQ ID NO: 24670 - DNA, 1058 bp, Homo sapiens
gtcatcccagggagaggtaacactgccagttatgtgcagttttgactactgcttgttttggtgggtggactcatacagaactttttttaaacaatttttaaaattttatttttaatttttaaaactagaaatggcggggggtctcactatgttgcccaggctggtcttgaacccctggcctcaaatgattctcctaccttggcctcccaaagtgcggggattataggtgtgaaccaccacacccagccatactgaacttttagattcccattttttggtagaaaggataacatttttttcaattcgttttattttgtagccttgaagtgaaatagcagctttctctggtaataaacttaatttgggtacagtcaaatttaaaatttattacctttttttggtcctggacccaaattaagttcactaatgtacagagaataaataaatacttggctgtttaggaactcctgaatctttatttttttccatcataactgctctacttataaatccacttttattttggaatagaaaggaacaagaagattgaactgtatcatgcaaaatggtgctaggtaaaagttagtggaaagacaaaaccaacgttttcaactaaaatgatcctcatcatctttcttcctttcttcatcttccctccaaacctatttcctccccctcctccccctccccttcctcaccctcccctctcttcccccttcccctccctctcctccctatctccctttcatgtttcgcctatcttcctctttcttcctcctccttccctctcctccccctcctccctctcctcccccttcccctccccctccccctcctccccttcccctcccccatctcctctccctccttctgccttcttcttcctcctcctccttcccctccctctccttcccctcctcgacttcccccacccctccttgttttggcatcagtgattccagtttttccagctcaggacctcaaaatcggtttggtttgcctctgcgtcagtcagtcatcaagacctgtgtgttttacctgtctctttcctctatgct

SEQ ID NO: 24671 - DNA, 1058 bp, Homo sapiens; identical to SEQ ID NO: 24670

SEQ ID NO: 24672 - DNA, 1058 bp, Homo sapiens; identical to SEQ ID NO: 24670

SEQ ID NO: 24673 - DNA, 1058 bp, Homo sapiens; identical to SEQ ID NO: 24670

SEQ ID NO: 24674 - DNA, 1035 bp, Homo sapiens
ctatacttttaaccttaaaaataattcagaaaaaagataaatgcatgaagacatttatgtctgcattctttataataacaaaaattggggaaaaaaactccatgtcaagaaagtgggataagaaaaatagtgaagtattatactgccattaaaataattatttggaagactgtagaaacgtggacatgtttgatatggtaagtaaaatgagcacaatacaaaatagtatgcatactatgattgtgactttgtaaaatctttatgcatgtggaaggtaatctgcaaaacaaattcattgtgttagtgtagcgggatatggaatgactttatttatttaaatcttttctttaatattactttgtattttcaataaaaataaatcactgtacatagtaagactgcttgaatttgggctgattgggttgcaggatagtctgaattaatgaaaacaagtgagttatacactacttcaatctgtaattgaattgtagactattttattgctctgaagaacatttagcaattaatgctagaactaatatgctgctcagtagtgctttagagatccactttatggcataggtgagaacaattgcagtcaccttcccctcctttgccagtttatgtaggtcctatgaactcctgagtcaagtctggccttctctggaaagtctttcctgtttcagccacagtaagactcccattgtcacatttaagaattggtcatttatatatgaattgtgtatctcttggctaagttagagattatggaccgcatcttattattggccttctcaagatctagtatttcatatgtacgtccagcatacaaggacgatgatatggattatttttacagaaaagcatgctggaggtgcttgaaggatcttgaaaatagtttgtgatctgaggtatttaattttcagctcctattttctgtttgttttttgaatttttatttttatttttatttttttatttttagtagagagagggtttcaccatgttagccaggcaggtcttgaactcttgacc

SEQ ID NO: 24675 - DNA, 1050 bp, Homo sapiens
caagttttttcttattagctccagataattcaaccacattttgtctctttttaaaaaattgtaaggttggcagggcatggtggcacatgcctgtaatcccggcactttgggaggccaaggtgggtgggtcacttgagctcagaaattcaagaccagcctgggaaatatggcaaaaccccatctctattaaaaatacaaaaattagccaggcatggtggtgcacacctgtagttgaagctacctgggaagctgaggtgggaggattgcttaagccttggaggcagagattgtagtgagccgagattgtgccactgcactccagcctgggtgacagagaccctgtgtcaaacaaaacaaaacaaaaacaaaactggaaggttagcatgcatttgacttcacactctgaagcaacatcctgacagccatatccatttcaaggaacatcatactggagtacttttcagagaggtgtccttcataatttctgaaagtctttgaaacatgatctttgttagaacttccttctgcttttctcttccccaattcctagtataaggcatttattctcagaggttcagcttttag[450 bp omitted]aagtcccccctgctc

SEQ ID NO: 24676 - DNA, 1050 bp, Homo sapiens; identical to SEQ ID NO: 24675

SEQ ID NO: 24677 - DNA, 1094 bp, Homo sapiens
ttctgggacatacaagggaggcaatgggaagcaacatttatccttctgcatctctatcttgtttatattctttgctctgcttcttagttcatccaaaactaaaccaaagtaaaatcaacttgaatgaaatccaagtctttattctctccattccccaaacctaggccagattctatggtctgattttcagcttacattctattgtccagctctgtttttacagtaaacacacacatttaataaaaggtgacaatttgtgcacagcgagtattattttaagggaagctatgggaatatactattggcctcaaagagctgactttctactgaggcagataaaaagtgtaaaaaccactactatctctaaagtcaagacaaagttagagggtctaagacctatggtaaactagaggatgttcaatccaatagatgtaatagtgtagaaataggccttttcaaatcatatatatatatatattttatttgtttgtttatttgtttgtttttgagatgcagtctcgctctgtcacccaggctagagtacagtacacgatctcagctcactgtaaccttcagctgccgggttcaagcaattctcctgtctcatcctcctgagtagctgggattacaggcgcatgccaccatgcccaagtaatttttgtagttttagcagagacagagtttcaccatattgatcaggctggtctcgaactcctgaactcaggtgatccacccacttcggcctcccaaagtgctgggattacaggcacttatattttttaataggattttaaaacacaacaaaagattccccagtttaactccagaccttctctgagcctgcggcagagcagctaaacactggaacagtgccttaaatttctggtatggaattctttttttttttttttttttttgagacggagtctcactctgtcgccaggtatagtgcagtggcgcgatcttggctcactgcaacctctggctccctggttcaagcgattctcctgactcagcttcccaagtagctgggattacaggcacacacaaccaggcccagctaatttttgtattgttagtagagacggggtttc

SEQ ID NO: 24678 - DNA, 1049 bp, Homo sapiens
gccctgaacaaaggaggacatcaaatggcaaatgtgcatctgaaaaggtgcttaacattgtaaatcaaggaaatgcaaattaaaggcgcaatgagataccaccacaccaccatgtggccaaaatttaagagaatgacagaccggctgccccgcctctggcaggggtccctggtgcgggcggggaatgtccccgacggagcttgatgagaggcgcacgctgctggcagggcaccgctgtgtgagctgggactggctcgcagccctccgagatggcccagcagtcggacaaggccgtgaagtgctgcgccctggaggagattcaaagcacaatcatagcaaaagcacctgggtgtacgatttgaccaaattcctggcagagcatcctggtgggaaagaagtcttaagggaataagctggagagatgctactgaaaactttgaggatgtcgggcactctacagatgccagagaattctccaaatcataaatcattggggtttcatctggatgacagataaagttaactaagccttcagaattttttttttttttttgagacggagtctcactctgttgcccaggcgggagtgcaatggcacgatctcagctcaccgcgacctccgcctcccaggttcaagcgattcccctgcctcagcctctcgagtagctgggattacaggtgcgcaccaccatgcctggctaatttttgtattttttagtagagactgggtttcaccatgttggtcaggctggtctcgaactcctgacctcgtgatccgcccaccttggcctcccaaagtgctaggattacaagcgtgagctactgcgcccagcctttttttttttttttttttccttcaagagatggtttagctctatgttgtccaggctggtttccaactcctgagctcaagggatccccctgagtggttgggactactggcatgcaccactggaaacccttattactactgttgactttaattccagttagtggactagttgagtgatcccagccatctcagcactggccaaagccttcctgtgtta

SEQ ID NO: 24679 - DNA, 2079 bp, Homo sapiens
tccagttctttttatttaaccatctgttctttccacactgatttgcaagagccttttcatataatctttaaatatattcttctttaaggttttctagtctattgacacatctgttacactattttagtaattgacattttagttttatctttttgctaatttgtaaacattattgtatatttggggaaagtgttttgccttttgtaacttatgtatttttaaataacagaacttggtactgtagagtaatgtcaggattggagtccatattatacagtgttctgaaatacattgtaattatctcacagtattattttggcgacttcaatttgccacgggacaagtttctaaaggaacagataaaactggatgaaggctgggtacctttggagataatgataaaattcaacaggtaacaagcttttaaaaataatctttaggttttctgtttacaatgagtgctactgctgagtcttatgtttttatatgtactcttcaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattgtaagtgggcctgtaatgcatttaaatatcttacatttatttagaaagtaaagtacggaagaataagggctcaggaatcacagcctcactaattactgtatgtcctttcgtaatattcttaacctaagtttcttttgttttgttttgttttgagacagtctcatcctgttgctcacgttggagtgcagtggtgtgatcatggcccactgcagtcttgacctcctgggctcaagtgatcctcccacctcagcctcctgagtagctgggactacaggtgcatgctaccatgcctggcaaaaaattttttgtagagacgggtcttcctgtgttgcccaggctggtgtcaatctcctgggctcaagtgatccaatcaccttgacctcccaaagtgctgggattacaggtgtgagccaccatgcctagtcctaagttttatcttcataaacgtggatattttctaccttgtagaactgttgtgagaattaaatgaaaaaaaatatatataccattggatgaaatctttgacatattctaagcacctattgcctattagctgttcttatttatcagcagctaaacttgattgcagttttctttagtgtatttttaaatagttttttattacggaaaatttcagatacatatataaatagattcaataatgtaccatcaccagctttagtagttaataacagaacatgcaaatcatcttgttttatttctgcttcaactgaattattttgaagcaaataccagatgaatcacttttattgtactggagagtagtggctcctaaacaaggctgttaagtgattaacaaagagaaatagagatagataggtatatcctgggttcatttcaagaaaaaatgaatcaaattctctccaattgtttatctgagaagtcattatttgttatttgtacatttcttcccactcttcacagaaaggcttcccaactgatgcaactcttgatgacataaaagaatggttagaagataaaggtcaagtactaaatattcagatgagaagaacattgcataaagcatttaaggtatgataatacagactttttctagttttaaaatatatgggacataacttaaaaaaatattttccttcctttttacagggatcaatttttgttgtgtttgatagcattgaatctgctaagaaatttgtagagacccctggccagaagtacaaagaaacagacctgctaatacttttcaagtaagtctttttgctgatgtttctcctggccttttacttatatggacacacactagggtaaggagcatggaagtagtatcccctgaaaggccaatattcttagtatctttagatgacctttgagaaatgcttgatatttgttcagtgagaactatagtcttttgagactataa

SEQ ID NO: 24680 - DNA, 1067 bp, Homo sapiens
cgatctcttgacctggtgatccgcctgcctcggcctcccaaagtgctgggattacaggtgtcagccactgcgcccggcctaaaaattttttaaagtatgataaatactgcctagaattattttccaagatagtttaatagccagatttatgtagtttataactaattaaataccagttgtataagagatcaaataatattgaaagccattttggaataaaggatgacaaaggaaaacaccaacactatgaaactactttatttatttattattattattattttttgagatggagtttcgctcttgctgccccggcggaagaaactactttaaaatagcattttggtttctagtctttttcttgtatagctataaggtggtgtgagtcatttctggtctgttgttgcttttaagaaactttttgatcactttgtatatttttatagaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggtttggatacatccctatcctttttagcaatcagtttgaaaatctgtagaaacttagacaaaattagtagaaagtaattttaaaaattgtgtttattaaattagtttctacttgatcatttgttattgccactagatgtgatgtctgatattttctgaattatactaaattagtttctacttgatcatttactttgttgttattgtcactatatgtgatgtctgatagtttctgaattatactatgaataactgttcatactgatgattgcagttttacttctgtagcattccttttctactgttcagtaaaattcattcaaactggtaaagacatggaaggtttgcagggtagaaaaaattactttggacaaagaaattaattgtgggactaaaaaccaagggtatggcttttgttttctgtctctggtataggggataattctatttaaagaaaaagccaaggaagcattgggtaaag

SEQ ID NO: 24681 - DNA, 1033 bp, Homo sapiens
ccctgggccggggacgtcgcgggagggcctggagcggagcactgggagcccactctgagctgtcaaggggagggtgcgggggagggtgcagccacagggggatggaggtgactgagctgtcagcggtggaaagggggtggggaggagaaggaggggagaggagagcggagagcatgtttaggaaaccgggctgtgaattttggggaagccagggtgggtaaatgatagcgagaaaagagccagtgtatggggtaggaggggagtgaggggaaatgatttttggggaagctcgtgtcgagctgtcaagtgtgtacttgttgggaaaggctgtaaagcctggttcttgggaagagacttaggttgtgatttggattggctgggaggggatgttattggggaccgtattggctcgcgggatgatgagagctggggaggtggtcttgtacgtgcagggaaggacgcttgaggaaaaggtcttctgaactgccagtgtgtctgtcactgtgagagaaggagctcttgagggttgagggaggagggaaggggaggggcctgcatgaaaagtgactgttgagctgtcagtggattatttggtatgctggaatgacatttagaattgggctactgagcagtcagttacagaataccctccataccaggagaacaaacaaaatactgagcgaaccaggaatcaagtgttaggtcttctccagttaagggcactttgttcactcactgatacgtgaacctctgtctaaaaggagacaacaaatgcccttttgacagaagcgatgcatcagatgttgggacttatgagaaaagacatttcagagtttgcagtgagttacagagagttggtacatgtagggtcgtggcttggaacatgatgtcaatgtcagggacagtctgagaaaaaaggaaaaagtgaaaggggcgattttggatgggcagtagttgaaagaatattagcaactacaggttgctatcagttattaaacttcttcaattttcaggtcttaggattaatgacaga

SEQ ID NO: 24682 - DNA, 2027 bp, Homo sapiens
gctctgtccccatcagactcaggctggagtgcaatggtgcgatctcggctcactgcaacctccgcctcctgagttcaagcaattctcctgcctcagccgcctgagtagctgggattacaggcggccgccaccatgcctagctaattttcatatttttagtagagatgggggtttcaccatattggccaggctggtctcgaactcctgacctccggtgatcttcccgcctcagcctcccagagtgctggaattacaggcatgggctaccacgcctggccccaccaggaatttgaggtcttgtttttctgcttattgaaacttggtgttaatgagaacacatggacaccacgaagggaacaacacacacaggggcctgttgggtcgggggcagggagagggagagcatcagaaaaaatagctaatgcatgctgggcttcatacctagttgatgagttgataggtgcagcaaaccaccacagcaaccatttacctatgtaacctgtacatcctgcacatgtaattcagaacttaaaaaaaaaaaaaccaaaagacacttggtgttatatatataaatttataatattttaccaatctgttggatacaaacatctttttaaaatttatattttcttgactagtaaagttgaacatcttttcatatgttttggggccatttgggcttctttcttggtgaactgctggttcatattatttgcctgttttgtttttctgttttactgagttttaagaatgctgtacatactctagatgctgatcctttgttgtataaatacttaatttcatcttctagtttgtgtcttgtctttttaccttgaaatatataattttgttgtaaacgattttaaattaaaaatgtagtttttcttctacagtttgtattatttgtatcttgttaaagaaatcttcttcaccttggtttaaaaaaatgcttatatgttttctactgaaagatttaaggtttttcattgtacacttaggtcttttgtccatctggaatttatttttacatgtagtatgagattgaggtctgtattagtctgttttcgcactgctataaagaactgcctgaacgggcccggaggctcacgcctgtaatcccagcactttgggaagccgaggcaggtgaatcacctgaggtcgggagttcgagaccagcctgaccaacatggagaaaccccatctctactaaaaatacaaaattagccgggtgtggtggcgtgtggctgtaatcccagcttctcgggaggctgaggcaagagaattgcttgaacctgggaggcagaggttgcggtgagccgcgatcacgccattgcactccagcctgggcaacaagaggaaatctccgtctcaaaaagaaaaggaaaaagaacggctggagactgggtgatttataaaggaaagaggtttaattgactcacagttcagcatggctggggaggccttaggaaacgtagaatcatggtagaaggcacctagtcacagagcagcagggggggagaagcgagcaggggaaatgccagatgcttataaaaccattacatctcgtgagaactcactcactatcatgagaacaacatagggcaaaccatccccatcatccagttacctccacctcatcccacccttgacgtgtggggattatggggattacaattcaggatgagattttgggtggggacacaaccaaaccatatcattagatctaattttatctttttcaatatgaggattcacttattgaacatttttttcctccattgatctataatgtcacctctatcacagaccaaacctatgtgtgtcctaagttctctattgtattgatatgtctcttataacaataccatactactttattagaacattaaaatgtattttgatatggcaggatttccttattattagtcttcaaaagggtttttggctgttcttggttcctgttttcatttgaatttcaggagcttgtcaagttctctggaaaacttctgttaagatgttgactggca

SEQ ID NO: 24683 - DNA, 1026 bp, Homo sapiens
tagtaactaaaaaatcttacccatctacttactatttccagtgctctttgtttctttatgtaagtttctattttttctagtatttctttctaattattctccactactgaggaaagatactactgtgtcacctatctaatacctgttgaattacaagttttccatcagtttggctgatgggaacagacaccattctcaaccttacatgtgagcatgtactgttttctaatcctttcaaatgtttttatccctggcctttggtagtttccatacagttatgtgctaattagtactctggcaaatagtcaaatactcaggagcactctgtgtagatttctgggattatttctctgtggaattctttactttttagtactctgtcctataagctatagcagcattgattttcctagatgcttagttctgtcttctcagcttcatagagtttggccccattttgattctccttcctttactgtggcctggaaactctgtcaaggaagtaagctctgacacatatcatcacgtcacttgcttcccatctatcacagattattgtccttcattacctgatgtccaatatcttgaaaaccattggttcatttattttatctggttttttgtttgctttggatgaaggggttaacccaacgacctggttatttttgttttagatacagattttatttaatttacttatgttaataaagtatttttgaagtaagtataaaagtatcatagttttttttttttttttgcctttagggttaagtagtactttgattataatagatagaagaaaaagtggtattgcctggcttctcttgcagagaacaaattacttagatgtttaacttaattacgcacatatttacagtacaatattaggttctatattacagttatatttacttttttatatttatatttaagttcacttagggcagttacctaagtgaactttctttcatatatgtgctcccagaaagtctattgctttctgctctatttttgggagaggactat

SEQ ID NO: 24684 - DNA, 1024 bp, Homo sapiens
gtgtgagcaaccgtgcccggactggaagaagttcttaaattcattttttcttttaaatcaaggtttaaaccttaaggtgtaatgcttcctaacctttatcataatatggcagatgtggaaaatagtatttggatgggacacagaggcaactgaggaggctgctcaggctctgcctgtgtgtctgccttgaggaccaaggaaaatccatctctgcactgtaatctgctgacctaacaattgaaagacctacctgaagggtagatagacttcagcagagtgtgaacatgctaacttttattttgtatttatgtatatattttcttaagagttgtaactttcattagattctcaaaagggtccttgaagcaaaaaagaataccaatgatgttttaaattgtggaggtaaaaccaaatgtatggcataacttattttttgtttttggtttaaatttttccttttgattacaaagttgtatgtatgtttgttatataaaattcaaacattatacgtagaattaacgtcctaagtagaagtatatcatatcataccctcagttaatttctacaaagtttggtatgtatttctgaaaatgtttttcttcttatatatattaacatttgtttcccttctccaaaatagtatttatagaagagattaaatgtatatacaattcatttctcacttaatttatcttagatataattatacttcagtgcttattgatctacctcatttttgtaaaaatcaaaatatgttatggatctgccatagtttggttcacttttcttctatgattaaatgcatgcatttttaacttttttatattgtaaatggaggtataataaacatctttgcaagcatatttaggagtatttctgtataataaattcatagaaatggaaatgctaagcttgtgttacgaacatttacaattttaatagatatggtcaagtgccaccaaaaactcaacctgttttacacttccatgtatacaacaaaaatttctgaacatgctttcaacga

SEQ ID NO: 24685 - DNA, 1024 bp, Homo sapiens
gagaacgaggtgtgtaactagatttttacttcttgtttataattcatttttctttttcacagtttaaaagtgggtagaaagaggtagagatttctcctcagaggctatccccaaatttacccgtatagttgtcatatgtacaatgaaattatttttgaaaatttcgctaagtttaggataatttattaaaagactatgaaatggaactgtttttctaatcgtataataaagttacattttacatgtcagggatttttttttaaaactatgtactgggaaaaagaccatcaatttgaaatttcaatttttatagtgtttattaataataaataggaaaaatcattgttatatttctatattttattacataatttataagagaaaaattgctgttatatttgcttataatcttgttgcttattcaacttaaattttatatttctaatacatttaattaaaatctaaaaaataaaattacatttaaacatatatatcttttttcttttggaaattcattttgagttgataatgtaatgtgaattaagccaaatatactccttttaaagggatgatttctgttgtggaagtcttgtaattgatttaataccttaaaatttaaattttatagtttttcccctctaaaaaggctttcacacaatgttacattttgtggagtctcattttgggcaattttcaagaattttcatcagattggagaggcagtttattatgctgtgtaggagtctgactctggaattagactgcctgggtttgacttctggctcctttacctattagtagtgtaaccttgggcaagtgtcttaacttcttcatgtctacatttccttatctgtgaaatggagataataatagtacttatttcatgagaatattatgaggattgaatgagttaacatatgtaagcacttacagccctggtgcccagcatattgtaaacactgtatgtgtgttagttaaataaaatagagtaatttaaaaaacttatgtaaatggttagcttata

SEQ ID NO: 24686 - DNA, 1035 bp, Homo sapiens
ttatacttgtgaagttgatttaaagcaaacagtctgattataggggcttacataaatcttcaagtttcatcttattgttatagtcttaagatctttgtatttcatttttgtaaggtgacatattaaatattccttctagccctgtgtagtctgtgttaatattctttgagtattgttgtaaccagctgtgaatttacctgacttctttttatgaagctcacatttatgaaaaaatgtgatgaaaactgtctagaaaatccatcaaaaaaaagaaaggttaatttaggttgagaaaccatctgtagattttgcagattgggagtttgaatctgtttttcttggattttcttgtctcatgtcttcttgtttctttccaaaatgttttggacctgtgtccatattttgtgcctgaaacacatgtagcaatagtgcctacttccatgctcagggtctatttaaggtctgaaaagttcctgagggctgtacaaatgctgtctgggttgagattgtatttgatttatttcctcttgtcagttggaccatcatcttctcttaggatcctatactgcttcctcagggacaaatgaaccttagctccacatcatgaatttggaggaatgggaaattgtggttatgataactgttttgttttcgttttccttaatgcctgaattctctacttttgggagttatttctgtttgttaacagtactgtactttctaaaaataaaaatatagaacttataactgataatatagtaatctgttattgttggaacaagtagtattggaaatcagacttgtattttaaaaagatgtttattaacttaaaactacaatccatattcattgttgaataagtagaaaataaatattaacaaaaagataacattacctaaatctctatcacttagtggtgactcactgtaaacctctgacattctttatttttaaatttttttctttttctttctttcttttttttttgagacggagttttgctcttgttgcccaggctggagtgcaatggcacga

SEQ ID NO: 24687 - DNA, 1040 bp, Homo sapiens
agggtaaggtgggaggataacttgagctgaggagtttgaggctgcagtgagctatgattacgccactgcactctggcctccagagtgagaccctgactcttaagaaaaaaaaaaaaaaaaaaaaaaaaaaagatgtatagtgttacagtgtacttgtctttgtatgttaaccactactatatatcacttatgtcaccactgaaatggaattagggagttggaagatatttttgcctttctgtagttaaaatcataatatcttcagaaaatacgatattttggtgctgtttttcttgttattaatgaaaaaactgcgttaaagttatatctaataaggactgattcaagccttagtaaatgcagtgttttgtaaagaaagtgatgacatactgagcttgttactcatttagacccattacctggggagatgtggtatgaacacattattcaatattagaagaagtataaagctggggtagtgttaattgaaaaaactctacaaggttatcctggaagacaccttgaacagtgatgtagttagggctggacctgaggattttgatgcgtgtgagatactgttttttccagtctctcatctaagtttagcccctgcttaagcagtgtcactggagccagtacatcatagttgacacttcttgtatcctcttgatgtctttgtggataatgctttcttccattgaatacctttatttaaaaagggcatccattccccccattcatttttccacttactgctttatattaaaatatatgcattaaattttttcttatttatatactgtgtacattatagaaatctagcttgtcaatattattgcattattgtaaggatatttttaacttttagatactttcccattttatggtttatgggttattagttataaaatgagatgagcaacttcaatcattaactgataaatttcatttttcatgtgcagatcaatccataatggatgttttgaagcataaaagcttcctagaagaactattattttggactataaaatatgaattcc

SEQ ID NO: 24688 - DNA, 1032 bp, Homo sapiens
attagtgaactttgtataactagtcttgaaaacaccttatgtttaaaaaaattataaaataatacatgtttgttacggacatctttgaaaatttccagtgaagtttaaagaaaaagttaaaagcacttgtagttttgttattcacaaatacctgttgttagcactttgctatatttcttttctttttgtgtaatgactatatttatagatacaataaatactttttaaaaagttgccatagtgtacatgtcaaaaacatgcattttaataagtgcaggtattaatatcatggctataccataatttatttagtcatttccttattagacatgtttctgcttttttatcataaatttgctgctatcagtcttagatatttttacatgcttatacttttataacttaaaaattgggataaatcttgcctttactcccttagtgagaactttatattcttcttttgtgcccactatgtggttgatactcttcaacctgccataatgtttctgtacctcttcccattctcatttctctatagttactcatcttaactttacctcccttaaattctatatatatgtatatgtgtgtatatatgtatatatgtatatacacacatatataaatacatacataatttttattattattttttgagacagagtcttgctctgtaccccaggctggagtgcagtggtacgatcttggcttactgcaacctccgcctcctgggttcagttcaagcagttctgcctcagcctcctgagtagctgggataacaggtgtacatcaccatgtctggctaatttttgtatttttagtagagatggggttttgccatggtgcccaggctagtcttgaactcctgacctcaggtgatccccctgcctcagccacccagagtgctgggattacaggtatgagacaccacgcttggccaataatatatagtatttaaatatttgctatgtacctggtactgtgctgaatactatttatgtattgtttcaattaagcttctgaacaagtctc

SEQ ID NO: 24689 - DNA, 1034 bp, Homo sapiens
gtgctgggattacaggcgtgagccaccgcgcctggctggagtttcactcttgttgcctaggctggaatgcaatggcgtgatctcagctcactgcaacctccgccttccaggttcaactgattctcctgcctcagcctcccgagtagctgggactacaggcgcccgccaccatgcccggctaattttttgtatttttagtagagacagggtttcactgcattggccaggctggtcttggactcctgacgtcaggtgatccacccacctcggcctcccaaagtgctgggattacaggcatgagccaccatgcctggcctacttctttgctttttaaaggaaaatttaaaagctgctttatgttttagttttactaacttcatgtaatatgatctattctttcctagagatttatctacatatattgctttttcttttttcctttttgaaatagtatctgctgtcattcagctgtatcaatgatattcttatattttattatatatttaaagacagacttttcacaaaaatggtgttttttttaaatttttttactttttaattatactttaaggtctggggtacatgtacagaatgcgcaggtttgttacctaggtatacatgtgccatggtggtttgctgcacccatcaacctgtcatctacattaggtatttctcctaatgctgttcctccccccgccccttgcccggcctggtgtgtgatgtccgcctccctgtgtccatgtgttctcattgttcaactcccacttatgagtgaaaacatgcggtgtttggttttctgtccttgtgatagtttgctgagaatgatggtgaccagtttcatccatgtcctgcaaaggacataaactcatccttttttatggctgcaatagtattccatggtgtatatgtgccacattttctttatctagtccatcattgatggtcatttgggttggttccaagtctttgctattgtgaacagtgccgcaatatacatgtgcatgtgtctttatagcagcatgatttataaccct

SEQ ID NO: 24690 - DNA, 1047 bp, Homo sapiens
gtagctggaaatccattccatcccttgttttaataataattatttgctttagctgaattgaatttaggaaatattaatctgtactggatgcttcagaggattcaaagttgagtagaatacaatttctgccttcaagaaacttatacttaagtgtttaaaatggaaaaattttatctatagtgattttggaatctgcatcttctaaaatgttaagttttgaactaaaagtataggaataaatccaggtgagagtatggtttaaacattttacaaccatcttaaaatttctataaaatagtctttgacttgtgcattttgtttgtttattccagccagcacctaaccaagtcacttttcatctgccactacatcgttactatgctatgtttttgagtaaggtaagactgtcattaaacaattctgttcttttttttttaattttcagaaataagaattgaattagtaacttttttattgtaatttttaggctgtgaaatgtcaagaactagatttggattctgttttaccagatcaggaaatgttaatgaaactaatgattcacccactccaaattcaagtatgtattcaggcatttaaaaagttttgaagtggattccttgtttaagtgattcttcctttatttatatgcctttcattgttattatagctgagatgtttgaaaactttttttaaaaagttgttattgtatttttgctagattatgtttaggtatttttcattttatgagatttactttttagttttactttttccaggaattcttttcatgatatttgcttatggggtggtatttaacatactatatagcactgttttgggagtcaggagatccaaaagattctagccttggtgctaccactgttttattttccgcaaggtttaaggtaattcacctccttgattctcagtttccctatctgtatagtgagaggagaaagaggagagaagaattagcttatataagcactgtgatttcttttaataccagcaatgtaatttgacaggccagctttttatatacattag

SEQ ID NO: 24691 - DNA, 1044 bp, Homo sapiens
caccaccatgcctggctaattgtttaaaagtgttttgtagaggtgggttcttgctatattgcgcaggctggtgttgaactcttagtctcaagtgatcttcctgtctcagccgcccatagtgctaggattatagatgtgagccattgtgcccagtgaaatatgtctgacagtggcagtgttgttagaactatgagctaggccatttccaaagatagaaatgatttcataaagcatctgttttaaattcaactgtaaagtacattttttaaaatatgtaatttcttatatttctgttgcctcctgtctcccatcttgaaggttaatggctgctgccccatgtttgaaagtatgatgtatgagtttatatatatcatttttgtctcaaactagtcaataattacgtgttggtttgagtcacttaaataatttttttctgtcatgtagcatttcatttgcattattctattaatgcttttgaaaagagcagtcaaaatgatgtattacttgggccttcaacaaatatataacctttattttggaacaatttattaatctaggtgccacatatttagtggctactgcttaaagcaaacaaagaaatgaagtaaaattaaaaattgctttttttatgctaaatgaaatagaatagttgaaatatttcatcatgactattgggatcattttgaaaattacatttatatgttgtcactgtagtattatatacaaaccaatttatttattttttatttatttttatttttttgagatggagtttcacttttgttgcccaggctggagtacaatggcatgatctcggctcaccgcaacctctgcctcccggattcaagcgatacatccgcctcagcctccctagtagctgggattacaggcatgcgctaccatgcccggctaattttgtattttcagtagagatggggtttctccatgttggtcagtctggtctcgaactcccgacctcaggtgatccgcccaccttggcctcccaaagtgctgggattacaggcgtgaaccaccgtgcctggc

SEQ ID NO: 24692 - DNA, 1081 bp, Homo sapiens
tgctacgacttcttacaaacttagtagttttttttcaggctctgacactcagaagtatctgaaggccttcaacataaactttagtagcagcagcattgttaacgtctttttaaaatttctgtattccttttgatgtttcctgagtggattatcaaatggggtttcctttctcctgttgtagttttttaaatctactgtgtcttgaattaaataaatgtaagatattagcttaaaatataaagtaaaacattatttttagttagctatataagatgattatatggatagatttccaaatagaacttctttcttgcccataaatccattggttgaagtggaagaaattagtaagataagtggaagacagaatacataatcagaataaataggaactgacctagtgatgataagagccagagtagagtctggttccttaatatgctaggctgacaagaaggtttctggtggcttctgcaggagctgatggacctacagggaggtattgtgtagagtagaaagagtcctagaccagaaaaactggggtttggtcctgattctgccatttctgagcaatgtgagcttggccaaatcccttaagtggtctgagactcaatttcctcatctgtaaaatagggctgataatgatctttcatgcagtaatcaccaggttagggttcactctgcatataggtcactctgcatataatacaggtcaatataaatgtaaagtgatgttttaaatattcaagctatcccatttaggaaggctaggttaggcctgttagacagtttgggttaggtaataagggtcatgcttccgtatattttcagagactttaaaatgaaattatggttattttgtagcagtctctgtatgtgtgtgtgtataaatacacgtatgtgtgtacacatattttcacacttttttctttgttctttattgctttggacttttgtttttttttttttttttttagatagagtctcactccatcgccaggctagagtgcagtggtgcgatctcagctcactgcaacctctgcctcctggggcctgggttcaaatgattcccctgcctcag

SEQ ID NO: 24693 - DNA, 1039 bp, Homo sapiens
gtaattacttttcttgacccattgaagttttaaattttcatgtagccagatcaatcagaccttatatttcttattttttcctattactttcatacttagaatgcccatgtcttccaagagctgatgtatacttttataactagtattacaatgtgtaatccagtcttaggatttgcaatatctacctatattttcactttagagttttctcatgggatgatttttaaaactatataacgtacttggaattcattctcacctgtagtgttaggtgaagatctaaaatttatttgcaaataaccaagtagtatttttagtgattttatatcctagttattaaatactaagggttcctacattataggcctgattaggagctttcttctttgttctattgagctccaagcctgtttctctgacaataccatgatggtttattgtttaggtgatttattatgtctagttatcgggctgagttaggttcctctcatttctcttccccaaactctgactcccagtttttctttgctgttctcacttattctccagaaggtttttagaacattttctaagcccttcccctcacttataattttttttttgagacagagtcttgctctgttacccaggctggaatgcagtggtgtgatcttggctcactgcaacctcctcctcctgggttcaagcaattcttctgactcagcctcccaaatagctgggaccacaggtgcacgccaccatgccaggctaatttttgtatttttagtagagacagggtttcaccatattggtcaggctggtctcaaactcctgacctcaggtgatccacccaccttggcctccctaagtgttgggattacaggcgtgagccactgcatctggcctaacttgtaattttgattataattattttaaactcataaattaatctgggaaagtagttatctttataatatgcagtttcctcaactagaaatattccccattcttttaattcattttttgttttattctgttgtatgcatattatgtttcagtt

SEQ ID NO: 24694 - DNA, 1818 bp, Homo sapiens
gtagttagaattgcttttaaaacttgtgctttatattatttcttaaaattttacaataattcaagattggattatcttgatattagattatactgctgtcgaacacattgtgtaatattttgctagctgtcattgtggtgatgaattcctcttagaatttagggtcagagaaaaaaatgccattccttattaatttttttagtctttcacactttgagaactggatagaggcctttaattcctaggaagttcagagcttaattacattaattttccacagaggttttttttgaggggaggtggagagttggggagataaggagttattaatataaatttttcttctccactcccttttgatgtaagagttaatagtggtctttattgggacagtgttattataaactatttttattgtaagaatatgtatttgtgtaactgtttaagttattgtttgttattagaagagaaaagcagaggaaggaaattttactgtttagacttactagaacgttaaatgcttcccatggttttatctgaaaaatagatggatgcagaaacctagctatatacctcttaaatcttttaatgcttagcattgttttcaggttgaaagacctttttatgccaattatctcatcagaagctcaaattaaatatattaaagacaagtttttttctttgatctcttatgtccttgcatcttatgtttcataatacccatcacatcactggcctctaaagaataaactcggaagtaacttctgacatcactgttttcaggtattcatatttagttctttatgtacaaggggaaagaagatttataacttaggatcagatttggctatataatataaagaagaaaccaaattaacacagtagcttaaataagatactacttgtttttctttcatgtagaaagaagtgtgaaagtaggcaggccggacacttctacttcacagcaccagattctttatggtatggccctcatctccctgtgccaaggtagctgctaagagttctagccatcacagtctagtttaaggcagcaggatgagagttaagagaggaacttcaccttcttttttaagaagccctcttagatgattcacacaaaatttacaattattatctccttagatgattcacacaaaatttacaattattatctctcaggctaaaattctttcttatttttgagcctccagggtttaagacataaaatcatcatcctttatagggagtgtattagttcattttcatgctgataataaagacacatctgagactgggcaatttaaaaaagaaagaggtttaatggactcacagttccatatggctgggaggtctcacaatcatggcagaaggcaaaaggcacgtcttacatggtagcagacaagagaagagaatgatagccaagtgaaaggggtttccctgcatgaaaccattagatctcatgagacttattcactaccatgagaacaggatgcgggaaccacccccatgattcagttatctcccactgggtccctcccacaacacgagggagttaaaattatgggagttaaaattcaagatgagatttgggtggggagacaatcagactgtatcagggagggtcagttacccaggtttggatcatgttgctgttcttgaggagcttcacaaatctgttcttaaccatgctgtatagaatacagactcccaagattctatagagcatttgggaccagtgattatagaatatccctgcttccaagatcccataagcagggcccagaaaagagagcttgaatcctgcttattattttccat

SEQ ID NO: 24695 - DNA, 1033 bp, Homo sapiens
ccaatactccaaaacttcagtattaccaaaataaatttcatcagttaattagcaggtatttcttgctcagatttttgttatgcagagggatacgtgggaaataaaaagcatagttcatgatattttggaatttacagtctagttggaaagagcacagtaacatgaacgaaacaatgaggaactatagaaagaccaaatatcatccaataataaattctctgatccaaactatcagtgccttaaaagtttaggttaaacttacattctgtggtgtttatcccttcctatattttaggattttaaaagtatagttaataagtagaataaaggacatcatagcagttctgactttatcccaatttacattttatggtaatttgcatgttacactttatatttcagtgaatataaaaagaactgcatttctttatgtataaagatcttattgacataaatttgaattcataaaaagccattattttttctttctgataaaaatggaagtaggacactaagatcaacttgtagactgttacttaatgtcattatctgaatattctgtaataaatatattgtcctattttatttttatagtgtattattttaataaatcctcaaagacatttgagggaaattgtaaatgaaaaaaatttgtggtctatattttttctattgtatgcatatgttatatgcatatattataccactataatgactatatcttttttaaatttggctcttttcacattgtaaatatttttcgtacagcttaaatttgccacattcgctgcttagaaaatgttttttaagttggtattccattttttaggtaactccctcagtcttgctggtcatttctaggttcttgctgtaatagtgctgtactggatgtcttgtacatatagctattttttttcttttggattatatccctggaaagaattcccaggggtgggaattacttggtcaaaaaacatgatttacatatgtttatttacatataattatgtaatttatatgctgtcttttaaag

SEQ ID NO: 24696 - DNA, 1028 bp, Homo sapiens
ccatcatataccccagaaatatacacacctactatgtacccacaaaaattaaaaattaaaaaaaaatccttttccaccctaaaattataaatttattttgtattttcttctattattttcatagttttatcttcacatttagatttttaattcagtctggagtttattttgtggtgtggtatgaggtaaagctctaattttttctctatttgataagacagtttttccagcactatgtacaaattatttatgaaataatgtaacttttttggactgatttttcatggtatcaagttttcaaatttctggattattatatactattaagctatttgtttctgtactagcagcagtttgttttaattactgtggttttattatagacattatatctgatagtgtgaatgtccaatttattcttgacgtctttttgctttttctattttttttttttttttttttttgctatatatgagcttttattcttttttatttttttgagacagagactcgctttgtcgcccaggctggagtgcagtggcgcggtctcggctcactgcaacctccatctcctgggttcaagcaattctcctacctcagccttccaagtagctgggattacaggcatccaccaccacacccagctaatttttgtatttttagtagagacagggcttcaccatgttggccaggccggtctcgaactctggacctcaggcgatctgcccgccttggcctcctaaagtgctgggattacaggcgtgagccaccacacccagccaagcttttattcttatatacattttttaatctgtcaagttacttcccaaatcctacaagattttggtttggaattatcttcaatttatagttttaagacattgaacgtggtttatacattcatttagtcaggtgttttaatactttttttgggtgggcgggaggaagacagtctcactctgttgcccaggctggagtgcagtggcacgatctcagctcacttcaacctccacctcctgggttcaagc

SEQ ID NO: 24697 - DNA, 1084 bp, Homo sapiens
atcaataacaagtagagagcaaatcaactaggataaaagagacctgaacaacactattatgacataactacatctataacttctccaacaaacagcagaatatatattatatatatacaactacacatggaatatcgttcattagaataaaccatgtgtcaagccgtaaagtatcaattttcaaagaagtgagttataaagtgtgttttttgactacacagaattaaattagaaattaataacagatagaaaatcatcaaatctgtgataagcatcataattctaagtaatttgtggatcaaagcagaaatcacaaggaaataatttttttttttttttttttgagacagtttccctctgttgcccaggctcgagggcagtggtgtgatctcagctgactgcaacctctgcacctgggttcaagcaattcttctccctcagcctcctgaatagctgggattacaggtgcccaacaccatgcctggctatctttttttatttttagtagagatggggtttcatcacgttgggcaggatggtcttgaactcctgacctcaagtgatccatccaccttggcctcccaaagtgctaggattacaggcatgagccacctcacccagcctagaaaatatttttaactgagtgaaaatgtaaacacaatatactgaaattgtgggatccagctaaagcagttcttagaggcgtatttatcacttcaaatactttatttgaaaaaagaagggccaggcacagtggctttcgtctgtaatcccagcactttgggaggccaaggcgggcagatcacgaggtcaggagtttgagaccagcctggccaatatggtaaaaccccgtctctactaaaatacagaaattagccgggcatgttggtgtgcacctgtagtcctagctactcaggaggctgaggcaggagaatcacttgaactttggaggcagaagttgcagtgagccgagattgtgccactacactccagtctgggtgacagagcgagaccctgtctcaaaaaaattaaaaaatgaacgaacgcataaaaattaaaaagaagaaagatctaaatcattatc

SEQ ID NO: 24698 - DNA, 1024 bp, Homo sapiens
atacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaatgtttactgcttacatgtttttttttcccccaaagatattgacagtaatatatgtgagtgaacatggctgaaaagatcaaagcacaacataattagtagttgctttagggtggagtaagtgtaaagggtttgctttgctttttttcttttatttgcagagtgagttcttgcttcttcagtccttgtctcataatcaatgcacattctttgctaagtgtgtgtgtttggtagggggag

SEQ ID NO: 24699 - DNA, 1123 bp, Homo sapiens
tcttcattttttacttggagagaaggactacagatttcctaggattcccaaagggatctgtaatcccaattaggtgaagaaccactgggcatggtggctcacaactgtaatctcagaactttgggaggcaaaggcgggaggatcgcttgaggccaagaattgaagaccatcctgggcaatatagtgagacctccatctctacacaaaataaaataaaataaagttaaaaataagaaatttttaaaaactgctttggtgaactacaaggccttctttaagagtgcagctgcacagattgtaaacatggcccaggatggggcagcagggtcagaagaagtgtcaggaatgaagaacaccatgtcagcccatttgtcaggcctggctgtggatcagcagccatggactgatatactagctttcaggagagagtgtcaggcctaagctaataagtcaggaaaagagtggaaaattggtcctttagactcaggcagggactatcaaacaggatacagctaaggccaagaaccagatgctagaatcatcctagtaggtttcctcctcaaggttgagaatggtgtcttctaatatcttagtttccttagtacataggatgtcacctggcagagaatagccactcagtaagtatttgttgaatagaactgaaagaaagtttaggaatcaggtacctggcatagataaggaacctgaaatagattagatcagttaagctcatgataaactctctagactcttcctcctaatcctgagagtaatggccatgttcctggtccttggggaggctaattcatgcaaaccttgggcctaattggttttaaatctgaagcatggagtgggacctatgcctgatattcagtcccattccctctcccttgtccatgtggttcctgcctggccaacactgacttgatcctaagccaactttcatccagtctttgatatggttctgatattacggtatgtgatttcatttgttccttgccttaccccagagagctttcttatatagtactgggagattctagcacagacactgccaccagtatctcctcgccatgcaaacatttttgtcatgtcaacatttccaaaaaccagtggaaccatt

SEQ ID NO: 24700 - DNA, 1035 bp, Homo sapiens
agtagcttcacctgtgtcttatgtaaaacaatagttatctcatccttacaaatagctttgccttacattaagcaagcaagaattcccattagtcttcaacattagcacttggctcaaacaccctaaccagtgataaagcttccccatgtcacttagctgagtcagtctaggcatctcttttcggtgaggatgatctgagcccagcctacagactctaatgctaaagaatgccaagcaaaaacaagaaagacaaaaagcctcagagcttagtaaatatctttttgttttctggcttaattttctgtggacagaccttccttgatttttcttaggccccacgtttggtctcacgatcttgtttcaatgactagtctaccagactatgcctctgtgttgaattgctttgaaaagagcatggcttgctacttttaaatcagtttcttagaagacaaatgtaaccttccaagatatctgatgcccacagctagttgtttatgccagttgaccgtcttcttgttatttataatttgtaattagaaaatcatcacttagaattattcttgacagatattgacttcagagaattatagaaacatagctgtccttgaggattattacagaaaaaccatgtagataattatattgagatctttaaaacctgggtcaatatttccaattatcttcacagttagccttcagatgtttacattatttttaaaagatagactttggctctggcttttatatattctacaagtgtgaaactggcagtcagcttttttttttttttttttaaacaaattgtaaaccaattttacatagaacttggaatgcttttttcaattaacatttgcattgtcctataatcttagaggtaaaagggactcagaaaagtcattttctttccttctattcctctgggtggaccatgcctaagacattccattcagataagaatctattttgttggtgaagtatcacagggctggcacttccaccacctctctcagtaacccaggctggtttctgacattt

SEQ ID NO: 24701 - DNA, 1056 bp, Homo sapiens
ttttaaaatttcttttgtagaaacaaggtctcactattaaacaactccattctgtcaacagcagtttgattatgctggggatcagtgaatcaagattattaattaattgattgatttcagccaaaatagtatatctactttgaatctctagtttgaagtagataaaataagaatttttaaaacaagaataggtattctgatggtgtcagagacagtgtgattgtgtacaaggggaaaagaagaaataagaattgcagttatctaggtaattcaagcagaccacaaatttgcctaagtttaattgtcagataattaatgtaaaattaactagtttgtgttggccaaacatacatagttatgtcagttctccttgtgtctttatttaggtaaacatgagtttgttcttattttaataaacttagagctctcctaaatgactcagtaactcagttgggctgaagagagcacctaggcaggtaaccaagaaatgtcattgtttctttctgtaagctccgttactctttctttctctgtctttctgaactcagggaacagattcatctttgttcagtaaatagattgagcagaaagtaaagcaggaaggatataactcacctatccctttgcagccactgatgcagctacctcttatatttctgtctagacttcaggtggaaagcgcactgaagtacacgaatcacctccagccaaattgcctagatagctttggtaataagtgtgactacttgtattcccagggtaaagggtccagtgggaagccccagcaatagggaagccagcaaaacctatcaggatattatcctttcgcttcctgacctcccttgtctcttgagacaccagctcagcgttcgtttttagaaacaataatcaaagagccccaacacctcccaatatgtccgcttgctgacagggggcgccatatccaacatgtacagcatcatggctgctcgctacaagtacttcccggaagttaagacaaagggcatggcggctgtgcctaaactggtcctcttcacctcagaacaggtgagtcgg

SEQ ID NO: 24702 - DNA, 1023 bp, Homo sapiens
aatgaaagaattgcacaaaatccctggtttttaaaccttcttggagttatggagaaaccctttgagaatctgatgaaagccaccaatatttacaccctgaaaactgcttattcatataaaagatagtgtgtaatttcaggagctgtagtattctctgaagccatccacagacctcaatttaagatccctggattagaggatttctgggttaatcctagttttcaaagtctataattctctatttctgtccacactactctgttgtctagctacgcatgctgtgatcctcattcttcagactcctgcttcgggtgtttactcatactgttttgtccattttcagatgtccttcctacccccttgaccatctttacctttgaatgttctaccctctttttaaaccacaattccttatcactttttatgtctgaagcttcttcagtcagaattaatctttcccttagaaccttataccaaatagcctttagcctgtttggttttacattatagtgattagagggctgtgtatccattgccccttcctcttctcacctattcctcaacagattataaatgtcttgacatacgtgactatgtgcctgtatttgctttgtaactgagtggtgccttgctagtagtagtcaaggaataattgcttgaatttgtcacttaattgtagtgactgtctgctgtgtcccctgctaattgctgagaggattagcccctttctcccaaaaaaggagaaagtggtgcagaaatagaaccacagagggaaaacctcatatagaagatgaactaggcccggtgcagtggctcacacctgtaatcccagcactttgggaggttgaggcaggtggatcccttgagcccaggagttcaggaccagcctgggcaataaggcgaaaccctgtctctacaaaaaatacaaaaattagttggacatggtggtacgcacctatagtcctcccaggtactcgggaggctgaggcacaagaatcgcttgaatcagggaggcagaggttg

SEQ ID NO: 24703 - DNA, 1081 bp, Homo sapiens
ttggcctcccaaagtcctgagattataggtgtgatcttccatgcctggccgaattgcagttttgattgtgagggaagaagggaagaaggaacaaataattgtgagatgaagcatcattgtgcatatcagactggtaaaggaggagctaggcctggcatggtggctcacgcctgtagtactaccgctttgggaggctgaggcgggtggatcacttgaactcaggagttcagtaccagcctgggcaacctgaagaaccgttgtctctacaaaaaatacaaaaattagccagatgtggtggcatgcacctatagtcccagctactcaggaggctcaggcgggaggattgcttgagcccaggaggcagaggtcgcagtgagccaagatcatgccactgtgctacagcctgggcaacagaataataaattgtcttaataaataaataaataaataaataaataaaattaaaaaggctgaagttggctactgcctgctcacccagcttttggtggcagtggagataatagatgatgtggcaggagaagggcacagaggtattcatgcatggcctactctgaaattgtcaagttgtttgggaaataaaagacatcatgatggaaacataagttggaacctgattatggagagccttaaataccacggtcaggacttccgatatattttgagcagttgaggctgtgataattgtatcagtaaggggttttgggttcaaatggtaaaaactagctgtcaccatcataagcagataacatacttaatgatatggattagctcatataatcaaggaaacagctgaagaaccagatgtagaaaggacaggactcagaaaacctagggatttagataggaagaagtatttggcaatgtcatcagcattcattctactaaacccatttttgttttttctctgactcccaaggtttgcagccatgggcaagagaaattggcctggctttgaccatgagccattcccttggtttgggcagggcagacactctgattgacaatcctaccagcactgcacacaacagcagagaagtaattccccaaagggaggaaagag

SEQ ID NO: 24704 - DNA, 1032 bp, Homo sapiens
atcttggctcactgcaatctctacctcccaggatcaagccatcctctcacctcatcctcccaagtagctgggactacatgcacataccaccacacctggctaatttttttgtattttttgtagagaaggggtttcaccatgttgcccaggctggtcttgaattcctgggctcaagcaatcttcctgctttggcctcccagtgtgctgggattacaggcatgagccatctcacccagccagtattcttcttttgtaaaaaaaaaatacatataaaaaaacaaacgtgaatattctccattatttacaaatgcttttatactcaaaactatgggaaattttagctggagatgtctacggtagcagatattccaagtgtctgcactcagattttctgtctgaaaatgaagcagcagcttcctacaagtccatgcagttaatgatcagcataccttaacctttgggagggctgacttttaataggtcatctcagtagttttataggcccgtcagtgatgtcagtgaatgatcttacagcaccatggtgtgcatcgtcaccatcttgtttctgtctagatgataattgtccctcttgtaacactcaccatctgtgtatattccttaacctacttagttttcaggccaaaggtttaaaaatgaagtactaggccaggcacagtggctcacgcctataatgccagcactttgggaagccaaggtgggtggatcacctgaggtcagaagttcgagaccagcctgaccaacatggtgaaaccctgtctctattaaaaatagaaaaagtagctgggcatggtggcaggtgcatgtaatcccagctactcgggaaggtgaggcaggagaatcgcttgaacccaggaggcggaggttgtagtgagctgaggtcgcaccactgcactccagcctgggtgacagaatgagactccgtctcaaaaaaaaataaaaataaaaatgaagtactagtagtagtcaaactaccatttactgtcgcagcgctcaccccaccttttgtgccct

SEQ ID NO: 24705 - DNA, 1030 bp, Homo sapiens
cctttgacaatgcctgctgtcctttcagtgctgggaggatgtatgatctatgccgtttttgtcctaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctccgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacat

SEQ ID NO: 24706 - DNA, 1046 bp, Homo sapiens
tttagtgctttttatacttccattttaaagtagaaatgattattttgttttctaagttttgaatactcttagatcgaaaacaatttttattcaccaatgctctagaaagattaaaattatgtatgtatttaaatagggatatgtccatatggggatatagaggaaatttttttagctatttattttttaaaatagatcactttgcttttataatttaaataactaaaaaatagtttacttataaaatataatattttggttttaagtataaggaaactgacccaaataaataaacttctcttcattcttttaaaagatacttgagctgggacactcctcaagaagtcattgcagttaagtcagctcagaacagaggctcagcagtggcccggcaggtatacatatttaaacattcaataaaatgaagactctttttcataggaatttgtctgcagatttgttatgaaaaatctaatgatcttttatttctgaagcatgctgtaaaagataggattcacggcaacctggatgggatcggagaccattattctaagtgaagtaactaagaaatggaaaaccagacattgtattttctcactcataagtgagagctaagccttgaggatgcaaaggcataagaatgatacaatttactctggagactcgggtgaaagggtgggaggtgggtgagggatgaaacactacacattgggtatagtgtataccactcaggtgatatgtgcaccaaaatctgagaaatcaccactaaagaacttactcatgtgacccaacaccacctgttcctcaaaaacctattgaaataaaataataataaaaatattttaaaaaagaaaagttgataggtagattttttttttctgaagcgtgctatttaaagagatttttctcttaaagaattacccaggatttactagattttataaagtctggaaatttatatcaagaaactttttgtttctattggtgacttatggggaaatactatggaaagcatttattgagcacttaaaaaatagatatagact

SEQ ID NO: 24707 - DNA, 1049 bp, Homo sapiens
tattgcctaggttatcttccagggtttttatagttttgggttttagatttaagtctttaatccatcttgagttaatttttgcgtatggtgtaaggaaggggtcgagtttcaattttctgcatatggctagccagttatcccagcaccacagggaatcctttccccattgcttgtttttgtcaagtttgtcgaagatcagatagttacaggtgtgcagtcttattaatatttctgggttctctcttggtttatgtttctgttcttgtaccagtaccatgctgttttggttactgtagccctgtagtatagtttgaagtcagatagcatgatgtctccagctttgttctttttgcttaggattgccttggctaattcagcctctgttttggttccataggaattctaaaatagttttttctagttctgtgaagaacatcagtggtagtttaatgggaatagcattaaatatataaattgctttggccaatatggccattttaatgctattgattcttcctaaccatgaacatggagtgtttttccatttgtttgtgtcatctttgtagatctccttgtagagatctttcacttcctctgttagctgtattcctaggtattttattctttttaggacaactgtgaatgagagtttgttcattatttaactcttggcttgactgtggttgttgtataggaatgctagcaatttttgcatattgattttgtatcctgagactttgctgatgttgcttatcagtttaagaagcttttggattagacaatggggttttctagatacaggatcatgtcgtttgaaaagagggatagtttgacttcctttcttcctatttgaatgccttttatttgtttctcttgcctgatggctctggccagaatttccaacacactgttgaataggaatggtgagagtggacatccttgtcttgtgctggttttcaaggggagtgacaagatgtcttttttcaaagtgggaaactaggatcagtgaattaaaaagtcatgaactagtcaatgtcagagtaaacaat

SEQ ID NO: 24708 - DNA, 1061 bp, Homo sapiens
gttcatgcaacagaaacttgacttagggtgtgcatgcagatggggtgggactactggaactgtaggagaggctccttttggcattccttgtaatattaaaatcacaggtatggctactctatagtattttttcaccttaaaaaaattaagtggtcatataaatagttattaattatagtcatccaaatgtttttctcatttatttaaaaaactcaattcattttactcctatacatcatgtgccttgctattcaataatgaataagcttcgaggaaaatctgtcagttattcattgaaccaaaggcctggggatgctgagccttgcttggccacagacctttagcaattcactttacttttctgatccttgatttccttatctgcaaaatgagttgcagcaaatgataccatcttagctctcttataacttagtattttacaattcgatgaaatttaccccctctctaagaaaggtgttttccaagaaaaaatttttaccatgacatctgaacatagagcttagacacagacagaacttcccagtatacttaaagagtgccaaatcacaaaaagaaaattatatacaagtctataaatatagtaaaaatgttctatatttagcttatgaaattcagttgttagaaaagaaatcaactggccaggcatggtggctcatgcccgtaatcccagcactttgggaggctgaggcgggcggatcacttgaggttgggagtttgagaccagcctgaccaacgtggagaaaccccatctctactaaaaatacaaattagccaggcgtggtggcacatgcctgtaatcccacctactcgcaagggaggctgaggcaggagaataacttagacctaggaggcagaggttgtggtgagccaagatcatgccattgcactccagcctgggcaacaagagcgaaactccatctcaaaaaaaaagaaaagaaatcaactattactcaaattcagtagtagtacattaaaagaaatagatcatgactgttcagagttcatctcaggaatccaaggatggtttaatgtttacaaat

SEQ ID NO: 24709 - DNA, 1032 bp, Homo sapiens
aaaaagaaggaggagttttaactgggcatagtggctcatgcctgtaatctgagcactttgggaagcgaggcaagtggatcacttgaggtcaggagttcgagaccagcctagccaacatggcgaaaccctgtctctactaaaaatacaaaaattagtcaggtgtggtggcgagcacctgtgatcccagctactcaggaggctgaggcacgagaatcacttgaacccaggagacagaggttgcggtgagtgagactgcgccactgcactccagcctgggcgatggagcgagattttaaaaaaaaaaaaaaaacagaaagaagaattctttttgcactggtataggataatttccaggatgtgtactattaagtaaaaaaaaaaaaaaaatcggtgcaaaactgtgtatataaaaatcttcatttgtgtaaagtattgtgtaaagtattcatactcatgtattaaaggaatatatatatggtgatgtgcttttggatttgcttggaatatctgaaaggacacataaaaacttgataaatcggaagagatacagatcaaaggaagacttagttttcattatatcttctgatacttctaaaatgtagtgcttgtattacctatgtgacaaagtggttctgtgtgtgtgcatctccttgagatgttcagaacttgacctatatgccattttacaaatgaaccataatttacttaaccagttccctactttggacatttagtttgtttctaattttgtgattacaaatagcatatttctataactattagtgatccttgcctgaatcagttatgtcatgtgatttgcagaatggcagtttttaaaactctgttactgcttttaccttcaatagctggcatttttctagaaataaaagctttaactcatcagctagagataaactgtatttccttccaaaaggcaagttaaagacttatttcttccctttaattatcaatattcagagcaaggagttggtataatagtcacttttgatgccagcaaaatgttttacagac

SEQ ID NO: 24710 - DNA, 1049 bp, Homo sapiens
tttgtgtgtatcacccataattttaaaacgttaacatttgaaaattcttatagcaacaagaattttatagtttttttaatctcaccaatctcccagcaaggaatctcatgtaaaacctctccacagtgggaatcaccaatggaatgtgttcacattgcttctgaaattgctggtggaatgtgttgttggttctgcttctccacggcttgttgctctttgccttccagagcagaaccagatggaactctggtggtcacagtgtaggtaaattgaagcactttgaatttttaaggatattcttaagttatttatggcagagtaggtagaaatggtacgtggtaaaacaatggaaatttctacccttcgaattcatttttattttctttttaaaaatggcttaggcgttgatttgtcatttaataaacatttattgagggcctaccatgtgccagacatgactaaggacacaatctcttccctcaagttatactcttaaaggaaacatgtagaaaaataagatgcaatgtattaagtacagtgattgtgataagtgcaaaaagtgagttaaggggggagttccatttttattttgtattgctgattatgttttttgttggttagtttgtttttcaagacaggatctcactgtgtcatccacgctggagtacagtggcacaatcacagctcactgtagcctcaacctcctgggttcaagtgatcctcctgccacaacctcctgaatagctagcactatagaaaaatcactcaagctttaattgttgatattttttctcatttcatgtggacatgtcagtgcaacactacttttattttatatttatttatttagagacagagtctcactctggtgcctagcctagagtgcagtggcacaatcagagctcactgcagcctcaacctcctgggctcaagtgatcctcccacctcagcctcctgagcatctgggactataggagcgcaccaccatgcctggctacttttttattttttgtagagatggggcctcgctgtgtttccctgggtagtct

SEQ ID NO: 24711 - DNA, 1048 bp, Homo sapiens
taaagttctcacacaagtgggcaaaataccttcttttaattcttgatagaacagaaataaactgaaatttttcttaaaaaaagattttactaaatacaaaaaatgaacaaaaaataaatatttaaggtaatataaaattgaactaactatctttactcagcttttgcatgtctaggaatttatccaaaggaaataattatgaatgtcaattaaaatttgatcagagaagcagaacaactatgagtgatccagagggatttgtgtagaggacagaccttacacattaagtcagcgtaggagctggttgtgcagtctttgtatgactgtggtcctttgtgtggtactgagcctgaagtcagcagggcccgtagttaggaagggaagatgcatgtgaagtgggagtgagcaaggacaaacggggattcacaggttgagctaaaactgataaagtgaaactaaaatttgcatctgcctctcattgtttccaaacaaccaacttcaatgatgtggaagacttcgagatgatctaatgcattccaccatggagctgcacatgtacaagggccaaaatctggagaagttgaaagctggatctgttggacccagatattaacccatggagatagagctggaattgctactggtctggttgctggctcctttaacaaggtgaggcagcatgacaatgtatgtgagctgcaatggtgcctgaccctgcaccagtcttccaagcctaagcatgattgctgctactattccaccatccaaatctcatgcaatttttttatggttctcattagctcagacgcatgcagggaggcggggtctgggaaatgtaaagtccagtttacgtgacaccatacaaagtcactgtgtaacgcgtgtcacaaattaactacagagatttttattgcagtattacttgtgataataaagaataggatacaacctaacttccaacaatacagaaatggttaaaaatgtatgaaacatccacacattagaacataatatattacaaagggggctgggtgtggtggctcacgcc

SEQ ID NO: 24712 - DNA, 1515 bp, Homo sapiens
tcatcctgtttgtaattggatacatctcttatttcataggagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagcgggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgt

SEQ ID NO: 24713 - DNA, 1032 bp, Homo sapiens
agtgatgttgtgtccttcatattgtatcatattagtagcacatctctggctattgagcaatgctaagcttgattattgggttacaattgtgataacctgatctctccatcataattagccccttgtgactaataggtaatatctgagggtgatacttgggcactatgtgactattaatttctttatcagccttttatctgatggtgttaatactcatcgatgatcctcatctaagttatttaattaagagttgcagcattgtttttgtaattctgccattctttctgcatttattggctaaagctcttctgtaaaggggagctttctctcaataactaggggttttggttaccctaaatgttagaaaagcaggagacatgtttacttttttgctttaattactcatagtcacctctaggcatggcagatgagtttttgcatgtattttatctcttttttttattttttgagacagggtttcactttgtcacccattttggaatgcagtggtgcgattttggctccctgcaacctccgcctcccaggcttaagcaattctcccacttcaaccacccgggtagctgggactacaggcatgtgctgccaccacacccagctaatttttaaatttttagtagaaacagggtctcacaggccaggcacggtggctcacacctgtaatcccagcactttgggaggctgaggcgggcggatcacgaggtcaggagatcgagaccatcctggctaacatggtgaaaccccatctctactaaaaatacaaaaaattagccgagtgtggtggtgggcgcctgtggtcctagctacttgggaggctgagacaggagaatggagtcaacccgggaggtggagcttgcagtgagccgagatggcgccactgcactccagcctgagtgacagagcgagactctgtctcaaaagaaaagaaaagaaacagggtctcgccgtgttgcctaggctggtcttgaactcctgagctcaagcaatccacccacctcagcctcccatagtgtt

SEQ ID NO: 24714 - DNA, 1023 bp, Homo sapiens
caggtaggatcagttataggcaaacaaaatgatagggaatcataattcaaaacaggcaagactactataaaaggaggcatgggttggaacccagagtcaacagatgcaaaaagcaggagggttccctggggtactggacagggtgactcattagggagctgattgattcagaatagctacgcaagttcccttccccaaccacaagctgagtggtggacaaaagcagtgtctctggccagcctataacaactgagtgatgccaccgaagctgggaaagcagggcagtgcccccagacacttgctgacccgcaagaggagaacagaagcccataccctagttcccccttatccatggttttgctttccacagtttgttacccatggtcaacacagtcttaatatattacatggaaagttccagaaataattcatgagttttacattgcaggtagattctgagtactgggatgaaatcttgtaccatctgctctgtccttcccaggatgtgaatcatccctttgtccagtgtatccacactgtctacgctgcctgcctgttagtcaatcagtagctgtcctcgttaatcagatcaactgtcacagtatctcagtgtttgcattcaagcaactcctatttaacttaataatgacctcaaaatgccagtagtgattctggcaattccgatgtgccaaaaaactgtaaattgcttcctttaagtgaaaatgtaaaagttcttgacaataattattttaattgtatgctgaggttgctaagatctaaaatatggcttagatctaaggtatgaacaaatcttccatccgtgaaattgtgaagaaggaaagataaattcgtgttagttttgctgtgcaccttaaacttcggaagttaccccagagtgcaggtaggcacttagttaaggtgtaaagagcattaaacttgtggatggcagacgtgaatggaaacgtgttccaactgacagccactgggtttggtactattcatggtttcaggtatccactgggg

SEQ ID NO: 24715 - DNA, 1202 bp, Homo sapiens
acttccggcccgggagcgcgcgggttgattcgtccttcctcagccgcgggtgatcgtagctcggaaatggcgggtaagttaccgggaaaagtttaccaaggggaggaggcggccagatcggggatagaacgccgagacggtggtgacaatgcccgcctagaactttcgggctgtagcctgggttccagaaggcctgcttgggaccggaagcgcggaactctcagcccagcagctccttgttggcggcggtccgcgcccccgcccccaactgcttggggttctgcgccttctgccagcaatccggcccctaccgagggccgaagacgccagggaaaagcgtcatgatttgggctcgtaaaatgccacatgccttggggcctgtttctcttcccattccttttgtccactgctgcttgcttcagctcttgtacatctggtcctgttcccgccagctgattttaatgctcagatcctcctcctcttccaggtctccgtctaccttccactacagtcaacttctgagctagcgcattgctgccttgccctgctctggcgctcccacttggatctcgactgacttcgtagtcgtctcgttaatctgtcacactttagtattccgaggatcgtatttagatgccctttgagaaagactttgttcctgaactgctcccttctcttttagggttggactactataatacaattctcttgtgtacattctagagacccttcaagttacaacatttaataatgtataattgctattactttgtacgtgtattaaggctgttttggtgtgattatttttttcgattacttatcttttgaagttatggacagtttctttttcctgagacagggtctctctgtcgcccaggctggagtgcagcgatcatagttccgggcagcttccaactcctcgtaggctcaagcgatcctcttgcctcagcctcccgagtagctaggactacaggcatgcgccacaacattcggctaaaaaaaaacaattttttttaaccttttagagacagagtctggctgtattgcctcaggccggtctggaactcttggcctcaagccatcctctcgcctcagcttcccaaagtgttggaatgacaggattgagccacttcgctggcctttgttgcttttatcatctctttacagggcattcctcatagtctctctacattaaccattcc

SEQ ID NO: 24716 - DNA, 1022 bp, Homo sapiens
catttctacaaaaaataaaatattagctgggtgtggaggtgcgtgcttgtggtcccagctactcaggaggctgaggcaggaggatcacctgagcctgggaggttgaggttgcagtgagctgtgattggttgtgccacaacactccagcctgggtgacagagccagaccctgtctcaaaaaacaaaaaacaaaacaaaaaagaattgggggtatagggagtgaggtaggaagataagtggtgatggtaagatggtacaatgtttgaaatagagattaaggaggtataattgtcaataatgataaataaaggctagggcacatcatgggaataagtggctaaggtacagtaaagacaaaattcttggggaggaatcaaggaactccaaggctggattggaagattcattttcattaattttgaagttaccaagatttaagtcagatgtagtgttggaaagtgcaacagtgagcctggagctaaattattcaaagaatgagggagagaggtggagcatgaactttaaagtggtttattcttagtgtgtggggagagagacattagtctgaaaccagcaatgaggagcaaggaggataccttgttctagcagtatgaagacagagaaaacaaccactacctgagaggtctgtaagacaggagcatccttaggggagagccatgtgtgccaaagaactgttagcgcaagataggagagcatttgataaagaggttggggatatggagaattttggtggtaactgacctctaagtttcacagtggtcacaatgagttgggaaggggtgggaaattagatgagtatttttatactactgtataatacagggatgagaatcccagtgataagggaatttttaagaattggactgctgttaatgggaataaagagtgtgatgggattaattatggcatctctagggaatatttaatgttgagatacctcattttgcagattgtttgtgctgatgggaatgttgccagcacactggggccactcttgtgttt

SEQ ID NO: 24717 - DNA, 1049 bp, Homo sapiens
aggcttggtagctgcttgcctagccaggtcctaatttaacactacttctctcatttgaaatgccttctaatactggtaatggtagcagcagcagcaacagtagcaatagtattaaatgtctgacatttagtgagtacttatacaatgtgccagttttataagtagtttacatgtattaacttatttaacccaaacaacattcctgacttaggcaacattcctgagttattctattttatagatgaaaactgaagcacattttattgtagattttttttttaagtatagtttaaaatcttgaaactacccatgaagttaaacttgtttatatgtagggttaatactttttaatgactgcaaaaattcattccattattgctattttttccatttcagtgaaactgcttttggttacaagggtctaaagatcctgttatactatattgctggtagcctgtcaacaatgttccgtgttgaatatgcatctaaagttgatgagaactttgactgtgtagaggtaagaacagaaatactttttaaactgttttccaatttaatttattttaaaataggttttaggccaggtgcggtggctcacacctgtaaccccagcagtttgggggaccaaggggggcagatcttttgatcttaggagttcgagaccagcctggccaacatagtgagagcccatttctcaaaaaaaccacaaaaattagtggggcgtggtggcatgtgtctgtaattccagctactcaggaggctgaggtcagaggatggcttgagcccaggaggcagaggctacagtcagctgagatcatgccactgtactacagcctggatgacagagctagaccctgtctcaaaaacaaaacaaacaaacaataaacaaatagtttctaaaaattaaaggtttgggctgggtgcagtggcttgtgcctataatgccagtgcttttggaggctgaagtgggaggatctcaagcccaggagttggaaaccagcctggacaacatagtgagaccctcagctacttgggaggctgaggtggga

SEQ ID NO: 24718 - DNA, 1050 bp, Homo sapiens
agatggttgaaaggataggaattagtagcatgttgtattagccttttgtagtgtattttgtcctaagcatcttaatttccctgttttgaatgctaagtagcaagggtcttggtttagaactaatacccatcatgcatgtaaacggtatgaaagagctgcttagtaagttaacacaaagtgttcttgtgtcagtccttgtggaaatagatacaatacaaacattacagctgaactcacggcaaactccattaagtaaaaacctggcctcattgttcaggaaaaagtttgaatagaatacaagctcattttgttgaatgtaatgtcaggcttttagggactgtattgagggataaggttttgttaagttgagaccaattcattaagttttattgcctggtgagaagcagcaatactttattgtaagacttcatcaaatattcatggttaaagagaagtagtaaatgtattcaatcaagtggtcttttgggattttgaaaaggattatgaagtctgctcagctgataacattgatagaggttgtttaacaagggtaattttaatctccgagtttagttttgttgtccagtcttgtctcttttttactgtcacaaatccaggtctgtaagaattgtgtcacattctaaggataaaagaatgatatatccattcatataatttatgttatttcctaaatatgtatattttaagttatcatcttagtttgagtttggcatatgagggaattgtgacccatctagttgtgagattgctattcatttggtcagactctagtctcatctcaccactgctggtgatcttttcatgtcttggataatatgatttctttgacacatataaaataataagcaaccttttgccttggccagttcagactgtcatgaaggggtatagtcagctgtttctgcataatggaaatgtccatagcattgcccttattattgtacttggtatcaggtcacctgccttctcttatttacttttatattatgctcatctcagttttgtgtgatgcagtttgtgcacaggaag

SEQ ID NO: 24719 - DNA, 1140 bp, Homo sapiens
agtgctatgttgaacactagattgtgctttattttttccgcccaacttcacgtttccatgcaccaaaatgttgatgctataaatattggatgccacgcttacctgacaggcttcttccatcccacctgggcgcgggggctcagagcgagcgcgcgagccgcggctggagcccgcctctcgcggctggagaggactcagccggccgcgggttctgctgcttgcccgggtgccctagccgcttcccagccagggctcccgcagtcagccccgcgcgcgcacgcgcgctcccctcgggcggcctcgacgcctcagggcttcggcagggctgcgactggccggctccagcgggcggggcggcgagcgagtgctcgcggccacgtgaccgacgccaacatggcggcgcccagtggcgtccacctgctcgtccgcagaggtaagcgcgtggaggagagccccgtgagggttcgcacggttgctcactaggtacgcacccgggtccaaagggatgcgcacccgcgctcagacttctcggcgcacacgactgtactttcagtgtttacgaacacacgcaggcacacacgatgacacattcacacaccacaggatcacacatacaaatttgttcactgatcacccgcctagaacacgtcaccacgtggcatcttttcgcaattactccttgagatttgcgggccattgtctgaagtttttttccccaacttcggttgtatcattagtgtaaccaacatttattctgtatgccgagcaaggaaacctatggtaattctgaaatgcatctggacacccggttcccttccctagagcttttatgcaggcatgctttttggggacttgcaaaatgtgatggttttcttccagtgacttaaagttaagaagataagaaaggatgactgggtagttctaagtaggttttatcctgcgtgagtgttgagattttagtaaatatacaaatgcctttgcagcagaattggggaaatctttgttggatttgaactaggtgctgaatctttgttggaaagaactagaaagtttttccaaggacgggggaagaggaaaactatcatattttgaggagctacttaagcgtcaggcatgtaggaacagttttgtgaggtaaat

SEQ ID NO: 24720 - DNA, 1047 bp, Homo sapiens
ccaaccgcaaaacaagaatagaatactatttttaaaaactttcatggggctgggcatggtggctcatgcctgtaattccagtactttgggaggtggaggcgggaggattgtttgaactcaggagttcaaaaccagcctgggcaacatagagagacccctctgtctattgtatatatataaaatatatacatattatatatttccaaggaggaaagggcctagagactatatatatgtatataatctccaagaggccaggtgcagcggcctcttccgtcaagccttagcacctataaactttataaaacctactctctgtgaattgtgcatgccactaatcttcatctagcaatacatttctgctcattctttaaaattcatctcaagtaccatttgatttagacgagccacctcttggttccagtggcttcctgatcatacctctagtgctatattgtaaccatcacttaattagttcatgattttttctcttctagactataagttacttgaacatatggatttgagtcagtaggtataggtgagacatgggaatctgcatgttcaacaaattcctcctggcattctagggctccaatctcaggtatgtttgtttcttttttttagacaagagtcttgctctgtctccaggctggagtgcagtggcgcaatcttggcttgtcgcaacctcccgggttcaagcaatttgcctgcctcagcctcccaggtagctgggactacaggcgcacgccatcatgcccggctaatttttatgtttttagtagagatggggtgtcaccatgttggccaggatggtcttgatttactgacctcatgatccacccgcctcagcctcccaaagtgctgggattacaggcgtgagccaccgcgcccggcctaacctcagttttaagtggtttttaaaatctacttcaactctgaaatatcaaggcttttcctccctgcaatttaactggtattggggagggcaggtaaagctttcgggtagttgattaaaaacaacaacaaaaaaagcaggggccgtct

SEQ ID NO: 24721 - DNA, 1030 bp, Homo sapiens
ctcgggaggctgaggcaggaaaatgacttgaacccgggaggcagaggttgcagtgagccgagatcgtgctactgcactctagcctggtgacagagcaagaagactctgtctcaaaataaataaataaataaataaataaaatgcattcctccctccatcatacttgaattctataatcctaccttcagatttaacctataaaggaaaataaaatgcagcttttagaaatggatgttattactgaatatgaaaatatttaaaaccataacctagatttacattccaaatacaaattttaaatatgaaaaaatgtgctgcaggatccagaggacatagagcaatttcaagagatgttcagactgcacagtgtgctcttccatggagtgcaggaagaagttgcctataattttcagcgttcaactcagactaggtgctgatagaatttttgtaacactaaaaataattcttattattacctttgataacagtaactattctagtattcataaaaaataacatgtagatttactccctaagaaaaccctatatagagttgctgttaggtcatcaacagtagcaatactacgatcatctcttgcaagatcaaattagtataaagcaactcctcactgttctgggctctcctactcccctgaggtttctggtgatttcccactggtgtctctaaaaacatcagattagtccacttgccccttgtagtaattagtacacacctgagtcttgtttccccaaatagctttaccaaaacaccgtgtgcagtgaatcctgaatgaatgatagtgtgtgggagacggagggactatttctgtctctgaagatggtcatcatgcatcaaatttgttgtaacattggtggtagcaatttggaaattagatgtagttataaggtatcagcagtgcttttgtcaagaaatgaattatataggaaattcaagagaccatttctacattgatctacattagttactgtagttcgggtatcctttctgtgaccctgaatataatagaga

SEQ ID NO: 24722 - DNA, 1978 bp, Homo sapiens
aaattgattatgataaaacagaaattttgaagtattttacttctaaatggatacaccaccaccatttaatgtttgttaaagcagtgcataatctaaatgggggttgtgcattacgtatgtcttttacttcttagattttaatcatataagtggtaaaattcaaatgtggcaaatttttcttatcaactcttgttttggttcttggcaaaattaaggtaataaattaagtgcatcttttgaaataaagattagatttagttatcctgtgtagtcctccttcactccaaattatcactgcatcccattgggtttgtgacagtagtcattaagtatttatttttattttccttttattgagatctgtctatcaccatttttttttctgtttacgttttagtcgacctcttcaggatggagatattatcaacattgatgtcacagtgagtaaatcatataaaaaattgtctttgatcaacttcagaattgctggtagcaacaggaagagtggattgaaaatgtgaactgcaccagtggaagtgctgtttacttctagacccagacgcaagcagctggtttccttttttgtctttaactctgtgtttattccaagtaaacccaggcctgacttgaatttagggctgcaatcagatgcactgagatcaatgttggcctaagtgaaatgtcaacccaatcctgctatgtgtcatgtttttgagaaggtgtaattgttattgatccactgtgtagttaacgcagagcaccacagcactgggcagctgctgaagctagatatgtatgagatgagctaacacgaagaaagccagcatttttccttcactctgccaagattgatcttcctcttcctgctgattttgagtggggcctgtcattatcttactctgtcattaggggctacattggcctgtgtatgtcagtctatttggacagcaactcttttgctagcagtgttccctagatttattaaaatccctgaaggtaacgttgagttccatttctggtatagagagccttgtgctcaaagtaagcagagtggtttttttgtctgaacttaagttttcaccaaatggttaatagcctttcttttaagtaacaagcctaagtaatttatcatagggacttcaaattgtacaagatgtagctttttctcattttcttagccttttaccattctcagacttggattatatgtgcttttacatttctgtttattaaagaattttgtaatgatacctttggattacctagattataaataaattctgtacatctaatgattaacaaatacattttaaataaataaacaaaatttaaacatcttaggagaactagttgaaatgacaatattcagggaatacaatttctattaataaggaagtgtttttaagaatagtatctagaccatgaaactgaagtaggagtgggaatgagataaaaataggaatccaatggtggaattcagtctgacttttagtttaagttaactaaaccttttttcttcatatcaatcatatgaggagatagccaacgattctttcattgctgatgctatttcctgtatcattttatcctacttaaaatgcttgaacacttgcaccacatacatcctgttggtatctttccaactcagaatcatgtggaaggaggtattttatgaagtatacctaaaacagagttcttttcatgagacacttttattttggattgtacctgattttacggttttacatctattttctcatctagtcaccctatcatgaaatgttaccattttaatgttttgaatgaaatcaactactcttccctactgtttccagtgtgtccaaagaaaatactctattccttttctaagtttcctgaatacttaataaacagttttgtatttaacattcaaattacttcacaattgcaaaacttataaagcaaagtgaaatatttccaagtgtctagaaatgtgaag

SEQ ID NO: 24723 - DNA, 1050 bp, Homo sapiens
cttcagtcacccttctttattcacccttctcaggtgattttgtcaaagtcatttgagattttcctgtggactatgaattcagagaaactactcattgataatcagaggaggagataacttttgcccccaatatctttgtaaatgttgagaatttcaaacctgaaggcagagaaagcatggctttgggccatccacttcactaaaatgcaaacgttccttatccatagttaagggctactttccctcggaagcttctctcttgactgccgactacctcgttgctggagaacttcagtggcctaacctaagacggccccttcttggctgagggccactgttttaaagctttgcaattttagggagcggtctgggtggagtcttgtaactgcaccccgaaacatttcccacgcactggctgcgttgatggctgttggtgtctgcggttctctgtttcggcccgtgaaggcagaagcattgcttgtgttgagaaagccctgactcaccccgcagcctctggctgtggtttgctcacacgtgtttctagacctctggggctggcattttttgtgaattatttcaagttcattcctgttcctcgggctcacctctgtgcaagtgcttgcttgccctgcatgcctaaaatggcagaaggacctcaactccacctgataacttgtcagtgattgtttgttctaggcttttccagcactactgcattatcatctccatgtttgtgcaacgtaatcataaagatacgttgtacttctctggaactttcccctgaggaacttttgaacatctaaagacgatagttttgtaatccttgtaattttccagtctgaggtaaatgtttctttgttaatttttaaggaaatgactatgactttgatgatagcaccctgagcttttaattttaccgtaaaacagaagaactctgtatcctgagcctgtgtagaaatgaggcatatcatacttataggcgtgtggatatgtgtacagacatctttcacttaatgatattttggcaaagttgactacaggctatttgtc

SEQ ID NO: 24724 - DNA, 1027 bp, Homo sapiens
taattcctcccaccaattatagcactttactcagattaactaattaatcctcaccatataccccagagacaaaattaaagataattctttcataactgtaaagcaccttttatctaaggattactaacactgatgcatttgtctcccatgacaacatcacaagtttcagagatgacaaggaaaatcttcattaccatttcaagaactgggaacaaagaaaaatcccgttccaggacgcaaaggaggagatgcgggtagctgaacagaaacttttgaagattaccatgggaatacacctgtgaacttccaggtggggctatgtctgcatcgggtcagttttctttatgttgtttacaatttccagggatcatgtccacgataaagaacaagagctggttcacaggctactgaaacatatgcctgacttcctaaagaaccttctgttttctacttgcccactcgtctccatcacgctgttgccctgttgtctctatttgccaaagttctgtttgtgatctagatgaaatgaagctgatagccaaaagctacaggaaggagagaacctgaaaaagacattataaactgagaatccttaaagaggagagtgggagaggcagggtggagaatgggagagaggaagggaaagaagtcagtctgtcaaagttctggaatcctcatttggggtaaacgaagggaaaagaggggtctgcgctctgtggcccaatattaggtttgctatgatttctttgtaattcccttggcagcagattaattttacttgacttggcagcataggcaactgctactgagctgcagccaaggctgggaactatatcattgtgcattataccatgggtgcttcataaagggggatctcaaaaacactcagggaggcacaaatggtcattttggatacacttctttcatttggccaagcagttgcatttgttctaagattattagtgcaaacaacatggctgggtgctggtagtgatttgctggtttctcttcatggctgacagctatg

SEQ ID NO: 24725 - DNA, 1046 bp, Homo sapiens
cctggctaacacggtgaaaccccgcgtctactaaatatacaaaaaattagctgggcatggtggcgggcacctgtagtcccagctactagggaggctgaggcaggagaatggtgtgaacctgggaggtggagcttgcagtgagccaagatcgtgccactgcactccagcctgggcaacagagtgagactctgtctcaaaaaaaggaaagaatgttgccaagttggaggcaggaccaggcctcttggctcctggtttattcttcttcccaccctatttactagcacatattattgaaagctgcccaacaaaactctatactgatggaaatgttctggagctgcagcatccagtatggtagccattagtcatgtgtggcggttaggcacgtggaatatggctggttcacttgaggcacagagttttaaatgtaatttaaattaatttcaatctgaatagcctcacggagccagcagctcccatatattgtacaaagtgaatctaggcttttaccttcatgagttgctggactaggaatcagagtttttcaggagattttatttgaccaggttaaattttataaaagacagttccatggccttatgaactagataaaagtaaataggaaaagttctctatcactgaacgaaggaaattatagtagaaagtggaattatacttttatactcatttagagtgacctaacctgaggagcattgggtccctaccatttaagggttttatggtgctcagagtttgggaaaatgacagcaatcattctttcatgatggtgtattcgaatttgtattgtgattcaccccacagatccaaaggcctcaagtaaatggcatttgttccataaaatttactgtaaaaggcagaaaaatacccatagtatatctatattttatttggatttgtgcttttatttagagaatttattttctaacctttgtctcaataaactgccgaagtcaatcttttgcctcttttggagttcatattctcctgcaggaagaaactacccaaagctacaatcagcaatgtat

SEQ ID NO: 24726 - DNA, 1032 bp, Homo sapiens
ccactgcactccagtctgggcaacagagcaagactccgtctcaaaaaaaaaaaaaaaaaaaaaaagaagaagaagaatgtatgcatgcatgtgaattggactgtggaatttaaagattttaacacttctctatttggaaagtaaaattcctacccgaaagttaagcgatcttaaaaaagactttaccatcctagagaaaaatgggcgcatgggttggttcgattgtgatgcaagattgtgagaagtgaccacaggactcttgtcatcatcagttgtaaatatttgtgggtatgggttcaaacactaatacattgaagaaatggtgtggcagttctcccccaggtaatactgtcctccgtagttaatgttttcttttcatcactacacagtttattcttaaaaatgctttaagcacatctctctgtactttcatatttttctcttctgctctgtagcaaaatcaccaggacagccaatacaagtggtttatgtaccatcccatctctatcacatggtgtttgaacttttcaaggtttgtaaaatagtattacataacctttaccagtacttttctgaggttaggaatctgctctgaaagccaaatattccactaggttctcctattaagaagtgccatttcacatcagtatcatatcacattgctggagatcagctttttatcaacacagggagacatctccatgtagtggtgagctcagactatggagtcagaaagacctgggtttgaatcccaattatggctcttaatatgtgtgtgaccttgggcaagtcactcaacctctctgagcctcagtttccttttctgtaaaacaagaatactgtccaggattgtttatgactattgggaataacatactaagtgtccagtacagtggcaacgtattacatataggtgctcaatagagttatctttatgtttttataaaacaatatttagaagagtgattctcaacttgctaccctcaaaggaccagaattctttttttggtctggcttttcttgggaggggga

SEQ ID NO: 24727 - DNA, 1035 bp, Homo sapiens
ttgctgatgtcactcctgctgttctttttgagaagacaacgtttattacaattcctcttccttcttatgtgaccagttttaggtgtctacttttgtttaactagagtttttaacttttttttttttcttttttttaagctgtgctctgaagtttcagtgatgtgacttggtgtgggccttttcttacttactgggctgtggtctttgaacttcccattattttcttgatattttccttttcactgtgtgtttagtctctttctgatagtcatattaagaggatgttgggcttcatgacatcactccctgttttttatcgcttcaactttttattctattctgtgagatttccttgacttcagattcccagcccttctattgaacttttatttccattatcttacaaatttccaagaatccttatttttaaaattaatccctttttagaattctgctctagttttattttattgctctaaggatattatttttttttaattaatttgcctctgtaccctgcattgtccgtttcctgagtttccttttgtccgtttctctctcgtttgttcattttaaagagataggcacaaaaaagtcaataaatggcgatgccatctgtttgctgtaaaaacaatatgaatgtatcacttttttttttttttttttagctcagatgctaatgtgtctattttttggttagttgtgtgtcagctactttcccgttaaggtttacagtcaagaaaagacccattggtcttctggtttggggcttaagttgtgctgcagcatgttctttcttgtacctttttctgcttctattagaagtgctttatttagcattttggtctgcagctgctttctattgctattatccgtcattgcatagatcaaggtttactgagttcttagactctcagaagagattacttctgtgctggtggatgggcttaacctcaggaatctgtctttatgatgtaaagaaaaattcataatgacccagcaatcctactcctatgtctatacctcaaaggattg

SEQ ID NO: 24728 - DNA, 1033 bp, Homo sapiens
ttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgtaaaaaaaaaaaaaaaaagtcttaatttaaccagcattaccctctgcttgtaccaattgaatggcagaactacta

SEQ ID NO: 24729 - DNA, 1086 bp, Homo sapiens
gcagtggtggggggtagataggacttagtgtggccccttaaagagcaaggtccaagtgattttctctggtgaatgtcgatgtggatctagtctccagggttagatccaggcaggtaacatcaaagtcagttgataagacctcttatgcctgtgaatggaaggccctgataaaacttcattattaatgttctgcattaatttagcggatgactatagtcatttcacataatctaatacatgaatgtcctgtatgggtgactgctgagggtttaacaaaggagagtccatttatatttggctggtaagatcgatgcttctgtcactactgatgggcaaggatattaacatcaatatctaaaaaaattctgagatttggattgtgatgtgttaaatttctagaccaatttgaggagaatttaacaatagcttttcaatttatgaacatggcgtatatcttttttggcggggggtgaggacagagtcttgctctgagattacccaggctggagtttagtagcatgatcttggctcactgcaacctctgcctcctgagttgaagcaattctcctgcctcagcctccccagtagctgggattacaggcgagcgccatcatgcctgactaattttcgtatttttagcagagacagggtgtcgccacctcaagggatccacctgccttggcctcccaaagtgctgggatttataagcgtgagtcaccgtacctggccagacatagcatatatcttcctttacatagattgcctttgatttctttcattgttactttgtagttttcagcttacagattccgcgcatattttgttagacttaaatctaagtatttgctttttttttaacttacaaatttttttaaaaaaacgtttttcctctccaatgttcattgctaatacatttcacgtttgaatctccagttcagaaaaatcatggcctctggagttttactgaggactagagatagctaagtaacatagttccaccttattcacttggtctttgatgtggtgtccataattgagtaaatggcagtatgtccaatggcaacaccatgaacttgactttgccct

SEQ ID NO: 24730 - DNA, 1065 bp, Homo sapiens
ttctgttctctaagatgtagtttgaaccagccaaggatgatggcttcaacatgtctccagttgttttgccactccagggcctgactcaaaccaaaataagacttgctgttaccctgagacaagccaactgtcattgctttagcaaccactacggctacaggttgttgcatcatgccaagctctgtgttctttctaactagtagaatggagtgggatggtatcgtgatggtgaacccaaaacaatggtactaggaaggaggttggccaaactcagagtggaggctgaccctgtatctggttgtagcagagtcggtcctaggggaacaggctcagcagcagcaaggatgcaaggaccagaaggcagcaggggaaggaaaaggagcaggggataggggaactttaggagcagagtagtgttgataactggcatctggaacctacagtttccagttcagagcagtacaccatactcagtgtatacttacactccaagacatttcctgggcagtgatctagaaatgatatttttaaaaggagctgtgtttcagtgttagactgtagttatccaagcagtatcagatagtgtgcagtttttgtagtaaaaggtaaaaatctgaataataaagtttattaataacagttttagttaatacttgactgacattgagacccttgatgcaaaaaggtaagtagaagagaaggctgtaaacacaagaccatcataccctgtggggaatttacaatctaaatataacaaacatatagagtgagataggagaaaagaaatgggatgataatgatattgctgtactaaagtctatttaggaaatggaaatatatagcaagaggagtcagctacttgggcattgatcaaagaaaaataaacatatagaaggaaagaaaggtcgttttagtttataacattttccttccgattctaggtgattatatagctagtttactcttccacccccaagattctggggtattttggctaatgttatttgcaatgtccataaactcagaagaagttagtattaacggggatatgaaagaacctccagt

SEQ ID NO: 24731 - DNA, 1049 bp, Homo sapiens
gtctaaaggtagttagtctgcagcaggtaaaaacatttcctagaaatctttcaaaatctttcaaaatgcagtcatgtatttgattctttctaacatttttttctttccttggcttgggagattataatatctctggaagataaaaatatctttggcttggggcaaaataatttatagttaagaaactaagtttatttatttttcggattctgagtgtgattagttgctgaggctcatttattatctgaaatgtaagtagttaaaagttttcaatagcctaagtcagatatgtgctacttttcaatttgattttgcttttgaaggtagagtgacattagtaataatgggggtgattaaaaaaaaggaatttatatacctaaaatttctgttgacatactggtattgccagcatagttatttcggagaagagggaagctttataaggaatgaaatgaaataactgttcttgtctctgtagtttggcaatccatatagacacaatttgcattattttaaagatatagttttgaaattaatgtgttgcagggcacagtggctcacacctgtaatcccaacactttgggagtccaaggcaggaggatcacttgagcccaggggtttcagaccagcctggacaacatggtgagaccctgtctctactaaaaataaaaaaattagcccagtgtggtagtgcattcctgtagtcccagcttctcagtaggctgaggtgggaggattgcttgaacctggcggttgaggctgcagtgagctatgatcatgccactgcacttaaaaaaaaaaagaaaagaaattaatgtcacaccttcttttgggatagatcattaatttatttaagaaatcaataaaaaacaagataaactaatttacagagattgttgaaatgtcttatagaaggcacagtaaaatacaacagtatccaatccctttctttctcagctctgaacacttatgaaagacatacaacatcaatttctacagaaaagaaaaccccacacaaatccattcttgcagaattctaaaagatagag

SEQ ID NO: 24732 - DNA, 1031 bp, Homo sapiens
agggttaagataattctttcttttcctttatggtgtaaaatcatcactcctgtttgcagtagccttttctctttttccccttgatccctgccccccacttccctttcaccctctacttcatggtgcaaaattgtcagtaggtaccaggcaagagtaatgtgtttgatatatggccttggttatataaacatctttgaataatatataactatttctgggtgagttgattttggaaacctgtgttcataggatcatactatcacatctcactctatttcttacccttctcacctaatactagatttcccagccctcttcatgttgttgtatgtaactctggttcattatttctgactgtaacagagtattccatagtatacctccatcagatttaacgtctccattcccacccacgataaacttacattgcctctaaatctctactgtcttaatgttgtgggccatggtggctcatgcctgtaatcccagcactttgggagactgagttgggaggacttcttgagcccaggagttcaagaccatcctgggcaacatagggagacccaatccctaccaaacataaaaataaaaaataaattagccaagtgtgttagtgcatgcctgtggtcccagctactcaggagtctaaggtggaaagattgctggagccttgaggaggttgaggctgcagtgagccttcatcataccactgtacctatagcctgggcaacagagcaagaccccggctcaaaaaaaaaatgtgatgggcacctttcatctttgtacatgtgatatggacaggaggcagggaaatactgggtagaagagggtggtccccagcgagggccacaccctcaagcctagacccatggcccaaagtgagaacatgcattcctgttttcctgcccgaatgttgccttttccaaaaccatcctggcccttcccaccaccccatcctgtacccatgaaaaccccacaggccccactggtggagtggcagagcggcagaaaaaggaagaagagaagaagta

SEQ ID NO: 24733 - DNA, 1100 bp, Homo sapiens
ctccctagtagctgggactgcaggtgcactccaccacaccctgctaatttttttgtattttagcagagacaggttccaccatgttgcccaggctggtctcgcactcctgagctcaggcaatccacctgcctcagcctcccaaagtgctaagattacaggtgtgagccacagtgcctggccaaattgctttcccttattttgcttgcctctgaatgataattgtgacctccttaatcatattgttcttttaatgggctaacatctcccttgaaattttatttatgctgcttatatgtgacagcctcaaggacacttctgcttggtgggggcagccctggtcgaagcaggtcctcaacttcaaatctgtggacactttgggtttcctgtggattcctgctcgagcctctctttgtccaggcactttcttcagttctcttttgttccattccctgcaggtgcagggtctctgccctgttgctctaaataagcccaagccagagttccagctctggacttacctgtctggcaagggaagaaggacaagaataaatattctttgctttcatgagctctgtagatggtagtgatataaataagtttgataatggtatacaaaaaaagacaaaaatgagattcatactgacgttggggggttggtatgggtgtgatgatgatgtgaccctacaagatgagggacctacaaggtgaggaagtgaaattgacatttcatcaggaatgttcattctgatcagcagctagggctgaggcttatggttttcagttgaatgtagctgtgcttacagtaggctctaccctctcccagtagacctccaggcagaggggtgcaggagtgagagctgactgttacagtttaggaattttgcaacctggtggtcaaacacagccattatttaagcttaaattatatgccattattgtataaattatataaaaattatatattgaaaacaaaggtaataaatactcaaaaaccatcaattcttaattgtcttactacactttgctgctgttcttgaggttatttggtgcccgtctgggggaaataccacataatcatgtactgctacatgtcctgccca

SEQ ID NO: 24734 - DNA, 1071 bp, Homo sapiens
ctacccccagctttcagcctttcctgtgttgtagcaccacaaaagggatctatcttcccaaggaatggactgctattgcttgttacccagtattgcaagctcagttgttttgttcctgtgtgatcctacttctccttttcaaggcagccaaactgccttgcatctttggcaaatcttctatgggacttccctgtacctgcccagtagtaggagacttctattagtaatggtgtaggatcctgagcccaggactgttccttgctcttccaataatgacaaggttttgttttgttttgttttgttttctctttctctagctgtaatgggttttcatctagtcttggagatatgaagtttctggttcttcccccaaggctagaggcttttgttccttgagaaagcatctaaggagggctttgtgactttccttcagcaactgcactcccctcctccaggcctgcaccaccaaggaagactccctctggtcccccaccctcacccagtctttctcatgagcaccaaatggaaatctgtgaagacgatcttgtaagtgtgaactgcttctctgtctgtggctcccagacaaacctgtactgtcacactagttcacagtcagacttctgcaatttgttagaaattttagcaaatccttcctacttgtttgatggcaaccggcatctcttcttcctgtgttctgccgaaggtgagacagagcttgtaccctgtattcttagagacgccttggatttcaagctacctagttgccctatggccttaactatctgatgggttcaagaaaaattatgagtttgtattttatctgtagtttttcttatttctagggtggaaaaggtgtttttgtttgctttctacatcctaggtagaagtagaactcccattgtatctttttgttgttgttttgagacacagtctcattctgttggccaggctggagtgcagtggcatgatctcagctcactgcaacctccatctctcaggttcaagcaattctgcctcactctcccaggtagctgggattacaggcatgtgccaccaggcctggctaatttt

SEQ ID NO: 24735 - DNA, 1063 bp, Homo sapiens
gctagattgcatctgagatgtcacagtgtatgtacacacacacacacacacacacacacccgacacacaccgcacacatatacacaccagcttctttctgagagagttaccaattaacatgtgttgacatatctttatccttcccaggaggaaagtggcaggagcttgtgaaaagttacaggctatgatttaaactatgttgtaattggaccaaataaaataatttctggcttataattattaattttttgctataaactctatcaccaggaataacaggtcttaacatttttagcatattttcctgcagtattttttttgtgtgggtgttttttaatgtgtttgagcttgaactttatgactttataccttttaaaatgaactttataggatgatcatttcccaggttattaacagttctttataaatataattcgtattggctgaaatcatacagatcatgtggcttaagtttttccttattgttggacaactaagacatttgaaaatgattgttgctgttataaataatggaataatgttttatattaaaaatttcttgtgttttagatacctccttaggatggagagatatctatagaactaaaattagttaatgtaagttaagagatttaaggtttttaacatatttttaaattacttttcataaagacagtaagaagctattattgatattttagaaataaggaatttgaggtctggaaaagttaaattactcgtccagggtcacatagctgctaagtgctagggaccactggggaattggaaccccagtccttttccactgtaagtgtttcaagtgtgttccttggaatattagtagatagggcaaggaaaaaagggcttatgagaaaaaatttggaaatgtcaagttaaagctttttaaaaaaatcctcaggccaggcacggtggctcatgcctgtaatcccagcactttgggaggccgaggcgggcggatcacgaggtcaggagatggagaccatcctggctaacacggtgaaaccccatctctactaaaaaatacaaaaaattagctgggcct

SEQ ID NO: 24736 - DNA, 1028 bp, Homo sapiens
cagatgtacaccaccgttcctggctttaaaattatttttaatgttatattagaaatgtttatgtgcatctgcaagtaagtaaactctaaacaatgatatgaagtggttatattgtgaacaataaaccagccttcaatgcagctaaataaaagcccacatttgatctttaaagaaaaatgtctgttgctcaaggaaaaataaaaagctttccatccagtagaaagtaataactgttggctgggcatggtggcaacatgtctataatcccaacacttcgggaggctgaggcaggatgatcacttgatcccaaagagtttgagaccagcttgggaaacatggtgaaaccctgtctctacaaaaaatacgaaaattagctgggtgtggtggcatacgcctgtagtctcagctactcgggaggctgaggtgggaggatcacttgagtccaggagatggacactgcagtgagccatgatctggccactgtactccagcctggcaacaaagtaagactctgtctcaaagataatttttgaactcagagaataaaatgaatgtagttaaaacagaataaaatgttattttatgttttttatattattttattatttatattattttattattttatttaattattttattgagatggagtcttgctctgtcatccaggctggagtgcagtggcgcaatcttggctcactgcagcctctgcctcccaggttcaagcaattctcctgcctcagcctcccgagtacctgggattacaggcgcctgccaccaggcctggctaatttttgtattttcagtagaaacggggcttcaccacgttggccaggctggtctcaaactcctggcctcaagtgatccgcctgcctcagcctcccaaagtgctgggattacaggcatgagccaccgcacccagctaaaacattattttaaaatgaaatgagtttgtttaaggaccaatgattcattaaatcctcagtatgtttgttgaacgagtatgtgaataaccaagcgtgtgcttt

SEQ ID NO: 24737 - DNA, 1034 bp, Homo sapiens
gcccttgaactagtggttaccacctctttacctgtagttcaattgcatgaacaccattctggaaaaatttccctgttgccatgagccatgtttgagcatattcaaaataataacacatatttatgaatatgttcttaaaaaattaaagacaataataaaattacagagccattaaaaataaaagcaatgttttcaatttgtagtctgacctgtgtcactataaaagtggtttcttagctgtgattgttatctgggagcctcttgacatgctattgtgattttattccaaccagggcaaaacgtgtcatggagagccgttgcttggatataatgattggcacattagattcactgctcaaatgtgtctgtggcctcagtaaacattgttaactgactgaaaatgtatttcatgctttatgagatacaaaactgagtggtaaaaataagaaagtgcacgtttctgtcttaagaaaagaaagtaattagtaaatagagatattaatcagaataatgaatgctgttgaagaaatatgtttatgactgtctctattccctaattttcagaatgtttatttttctataagattctaccagatatgttggcggttgtgaaactggaaagctttttagttacttccatttactgacttttttttagagtaaataggggaaaatcccttttccattaaaatctttcaagccacagtgagaataaggattgtttgaagcaacagcagcttagtctttgctgaggtgctttaaaaacactgttagaataatataccttccagaggcatctgatcttgctctaataggcttgatgtttctatctgtctgtagctgtcagaaaaatgaaagccaaatacttaaaaattaatatctcagaacacagatatcccagaagttctcaggtaaattgtatggctttatccaccatactaacaatttcaggttgtttcacttttgcattaatggtaggcttttcaggtttatatttaatgggcttgggtattgagttaggaatgcccggccca

SEQ ID NO: 24738 - DNA, 1054 bp, Homo sapiens
ccaggacatagtgacagtcctggccttgcttcttgccagttctgtgtcctcaggcaaggtacataatatccctaaatctcttccctcatttgtcaaatgggggtcaaaataaccgtaccataaatggttgctgagaggaagaaatgatataatgtaatcaaccccctagctctaagaacaaacccagtagatgtgggtggtgatgatgattggatgcatagacagagcaggggttcaaatccctcactccaggtgctcagacatctaactcagctctcgctgctgcccaaggattaaggttcaaactagctgccctggcatgctcagctttctaaatctgcccttacatccttttctagttgtagtgcctctattaattgatgcacacttttttttttaattaacctcagtcatatctgcaagcattagtcaagcattcactaaatgccagttacgatgctaggcactggggttgcagaaatgaacaacttgtggccgtcaaggatcttgcaacttaatggagataaatataagaaaataaatattaaagtgagataaaagatacaacaggggtgcatacaggagctagaggtggaaggaatagagaaagtaattgccaaggagagtgaaaagggtttccagaccaagtccctcactccatgggcgtcgcattcgtaaggccgacagaaatgtgacagacaggaagatgccaccagacccaggcaaagtatacaagtctttctgatgtgacatatcttcacacagaggaggggtcataacagcccctcagtgtgagggacaatcttctctcatcctcaggctctccctgtggaaggagaagccctttggagcctcctggcctttcttgaggacagaacagggttttgacatccttcagctcctccttgacccatctcacagctcctagctgtgtgcttgcttgctctcttggtgcagaaacacataagacacccagacatgttaaccaagagaactgaaggtcaaactcttggtgaaagtcttgctaggggtagcagactccaacttcaggccc

SEQ ID NO: 24739 - DNA, 1063 bp, Homo sapiens
tgtactccagcctgactgacagagcaagaccctgtctcaaaaaaaaaaaaaaaaaaaaaaaaaaaaaaaaaaaaaaaaaaaaaaaaaaaaaaaaaggaaactggtgaagtttattatgtgattcttttagtgactaaaataaagagaacttttagaggaaggtaatatccacagtaatgtaatgaacatatatgagttatttgttgaaaacactcagaaccacagttatggataaatagtaaacttttaaaaatgtaatttagctgatgtgagtcatgactttcaaagcctaacaacaagaccaggcttgagcaattcttgtttttgagtttatgctccttcttgactgtttccctttttctcatctagcctaagtcagtttgaattaacatttaccaaattattaatttcatcgtattcctcttaccccttgattttatctttatgatgtattttcaaagtctggcttgctctttttgattttgtcatagttcataagctgatttgtagagtagtaaaatcttgttcatgtatgttactttcaaactgaaggagaaggcctgtgtatgtgctcctggaattctctcagcatcccaaaccagtgctcggataccatactccagtgaccggcccataaagagcagggactcaatacttgattgattgatggttctgaatgccagccagtcagttctgggaaggtgggcttatcttcccagtgaaataaaactgagtcattgaaggccatgataaagatttggctttcagcctaagagtaatgggaagctatgcagagttttaagcagccgagtgacaagcccagatttaaatttttaaaataatttatctggatgtttgtggagcagttaagtataaccaagttttagagcacagaaatcaatatatgtttttaaagtttacccaagtgatataatctaagaagaactgataccctgaatagtctctaatcagccctctcaagttatttctcctgactgaaattttgaaaaacgctgagaagcataaagtttgagattgcctttttctgtttttggggggtgcg

SEQ ID NO: 24740 - DNA, 1028 bp, Homo sapiens
ttaaagaggaaatgggagccaaaagatggctagttgacctttcagaacataaccattcattatgatttgtcagaaagtttggcaactgttattccctaaataacttattgtgatttttaaggaaattcaagcaagaatcaaaattataccaaacccccaactggcaaaaaggttgttttccacaagttcatttgcaagccctttataggagcgatgttgtaaacatatttaggctccttttcaaaagtctacccaacccaccctcgggtcaaagtcatgtacaattgcaataaaaattaatagcaaaaccacttttcatgttaataattaaagcatatataagcaatattaagcaatgactatataagcagtaagcaataattaaagcataatagaagcaataatcaccaggatagaaaatattttgaatgctagtgttcagggttaactacaagatgatatgtatgggttgtgactcttttaaaatttgtgtctgccttcactgactttgagacattgacttctttcattatgaaaagtaggattttcctgtccttatttcaggcatatcatgggttctacctttacccatatctgccatgatttgggttgttttcacaaacgaggatgagagaaaaaggcgggtagtgagagagatacctgaggtagctggggcaaaagttgagaggaaaaacagcaggtttaaagtatgagtgagaaggaggtcaaagggcaatgaagggagcactggacattgaaggaggaacacaaaaaggtgtgcattttgctcttgaggggaaagaacattgggcttcatggctccctggatcagccaccagggggtgcttcagcctcagagaagttgtctcttgagtctgggattcggctcttgactgggtagacctgaggaacctccagtgtacgtcccccgatttaggtcccccttgtcttcacttccttccctgttcagtttggataccattgcctatcatttcaatcaccctcttgtccatattactggttctccc

SEQ ID NO: 24741 - DNA, 1054 bp, Homo sapiens
cagctctctcctgtgaatggtgcctgtgccctctttaaaggtatgtctcttgcagataaattcaaacaatggaagcagctatctgtctgaacctgacagtacttattaattcagaggacagaatcatagttctagcttcatcttaattaagtgggtttctacagtttttcttcttctaaaaggggaacgtgtgtgttagtccatttgcattgctgtgaaagaatacctcagactgggtaatttgtaaagatatgaggtttatttgggctcacagttctgcggcctgtacaggaagcatgatgctggcatctgctcctggtgagggcctcaggaagcttgcaatcatggtggaaggtgaagggggagcaggcatgtcactgacgagagctggagcaagagagagaagactggtctcaaattcctgggctcaagccatcctcccgccttggcctcccaaagtgggcctggcatcttgtaggttctcaataagtgtttgtagttttggtatctggagccaactagaatttgatctgaaaacaaagtttacattaaataacaaaactgaatttccccccattctaagtgaatctccagaatgattcatttccctatctgtaaaatatgaagactaacccttacttcatggagttattaggggacctcaatgagataacacaggaaagtccttcataaacaatccagctctattaaaatagaaggtttatcatggaaaaaaccaaaccagagcccttgataaattcttagttattgtgttattgttttgggtttttaaaaaaattaatatgtgctttttaaggaataattttgagcatctgaagttaaaatattgaaaaatctctttgctaaaagtcctttccctgtgggtaattttatgctgtatattagaaagcacaggaagtccaacatcttgcatggagttaatggtaaattttgtgtcttgagaactatagatggaaaattgttttctaatatttagatgtttcacccatgtagctgtgtatgggatatgggatgggggtgtttgtcagctcag

SEQ ID NO: 24742 - DNA, 1035 bp, Homo sapiens
gtttgcttggaggtgccctttggtggcccgattatttatgtccttaaactcttgtgcctgaagccgagatgcctgtctacctttccctgatttggcctctccctgcttaacccctttccttggaggaaatgaagatgatctcagggcctggttgtcaggattgcccacccctgggaaaagctggtgggaaggtagctggcgcctagtgggtgccaaggagacaatggatcaccagcatcctgcccagggacaatgctctggccctgagcccagccctgagcagggaggctttacatcaggaagatcaagatgctggcttttgtttggttatttaagattctccaaagaatcacaaccaaaaatagtcacaataataatgataaaaatttcatttaaagctataaataaatcttgtcatttaggactgcctctaaacccaggaattataatataataatgggaattgctcccaggatttttgtgttcagagttgagcctctgggtgccatatccagatctgctgatctaagtctgctgagctaaatagcatccgagcttacatggcctggccccaaagcacacaagccactgaagcaagtgagcaggagtgtcagcacgtgctcatggcccaggcggaagccctcctgtgtgcagagaggtgaatggtgtctccccactgccacacagggtagcagtgatctgtgaattgcctacagtatagcacttcagaccctgaacatcagcctgaagatactctcaattttttcccatgacctctttgtggggttttcaccaatatctcttgttcttttaattggacttggcaaccatatgtgcacctattcttagaccaatgctaaggtaagcagtttagaaggggcaggaataggggtaaatgagtatgaataaatacagtaacaaaaatggcaaaatgatgcaaattggagaggatgcctaaacatttttcataactatagttttattgaaaactcttaagagtgatttactaccttgttactgcctttggatagttct

SEQ ID NO: 24743 - DNA, 1038 bp, Homo sapiens
gcttcattgatgtcagtaaaacacagagaaggttatttcttggtcagttgtttaggttacttctcagctttaaaattccttgagattgagtgcccagcctatagagatcacaccttataagttgatatttttcaacaaacaagtagcatttgcatggcaggtagaagccatggtggctgcagctgtgagactcccttagtgccctctcaagctgccagaggaggatatccaccttcaggctaaaggtctagaaatctccaagggcacttcactttttttcttaccccatgagatatttccctctcggtccaacaaggcttttagcaagtttgggattataataacaacccctaaggtaggtgtctttaagttccttctcagatcccaaacctcaatggctaacgtcttcaactttctaaaaacacagtgagaaatcaaacagcagaacatggtcacccaagtggaacttttacagtacattaaatctatcattgcctgttctcataaatgagccctgacaaatattaatgactatcagaaaatagaactctaattttttttatctcacacagaagtaacattttactcaaacacgcatctcctgtgtttcagctgtaaggagtataaaaatctgaattccttttttgccatcgtcatgggactaagtaacgttgctgtgagccgcttggcactaacgtgggaggtaagcttcagctaggatccagctgtgacttttgccttaggaataaaaacacaggctcaccagtgagctttttaatagaaatatcactcacactagtataacaatgggaaaggtgggacacttggagggaggtgacctgtctcctttttccagttgcctcagagggagaatttttaaaagatattgtccttttgtgtatggagagtgggggagatgaggagatgtctacttcttgatatatgcaatgtaaataaaaataagtccagttcctaagtataacatgaaggacccacattgctgggaatgacttcataagtttgctcatagattgtatt

SEQ ID NO: 24744 - DNA, 1028 bp, Homo sapiens
tataggttctctctgtattatttcttataattgcatgtgtatctataattatctcaaagtaaaaacttaaaaaaactagattatgatattttatatgtatatatatcataaaaacgtgtcccaatgtgtaagttgtaaatcacctcgcaacttactttttgaacttagtatactgaggcacttttttatgtgactacacgtagagctaccacattccttttaataacttttttattttgtatttaaataatatttgtttacttcacatttactttttatactaaattctcgtgtagtattattagaaaaactagacatgtgaagtaaaacatattagacatgtgaagttgtaattagcagacaaaagactacaaagcagcttttataaacatgttcaagaacttaaaggaaaccatggttagaatgagagagcagaatcagtaattcagcaggaagatggaaactaaaaattctagaactgtaaaactacagtctctttaaatgtaaattgtactgatggggcttaacagcagattgaggaaggcaaaagaaaaggtcagtatatgtgaagacagattaatataatttatcaaatctcaagaccaaacaaaaaaaattttaaaaattgagcagttacacatgagacaatgtcaatctaatatacattaatggaatcacagaaagaaaggagagagagagaggggatggatagaaaaatatgtgaagaaatgatgacttcaagtgccccaactttgatgaaaaccatacacttacagttccagcaagctcagaaaaccccaagcaggataaattaaaaatgaaaaccagaaacaccacactcagtcacatcatagttaaactgctaaaaatcattgatgaaaagagaaatgtcaaaaacagccagaaaaaaaagacacattacataaaggaagcaataccagttacttctcactagaaacaatggaggccaaatgacagtggaatgacctgtaatatgccaaaagaaaaaagataactgccattttaga

SEQ ID NO: 24745 - DNA, 1032 bp, Homo sapiens
tatcttgagtctatatttcttataaatgtgaatacccaagaatgggttatattgttggttgagggggaaccatacctcacattttaagtcagatttctgatttaaagttaaacctttctctgacccatataccatgtggctccttttttccgtgtccattgtatctacttctttttactagttatatttactttttaaatctgaatccagtgttctgatcctcgtttgtggctgatgttattcctccctaagaaagtgtgacactcccaagagactagaaactctgtttcttattatatactcttgatgtttaatgctttttgaaaatatttttggccaactaatgagctattcatgaagttttctagtttcttgaggtgagggtgaaggatagaaaagggaacttgagtggtgatatgaaattctttctccaagagtttactctcagtaggaagatatcaaacattcttagccagcatatttcccctaggtcatctcatctgaaagagggagaaagaatccaggaagttttcttccattcagtatttgtatcagactagtcaatcctttatttcattcatccctttagcattctctactcatacttgcacctacccaaattcttcagttaaattgattagttttttatggatctatatctctttccctgtagagccagtaagtaagcaactggctttacattgtttagttaacattaaacctaaagaattaaaacaacacaagtttcagattatgaggcagtagtagattgtatatttatagctctcttattgacctatgagattgattattaaagagacctgttaggtgagttttaatgttttgaatgtattgatttgatatgattatctttgttcctagagatgttagttttaattaactaagtgcttgtttatgtgagcctttcagcctaccttgtacagctatgctctgtgcatgggtagtagaaaatatgacaactgagtccagtttgggagtgaagaaatcacatggattagtgatgacgacact

SEQ ID NO: 24746 - DNA, 1775 bp, Homo sapiens
accttctgtgcttaaattttgagagctcttctaagtccttatgtgacaacaattgatttgtttacactgtcattaagctgtctgatttatgcatttaatatctatctcataagaataacaacttttaaagaaatacctatttatatacatacctttgtttcaaatttattcttccaacacctctttgggtttctcagttccagctaaatggcttttgattctcaactgaagtttactattcattgtaagttactgtcttttgtttgacagatatttttctggatgacattaacttttagaaaccacaccatggaacaattttttatatatttttgatgtcttttgttaaattctttaatgtattttctcaatgaaaatataaagtcttatttctgaaatgtatcttgattttaattatatgcttatctttccttttaaaatagaatatgcttctctgggatcactctatgattacattaacagtaacagaagtgaggagatggatatggatcacattatgacctgggccactgatgtagccaaaggtaataatatttggtatattcttatagaattagtggggtgcattttcccctcctgaaatggggacttaacatcagaaaatgttttattctgtctttagatgttctttttccagaccaaaagtagtaagaattccacagctgatggtacagataatattttaggtcattgcctttccactcctgaattccttttatcttcctcttaagactctactttatttctatccacgaaatctagttgtagcttcagggcagacatgtttgtcatgttttgtgatattataattgactagcttgcttgacacattaaatggaaaaatcatagttctgttgttctgaaagtctctacttagactcagtatccagaaaacatgatttattgtaggattagttctactcattttgtatacataatatgctaaaaatagaaaccacttgcaaaaaaaatttttatttgtcctgccatgtaaaagcaattcagattttattttacatttaatgtaaacttacttaggcatcgctgttggaattaaatatttttaatacaccaaacccctaaacaaagtgcccagtcttttttctcatacattcttgcatagatgaatgctttctaaagcaattcaaacttcatttatttttatcttttttttttccattttcctaactgaacatttctgggctttatttataactgtcagagttgctttggaaacaacttcatctaaataatgaacaccgatagttatatttgtattctagcaacccctacaaagtgtgtctgaattttcctggggcaattaactcctctacattttactactccattctctacaagcatctctttacaaagcaaatataatgtgatttagcactcagtaaggggagcaactcatacgttgatttcactgtgtgacttccaaaagtagcagtctttcctttggggaattgtctattttaagtttcatcaacacctaccaaattcttcaaatagggaaagtgaaaaaaaattttttttgagtttcatgctagatgctgctgctgaatgatgcctcattacattataaaaataataagctctgtgtttagggtggtgtacctgagactttatgttaatttgcttaattgtgtattgatgcatcgggcatctcaaatcatgcttaaactttcatattcttaaagatattttcatgtaatatcatagtgacttctctgtatgtcagtagaacacaa

SEQ ID NO: 24747 - DNA, 1100 bp, Homo sapiens
agaacttcttatcagaagagaaatttcctttatcccagttacatcttatttaagatcacataattactaatacttgtgttaacttgactcttcagtgatatcattcagtgatatcattaaaaggcaagagtttaaattttctttgtcctttcatgattcttcaatatatcataattaaaatagaagaataaagatttaaaaattaacctctctatatgctttaaaaagcctaagcctcttattaaattattttcaatgcattgttcattttaaaaagaagcctatttgatttggaggtgagggggaggctatttctgccattagttagaaaaaacaacttgagaaataaagaggatatattttagtagaaaatcatcctttttttattctaaaggggtagacaatacgtaaatacagaaagagtcaaaaactactaaggtggtaaccataaaatgtgtctttaaagtataattttatattcaaaataataaagctctataaatatgatggaaagaattttggagtatgttgaaatacagattatctcaaagatttatccttgtaaaaggaatgaaatactttgtaactactgtatacttttttatctgaagatcataaaattatttaccaaccgtaactaatcagtcctcccagttctccccaccactaccccacatccactcccaggtcttgttggaatgggtactgagaaaaagccaagctgcagccaggtaaccatagacatccagaacttcggtaactggacatcagaatctgcagttgggtacctgcagacaaccagatgaaaaccacaaattttactcagaactttggcagatttagaaggtagttggtagcggaataccttagtcgtggagccctcctttcagtggttactgtgctattttcatgcagactgcagaaaattaaggtgtccttattaggtattgtaagaagctagatttacccacagtcaaattccaacctctaagagattaaagcttataaatttgacttcacatatacatgttactaatgtagacatattctgttttcattttatcagtcatggaagaataagacatgtgaattagtttctg

SEQ ID NO: 24748 - DNA, 1089 bp, Homo sapiens
ttgagtctcaactattaaactgattcatcggtttctaaaagtccaaaagaaaatgtacttagcacttaccagatgaccttgtccatgtctgctgccagtcttagagtagcagtgactatctgaagcgtgactctaaggcattacataagaatcacagcagagccacatagagaatagactaatgagggggtggagtgctcaaggaagagaccacaggaatgaatccgttaaggagcagaagctcctggaggaggaatttggagatgggccatttcctgaggaataggttatacctgcattatcagagagaaggaagtggagtgggagagttctttgctggaggaaggaattcatttgttgccttttgttgaggataaacttttccctaaaatgttacgtattctttaaaaagtccaaaatagttttggaattccctgtctttacatctcatactgccctgctatttatactattatactgccctgctgtttatactattacttcctaaaagggcattttcatagtaatgggtaaagaagcagcctgttttaggtccaaatcagcctgtctcttcgtcctgaacttctgtgttttcttactgcaggtggtagccaatgacacaagaggagattcacgttgtcagacctgttttgttttgttttgttttctttattcggtctctaggtatttaatgctggcttcacaggttttggacttgtttcagtgactagctttttgtaaatcataacacatcctatgtataccaaattaataaagattaattttgttagctattgaaaaaatcatttcaagaatgaaatatgtttttgaccgaaggctagaattttaaaggtcagaaggcaagagtaacatcaggcttaatacctgatatccaaaaaaagaaaaaaaatcaatacctgatatcccttgattctggtttcttaagaatgaagactataagctattacagtgatcaaatatttctcataagtttcagaggagactagcttataaaactggtctcctatgtcaaatgttactacattctaaccatcatacattcatctgtgggatattctgaaaatgggg

SEQ ID NO: 24749 - DNA, 1047 bp, Homo sapiens
gccgcctttgaggctgtctggggcctctgactgcttgcaggtagattgatgagtaaagggtggtaattcctgcagtaatgcgatgaacactgctgcttaagaagatggcagacttgagttctccttcctgcccctgtgatcttgcagtctattacaccttcctggggccttgaatatcctcatctggaaaatgggatctgagatccttttcagctcccaacattcattgtgtcccaggctggagtgcagtggcacagtcacggctcactgcagcctaccgggctcaagcagtcttcccacctcagcctcccaagtaactgggattacatgtacgcaccgccacatccggctgatttttgtgtttttagtagagacggggtttcaccatattccccacgctggtctcgaactcgtgggctcaagtgatcctcccaccttggcttcccaaagcgctgagattacaggtgtgagccacccccctacacatacacctaacctttatatttagtagctctaccttttacacgttgtcctgccttgttaagagggcaaaagacaaaaacttcctaagatgattgaacggagtttacttaggggtatagggatgttgggagtgccatcatcatgaaaataactttatctgcaagagactgaaatgcgtaatgttaggccaagaaggagggcaagaatgttctggtcacctgacatcttacatcttagcatattttgtagaatctataccagagcttgccctttcaaagttttcagtgtaaggaatcacttctgctattccatggccccatttaaggaataaaaacacaggacctaatgcaacacttaggaaatctcgttaaatattaagaaatgacaaaccactatcctttttttatacaagatagatgccaattacattttctgagagcagtgccaggctgttcagtatttatgaatgaatgaagcatttctatgtaagtaatttgcactttataaaaggacttttaaaaacttaagtcttgtatagcaaagggacagcaacaagaactgaat

SEQ ID NO: 24750 - DNA, 1048 bp, Homo sapiens
ttcggacagctacttgtggcatgtctttcatggattatttttcttttttaaaattaaagtaataacatggacttggtatcttcgtccattgtctgttgcttacaatacctgaaactgggtaatttataaagaaaaggaatttatttcttatagttatggaggctgagaagtccaagttcgagggcccatatctggtgacgatcttcttgctggggggcactctgcgcagagtcccaaggtggcacagagtgtcatgtggagaggaggctgagcttgctagctcaggtctctcttcctccccttgtaaagccactgacccactcccatgataaaccattaacccgttacttcacttacacattaatcaatgaatagattaattcattattgagggcagaaccctcataacctcatcacttcttaaagatcccaactctcaacactgccacattggggattaagtttcaacatgagttttggagggaacaaacatttaaatcataatatttggctaaaacaatcaaatagctctgaaggatttacaataaaaagcaacagctcctttctccacctctccagaaccccagccctattttccagggagcaaccacttttaacttcagtttttataacttttgaggaataacctgcatatctcaactagtaattctttcctgatatttcttgatgtgtaaactttgatttactcactgacttcctgacctcttttcctcacttctgctactaaccctggtaactctccttttatttttgcataatcaaggctgataatatttaccttttgatctaaaaatgtctcctgaaccttgtctataggatcgttcaaaaggttgagaaaaaataaacaatgtacattaataagatgatatagcatcctttactacagttgtgagtgatatgtttgggtttttttttctttttagagagggtctcactctgtcgccgaggctggagtgcagtggtgtgatcttgcctcactgcaacctctgcctcccgggttcaggtgattctctcacctctgcctccc

SEQ ID NO: 24751 - DNA, 1054 bp, Homo sapiens
aaaatttaacagtaaaaaagaaaaaaaaaaatccagttagaaaacagataaaagacatgaacagacatatcacccaagagcatgttttacattgaacatcaaaagatgtccaacatcattagtcatcagggaaatgcaaatcaaagccacagtaagctatcactacacacctacaataatggctaaaataaaaaatagtgacaacatctaatgctggcaaggatatggagaaattaaattattcatgtattgctggtgggaatgtaaaatggaacaaacattctggacaatagtttggcagattcttataaaaccaaatatgcaattactactgtacaattatactcttgggcatttatcccacaaaagtgaaaacgcgtgttgacacaaaaatgggcacatacatatttacagcaatttttttcctaatagccaaaaaaataccccactgcgcttcaataagtgaatgtttaaataaactgtgatacatcaataccatcatggaatattattaagcaataaaatggaacgaactattgatacatgcaacagcttggatgactccaaggaattatgctaagtgaaaaaagcccattttcaaaggttacatacagtataatttcatttacgtaatggtcttgaaataaacaaattatagaaatggagaagagattggtagttaccaagtgttagggatagcagaaatggcagagggtcatgggaatggatgtagctataaaatggcaaaacagaatttttgtgatgatggattgttctaggtcttgactgtagtggtagatacacacacctacacgtattaccaaaatagaacaaagtacacacatacttacacaaaaatgagtacaaatgaaatgggaaatctgaatacgatctgtaggccatacgaaagtccattcttttttatttttattttttttgatacagggtctcaaaaaaactactttgtttttctttttttctgattacaaagttaatctgtgtttattgtagaaaatgtgggaaatgcttgaaagcataaagaagaaaataaagg

SEQ ID NO: 24752 - DNA, 1051 bp, Homo sapiens
actggctagaattttgctcttttatttatagcagggagctaagttttttttttttttttttttggacgcaagtaattaattttgattgaggagctatatataaaaaagccagaaaatctgatctgagggcaggcacagtttttagagttagcagagttaaatggaaacattaaatcttagggaagtatggctggatacggcattgttgtgcagttttctggattaatatggacggtaaatagcagccttaccacatagcagggctatgtcaattcatcaccggtagtctttgttccctagacatagagccatggcctgctgatgagggactagctaaaccaggttacagcctcccaccccatgggcagctggaatctgggaaccagccgaaacaccctctgaagcctcagcatagcccttccctgaaaagtgtctctcaatagtgggcaggctgtcgtctggagtgacagctgtctattcaggtagtggctgctattgtcttcacacttgtaacaccaagaggatttttgtttaattttaagaattctgacagcatctcagaatgtcgtactccaagtgggtccaacccctcctctcatggggagggcacaatgacattagagtgtacatttttttctttaaattgcagatgccttaaaatgagattgtcaggtttgttggcttgtcagactaaagtatcaagattgtcacagtgtattatatcactataatatgatcattgtacacgaaactaatgaataatattgtacttagtggtgggatggagtcacattaacattaaaaacggtgagcagccttgcattttacccaggagaatctgggagggatgactctacactgtggggtgtcaggccagaatttcatcacccaggggaggtcaggaagccctctttggacagagaggtaaggaggtggccagctgagtgctgtgttgggaacagcagagcagaagggaggctgggggctcctcagggaggctgattgaagtgtttgcaccctaataggtgcacagaaaatggtttttaaagga

SEQ ID NO: 24753 - DNA, 1044 bp, Homo sapiens
acagaaaatcaaatgccacaaatcctcaattatgaatgggagctaaatgatgagaacacacagacacatagagggtaacaacagacccctgggcctactggagagtggagggtgggaggagggagaagatcaggaaaaataactaataggtactaggcttaatacctatgaaataatctgtacaacaaacccccatgacatgagttaacttatgtaacaaacctgcacatgtacccctgaacttaaaatgaaagttttaaaaaaaaagaaatttgatggaaataggtatttggaatgaaatattgctagtcactaatattcaatatcagtaacatacttttgcattagaactgaaaaacagatgctatataaaaggtctggggtaattgtgaaaaagcattctccagaccttatatgaaagatcaaactgatcctcatttcatgttagctatttgtcatcatagaaaacaatatgttaatcttgccgggacctatataaaacactgtggaatatgtttgtaaaagtatccagcatccctgaagccctgaatctcaaatactacatgacaaactgctgggaatgttcaaatcatgataaccatacacagttcctgtgttgggtgcaggtcttggaagtggattttcagtgatgaatccctctgtctcaactggcttgacttcccctacttccccagccttgctcaaatggcctcacatcacccccttactccatctaggcaatgccctcttccctttccataacatgtcctactatttgcctcctccaaggcttggctattcttgctgatccctcttactagaatgttcttcccatttctctctgaccatctcacccccaatctacacatcttttaagattcaactcaagtactaacctcttccattgaagcctttccccaacgcccaggattgaagtaacaattccctctttttcacctgcttacaccatgaacagagcgccatttaaaactgtcattgagcctccttaaaggccagagcacttgtcttatttatttatttact

SEQ ID NO: 24754 - DNA, 1552 bp, Homo sapiens
taattggctcacagttctgtgggctgtacaggcttctgcttctgaagagtacttaggaaacttacaatcatggtagaaggtgaaggggaggcaggcacagtcttcatatggtggcaggagagagagagcaaaggggtagaagctacacactttcaaacaatcagatcttgtgagaactctattatgagaacagcaacggggaagtccgcccccatgactcaatcacctcccaccaagcccctcctctaacactgggcattacagttcatcatgagatttgggtggggacacagagccaaaccatattagtgtctttacccgtgaacatgaaataataagattgatgtaacaggattactgtgaagcttaaatgagatgatgcatgtaggtgcctagaactgcctgccactctcgaggacctcactaaatgcaagttctttatagtccttcctcacagttagcatctggcctggtggtgcacacactaacaggggggtttcttataaggacacaggacaatctcatgaattggcttcctgcgtgtggctcttggtttgttcttccccataatggaggcccgtctgtgacttcatcttgcgatggtgctcactccagctctgatattacatgctcttgcacctcagctctccaaagttagccgatcattttcacagaaataggaaaaccaatcctaaaatttgtgtaaaaccacaaaggtccctgaataggcaaagaaatctttggtaaaaagagcaaagctgaaggcatcacactacctaactccaaaatgtattacaaaactatagaaaccaaaacagcaaaacactggcataaaaacagacaaaaaccaatgaaacaggatagagagcccagaaataaacccacatgtttatggtcaattgattttcaacaaggctgccaagaacgcacaatagagaaaggacaatctctttaataaatgatgttgggaacattggatatgcatgcagaagaatgaaattgaacccttacctcacatgatacacagaaatgaactcaaaatgaattaaagacttaaatgtgacacttgaaactgtaaaactactagaagaaaacgtaaagggaatgctccacaatattgttctgggggcaaacatttcttggatgtgacccccaaagcacaggcaacaaaagcaaaaaataaacaaaaagtatgtcatcaaactgaaaagcttctgcatggcaaaagaagcaatagaatgaagagacaactcatggattgggagaaaatatttgcaagccacatatctgataaggggctaatatccaaaatatataagaaactcaaataactcaattgcaagaaaataaagaacccaatttaaaaaatgggcaagagacttaaatagacatttcttaaaaaaaaaagacatgtaaatggtcaacagatatatgaaaaatcatcatcttcactaattatcagggaaacacaaattaaaactgcaatgagatatcacttcatacctgttagaatggctattttagtaaaaagatggacaataacttttattgg

SEQ ID NO: 24755 - DNA, 1036 bp, Homo sapiens
cttttgctagtcacccaaaggcacgaagttggttcaagagtcccaggacacctccccagtgtcaaacttgagctttcaatggcggcctcaggctggtttctgttttgccccatcactaattcctcttgaccagggaggcactttccttccccagatggattatccactgagtctttccttttcagtcctacatcacttctctatagcatgtcttgctagtacaatcatattagaagtactgtaagcatttgccccattgatcatgctattaaaagatgttgccatctaattctttgggtttttttttttttttttttttttttttttttttttgtgaaggagtttcacttttgttgcccaggctggagtgcagtgcaatggtgcgatctcagctcacctcaatatccgcctccccattcaagtgattctcctgcttcagccttccaagtagctgggattacaggcatgcactaccatgcctggctaattttgtatttttagtagagacagggtttctccatgatggtcaggctggtcttgagctcccgacctcaggtcatctgcccaccttggcctcccaaagtgctgggataacaggtgtgaaccaccgggcctggccattgccatctaattcttaaaaagcagaaagctagcatgtaagattcttctgatacttcttgctcttaatgtttctcttctcctgctctgacttgggacactgagtggtgattataattactttataacacaatggaatggattgttatagcagaataaaatgttccaaaggagtacttaattccatcaaagcatcccttatccaagtttgctaacttaaatgaagaattgttaacgtattctctttcatttgtcaaatgtccttcctgacctttcattgtttcacattttgaaaggaaattatggtaaaattgtctgagccaccctcctctggatccagtgtcttatttagttctgtattttgggcttaccacgggcgggaactatctacacaacccagatcccctttcacctagga

SEQ ID NO: 24756 - DNA, 1031 bp, Homo sapiens
tcccactgaagacaacggtgatggggactgtcaggctggtgatcccacgagtagcaaatgtgtgggcgtagtcactgaccaagtgccccagcgagtgatggcgggaggcgtggcctgctgggccactcttccccacagcaaagcagctcaccgcaactctgcgtcttgggctcattctgggttaccctgtgagaagaagtgttgtttccttttacttcgccatctcctccttccccttcccagttaacctttccaacagtaggaagactgtggtcctccatgtccctcaagcagcccaagtctttgcaggggtatccaatcttttggcttccctgggccacaatgaagaagaagaattgtcttgggctagacataaaatatagtaacacctacaatagctgatgatctaaaaaaaaaaatcgcaaaaaatctcataatgttttaagaaagtttaccaatttgtgttaggccacattcaaagccatcctgggctgcaggttagacaagcttgctctagaacataatttttcttctaataaacccaggaacccctcccttactccaactcagcttcctttctccatttaatggcaactttctatgcctctctgcaaagatctttccaatcttactacatgtacaatgttatttggccctatccgagggatcgtagtcagacgtggactcattagtgagaatctgttttagtcctgttaagcctttggccatcgattctgaggggcttgagaccaggctgcctgtaacactaggttccactggctctggcaccctctgttgctcttcctccttcgggcagcctcttctgcaacgtttctgtggcacagtccagcctgaatttcaaatgtcctcccaggccctgtccactatttcctgaaagaacacccatttctgggagcttgtggcctctgctggtaaaaccaacacttgactgattgctggtatcccgaacgagcttagccatttacagatactgtttgagcagatggaacggaggtgcgagtcgctgatta

SEQ ID NO: 24757 - DNA, 1035 bp, Homo sapiens
gacacacaaatagggccaggcatagtgccagttgccctctcctgtacccagactgactggaaaatttcaagatacattggggcttgggtagggtatacagagagtcttccttcactaatggaaaataattagcaacactaacaatctaacaataattagatcgagcactgcttcaatcctgcctggtaaatcttaaaagagggtttaaaaagattaaattctttgaaagtaagttaactgtgtcaaaaacaaagctcaataatacttatagaaatacaaaaatgtccagcacacagcaagtaatgttcagaatggctgacatctaatcacaattaccagacatgcaaagaagaggtgaaatgcaatccataatgaggagaaaaaccatgacacagatgttagaattggcaggacaaggatgctaaaggagttgttgtaattgtgatttgtatttttaaaagttatgtaaagacacggaaatattttttaagaaggccccagtcaaactttgggggattaaatatacaatatctaagattaaaaaaacactgaatgggattaatggtagatttcacatgaagaataaaggattagtaaatttgaagacatagaaataaaaattgtcaaaaataaaacctggagtaaaaagataatttaaaaaatatgaacagagatttggtgtgctgtgggacaactttaagaagcctagtatatatatgaagagttcctaaaagaagagacaaagatgggtaaagaaaagaatatttgaataaataatggccaaaaagttttcaaatttgatgaaaactataattatgtagattcaagaaactcaacaaaccccaagcactcaaagaaacaagaaggaggggccaggcgcggtggctcacgcctgtaatcccagcattttaggaggccgaggcgggcggatcatgaggtcaggagatcgagaccatcctggctaacacggtgaaaccccgtctctactaaaaatacaaaaaattagctgggtgtggtggcgggcgcctgtagtcc

SEQ ID NO: 24758 - DNA, 1083 bp, Homo sapiens
agcaaaaacttgcatccttggtattttcaaggaatgaatttcttaccagtctattattatactaacaaaaaggcgtggatcaccagggacatcatttctgactggtttcataaacattttgtaccagtgactcatgctcactgcagggaaaccaggctggatgataactgcaagattttgttattccttgacaatcgttctcctcatcctccagctaaaattctcataaaaataatgttgatgccatgtattttcccccagtgtgacttctttaactcagccatgtaaccagggtatcctgggatcagtgaagagtaaatacaaaaatacactttcttgaacagcatgctagcagcagtgaacagaggcatgagtgtggaaggttttcaaaagaagttagcatgaaagatgccatatctactcttaccaaggtctgaaacacagtgactaaagacacagttgtgcatgtctggcacaacttctgtctgtgcaattatgttgagtgatcatgatggacaaggtggtaactgtgaaggattctgtatatctaatgagaaaaaaaaagatgcctggcccccttacttatgcaaggtacatacctcagagtctgtcagcaagctggaagaagcgggtatcaaagaagtttttaacatcaataatgaggctccagttgttcattcattgaccagtggttaaacggccaaaatggttctgaatcaaggtgatcatgataatagtgatgatgagacgaccttgttaactctgcagaattgcctatagaccacatgctgaaaatgtgtggtgggcttatggaaggactagagcagcatgcattcattgcagaacaaaaaaaaatgtcagtttataaaatcaaagagaaactcctaagacaaaaactgttgttaatgaggctgatgattctggaggaaacatctaaaaagccatccagcagaatgcctccccacgcctaaaggacccacttcctggtccctcaactcctgatgtttcttctcaccagaaaagaaaatacagtgtatcttttattcaaagcccagcatcatagatggagactgaaagcctgcc

SEQ ID NO: 24759 - DNA, 1065 bp, Homo sapiens
atcaatccttctttgcatcctccagctcctacacccccaaacaggtagtgcccctcaagtgcacataatattgtaaacctttaaaaattccctttcctgtttagcatccagatgccaatgcaaaaggaaattcactgaactgaggattgccaaatgcggacaacctggaagtattttggggtttttgttgtgttgtgttttttaggctcaagggtacatgtgcttgtttgttacatggctatattgcatactagcagggattgagcttctagtgtactcattacccacatagtgaacactatatctgataggtaatttttcaactctcactctctcccacctccccccttttggaggcttcagtgtctattatttccatctttatgtccatgtgtccattgttcagctcttgcttataagtgagaacatgcagtatttagttttctatttctgatttagttcacctaagacaatggcctacagctccatccatgctgctgcaaaggacatgctttttttcttttttatggcagcatactattctgtggcatatatgtaccacattttctttactggaagtatttttgcaagttaggtctctactacaccaaggtgcttcatcattcagaaaacacagagtgagttaaggatccgttaagggaaacgaggaaaatctgagaagccagtttaattgatactttaaagttgagaattaccatgtatgggttgccccctgcattcctccccacaccacccctatcctcctgcagaaccccaaagtgacaagaaggaacatgaatttggtgtcaaaggcaaaaaaccaggaggctcacccccaaggctgcttcacccctttcaggccttgacatggagggaaaacaaaagctgccaccataccaaacctttccagactcatcctaatggaatctgcttgagtcatggaaacatattacaaaggcttgccaacaccagggccttgtgtaaatctacaattgcaactagtattgggattggagcacccacaagtcagttaggaccatctaagtccatagattaaccatgcca

SEQ ID NO: 24760 - DNA, 1111 bp, Homo sapiens
acttaaactgtctttcaaagaacaatatgtatctgaaataatggaatgccatgtgggccatctcttagagaaaattctttaaattgaaccatttggggcccagtaaaagttgccagggtcttcctttccacaccctccccattccaccttagctactatgtcgctcctttcaatgtggatattgtttacactatgaatggcataaacaaatttttttagttttatgatttcaaaacgaggaggaaaaaaagcaagaaattatgcactcaagggtaaaggaatagaattttgccttcaaaacttttcagaatgaataggccactctacacaagtacctacaaatggccttcctgtctctaagtacatagagaagtactcttcatgagaagtctattctagacatataagattctggtccagggattgatgattttgccattctcttactgatatcacaggtatgactgtttaagcattttcaatggccaatgcttaaaaacaattgactcttactctgaaatttttttttttttttggagacaggatcttgctctgtcgcccaggctggagtgcagtggcacaatcatggcttactgcagtctctgcctcccaggctcaagcaatcctccgacttcaacctcctgagtagctgggaccacaggcatgcaccagcatgcctggctatgaaaatttacttttaaaaggaagacttaagtctttattctgtccttattatatgaactgtatctcagagtaaccaaactagtgctagctgttgagaggaaactttttttgtagaattccagctaatacataataaagaaaagatggaattataaaattatcattttataacccttaatgtaataattgattcaggcaacaaacaccaatagctactaagaatgaaggatgagtgaagaactaaatacttttggcagattatttctagtcctaagaggaaagccacagtattgtaatggaagggtctggctgtcactaactgaactcactgactaatcttggtgtcactaaacttggataatacagatatccagatactttttgcctcctaatatgatgcaattgtgaagcaaaacccaaaatattg

SEQ ID NO: 24761 - DNA, 1044 bp, Homo sapiens
agggagccattcaaggatgcaaagcaggaagagacaagtaagttttgcatgcagaacagttactggggcacacagatctgaaggcggccctgtagaggctggggggtgggccacgggagggcacgggaactcagcagggggatggcaagggccttagtcatggcggcaacaatggagctgaagaggaagagagagagacgtaccaaggaggcaaagtagagggcacccattctctgctgtaatcggcctgtggagagaggcctgggggttctagcatgggtgagtgggaagacagtggtgtctttcaccaagataaggaacacagggggaacagtcagtgtcatgggggcagcagagagggaaaagagcagaaacatgtctgcatttctgagtgtgaggggctagtgagacctccagatgaaagagacaaagaactggatgtgtggaactgatgcttgagagagctctgggctggaaattgtgattctcaaattgttgttgtgtggatgagtggctggatgaggtagcgtgaggccgtggtgcactcttgagccatttctctatcacctgcatgatcttctttcacagtcacttaccgcttattccattatatgaccaatgcttttctgtaaataatctcccattttgcttaataaaatttattttataaggaaactttatatcattactataaattttttaatattatttgtcattaataggaagtaaatataaaaataaatatataacaactatgtaataatataacctcccttatatataaaacacaccatgtggccaaattacaaaaagaaacgaacaaacccccaatcatagtgagagatgttggcatatttccctcagtaattgataaatcaaacagatgtaaaagtagtaaagacatagatttgaatgctagtcattcttttcaagcaaatatagaccattttttttaaaaaatcaccacatactaagccacaaagcaagtctcaacatattatctaagaatctctaccctactgaccacatatcctaactataatg

SEQ ID NO: 24762 - DNA, 1045 bp, Homo sapiens
ataaaacctaagatccgtgcttgagagattttgcagactgtgcacttgatggatcggctagcactacacagatcgataaactggctcatctgatcttatggcccccgcccaggaactgacttggtgcaagaagacagctttgaatccttatgatttcatctcccacccaacagatcaacactccagattcactgtcctctacctaccaaattatccttaaaaactctgatccctggatgctaagggtaactgatttgagtaataataaaactccagtctcccacacaggtggttctgcatcaattactctttctctattgcaattccccagtcttgataaattgactctgtctaggcagtgggcaaggtgaacctgttggatggttacactcccatcataacttttccttttcagggagttttccagataagctgaaacaggggggattttatacaatacagtgagtttgcaaagttgcaatattcttccatttctggaaatcctgtggacattctaagattctcaatggctctaatgactttgggactgcatttaacttagaatcaaaagtctgaaatgttttctaaacctattctgtatccatgagtgattataaaagtctttgatgaatggtggtaaatgctagaagaagaatgtccttggcaaattcatattcttcgaggatctctcactcttccatttcagtaggttcttattcctataccactgattctaaccacttcccttttccaggatgctgaaggtacagaaaggtcttctcctagaggaatcaaaatattctttcttatccctgaaaacacatttgtttgatatctctgggactctgtgcttcaacatagaaaaaaaaatgcttgccaaatgtgataattaattctttagacatacaaatttgctgtatccagtcacaaatccaggcaagcaaaagccatcccatcatgatttctgatcactgccccaacctaagctctcttcacttccttcagatgttttcccctgcccttcaaaatcacattcctaggcaaa

SEQ ID NO: 24763 - DNA, 1027 bp, Homo sapiens
atatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattatattcaaagagtgctcaggaagttatgtgttcaaagttctctcataaataccatcgtctgcctgatactgctcttgtctaatagagggttgacattacaaaagaaaagatgtctgactcaagaactcagttgattctgtttgccttaagtttggttcagtgataggctgtcttctaacccctatactcctcttctctcctttaatagatgaggaaactaagggcaaacagttcgttacacttacgggaatcttatttccctctctaggggcagcatgttttcaccttctcctttgctgccaccttggcctaaactagcaccgtcttttagctagaccattgcgttaactgttctcctacacccatttttgttctttatttccacccacatgagtcactgcagccaatctattacaaatttaaatctgattatgaattcccctcctaaaactcttttttaaaagagactttattttttggagcagttttaggttcacagcaaaattgaacagaaagtacagagttccaatacagcccctatcagcatacatgcatagcctcccccactatca

SEQ ID NO: 24764 - DNA, 1037 bp, Homo sapiens
ttccgttgctggtgaggaactgcgttcctttggaggaggagaggcgctctgtgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcgcctgctggggggtgcctcccagttaggctgctcgggggtcaggggtcagggacccatttgaggaggcagtctgcccgttctcagatctccagctgcgtgctgggagaaccactgctccagtatttttattatttactactgacccatgcataacactttacaaaacacataacactttacaaaacaatttttattcacccctatttgtgtatgtcatgagaatccttgtgacagtaactggacttggtcatgcaaagaaagacttgcataatagaatatccaggagactctcaaaaatgaagtataatatggaaaataatatgctttaaattgaccaaaagcttgattttcttttctctctctccttttttttcacccagtttcagggatagtcaggaaataattaacattcctacacctccctccagttgacctgagaggtgaggatgctctcccatccccatgcttcctcacatctcaggccaactgatctctgaaaatggtttccaaacattgagaactcacctcaaaccaggactcaaaaattctcatcaattttgatttttaaaaaatctatactgtaggtcattaaaatgaccactttcaggacaattagttctagaaggacgcattataaggtgatttcttgttatccttccttgaaacagatagctgcattttgtcaaaaataaattcagatcccaagggggcctaagtttagttcaaaccatcagaaaggaggcgactcaagctgtgtttacaatctggcagtttacttccttcgta

SEQ ID NO: 24765 - DNA, 1050 bp, Homo sapiens
ttgcctagggtttttaaaatatctgtttttaatgttttgtttctccctccaggccagtataaagggacttgaagtattttttaataatccgccccccaatgaacttcagaagtgccattctgatttaagggtttttttaaaaaattactttatttgttcattcccagcactgattatcttcataatccattaggacagaatggttttcagtcgttcatatcctgtaattaggtaattgaatcattagctctcagcagttgccctgaggcaagtggaaaggcaggcagtgctctggggtcaccgagaaagtctaaaaacaggaggctgaaggtactgtgatggctttaaaaatggccaccttattaaatagggattgtatcaatattgaaatgaagacaatctttccaactttgggtgtttcacttgctgttttaattgtttgtttttaacactttgtaggtttgtgttttcataatctttaatttgaaactcatgtgtcctcatggatcgtggatgccttcatttcttgagctctcaatgcagacatttaaatggctgcaatcagtagagtgacccgcggatggcataaatgcacctccttttcttggccttggatctatgggtctgggattgtggtcatctcctcaatcctcaaaaagaggctgaatcaatgtggccgtgggtgggaacttacatacagaacccaatgaagaacttgactgtctaaacaagggggcctcgcatggagctgtaaagcatctaacaaatatgaaaaatgtgaagttccaaggtccaagaagaaaaataatgatgtttctgaaagtgatgataaataattacttttaaagtgctgcatatttatacaattgagagattatttttgtaaatgcaatgtctgtgagctgggatacatgggcagtgcttcagacatttaaaaatcactttttactcctagggagatgccaataaacagaactcttttgtttcttctgagtccttatacatttgttttattttttcaagtttgtgtttcttcttgaaacgattctt

SEQ ID NO: 24766 - DNA, 1057 bp, Homo sapiens
ctccaggaagcgccctcaccccagccccactcacccaccctccttcccaccagcctgctctccgcaggcccactgtccttgggtttaatgacgtctcttctctgtggaacttcacgattccttcccacggtcaactcgggacctcccagcgaccactgcagcctgcggacgaggccgggacttggccgagcggatcctaataaggggaaaatggtaaatgcaaacgtcccgttacaattttaccgccagtgtgctgtcgttccccctccccctctccgagtcctcgtggggacacggcggggtctgtaggaagttgggccgggttgggggttgctagaaggcgctggtgttttgctctgagttttaagagatcccttccttcctcttcggtgaatgcaggttatttaaactttgggaaatgtacttttagtctgtcatatcaaggcatgagtcactgtctttttttgtgtgaataaatggtttctagtaaaatggaggttacagcttcaatacactgtatgaattctcctctttgaggtttagtgcctccttaggatattttagtggccagaacccatgcaactgaaaatcgaatgaaatactttttagtcccactaaaatagtagtcgtaccctcccaccacctctaggttacactggttttaaaaatcatgttagtgatgaatttctgaattgacgatgtgaccaagcaatgctggcgctgccttctccaggcagtaaggctggggcagcaggaacctaagaagaaaactcccacccccaccactagtctagtgaacttgggatttctgaaaagacagcaaccatttttaaaaactggttagaaaatccaaatgatctcttacaagctaacaaggagtcacagtcccttaaaaaagaagaaaccaaaattagaaacttccattgaagggagaagttttcgaaaaggaagtcatcagtaggtggagagggcttgctggtgtcataagtggacctggagtagggaaggtaaaccctccccgcccccactgaaatagggccaggagctgcagaccctc

SEQ ID NO: 24767 - DNA, 1050 bp, Homo sapiens
cgttaagaaggggattcctttggtattctagacatcggttaaaatgtcagtgccctaatagtgtgatcgttccatgagcttaaaactgttttttttctttctgtttccatctattttttaaaactgcatctaaacgtagcaagcttgtgtgcccaccacccaaggcaagccgaacccgagataccattttccgtttgcaggggcctggagatccacacgagggcgcgctcacgttccagaagccgcgtttgaccaagaggccgcggtaccttgtctgtccaacactggattctaataggcgacctcaaccccttagaaacaggcggcagctaaggtgtttgctagtttatttgttctaagcagccatgaggtgtgagaagttgtatagagacagaaaacggagcaactagattcacgaaacagcctaatctttgtctctttaaagacaaagctgttgcaaaagaataccttggtataaccagatggtgtggagcagagttttaaaagataaatgtatgcattttgaaagataccatagccactgctggttaattaaattagggaaaatcagttttcttggtttcagtgtggagagccttgtctagggttggacaccccctacttaacatccccctcccccccgcaaaaaaaaaaaaaaaaaaaaaaaccttcatcggttttaccccctctcagacctcctgggatgattaaaaggcttttgtttataacagatcagggagcgggccacttagccaaatgtctctcagaaaaaaataagacgcatgggggactgggagaatcgttctgggagcccgcggccgtgcctggagtgcgcggctaccagtggcgaccgagtggcgccggcaggactgtgagttggtgtgcccaggccgggctgggctgatgcggacacgggaggcagcaggcactcgggggaaacgtttatacttcaaggcgttgtaaaacggggaatgtatttgaagcaaacgggctttgcgtttgacagaaaactggccacccttccaagctgcacgccggtcttgagcagag

SEQ ID NO: 24768 - DNA, 1034 bp, Homo sapiens
ctcaaggcggccccagcggctgcacatctggctgtgcgggggccccttggacttggctggcagccgcctgcgaaacaccgcttctcagcggtctgcagttcctttcctccctgcgcccaagatgggcctgacaagggcccgggatcagaccagaacctctgggggctgaagacctctccccacccccatcttacaaagtgtgtggggcttgcggagagtggccttggatcctaaggcgccaaggtctcagactctgaagtggaagggaaatgcgcgaagtaggagtcttttgtgtctgtgcagaaggaggttctccggccgccggcccttgttgcacgtctggatagaccccttattgcattggtggtagactccccatttgccccctagatttcctttcaccttggcttggaggtgcacagtgcaacccggaggagcgcccggggaagacagcttttaatcgactccatccgctctgtccccaaagagtgacacagcccagaggtggctcagaaccctaatccggggtgaccctaagagcccacaggtccactcaggcccagggcttcaacttttcttccaggagacaagagtgcagatgcaagccactttttgattacaaatgctaatttcttgttcaagctgttcttttaatttttccctggaaagaactgtggcagggagaagggcgtcttggtacaaatatgggtattcatctcctttatggtgcaatattgatttattattaatggtaactgctccaactgatctaaagatgatggaaaacatcagctacattaaatactcataagcaaaataaaggctggcctgtagagcacggcctttttattccatttgtctcacctcagccttagagtcttaggcacactttccatcctttggggctcggatcattcttttgtattatttctatcttgctcaattttttaatgataaaatatctcaaaatattgacagtctcttgtctcaaggagcgggtctgaaagcagaaattttaaagataaaaaatagaa

SEQ ID NO: 24769 - DNA, 1103 bp, Homo sapiens
ttcataaagcgaacgccattatggtaaatttaactattaatcttatcctttacaaagtctcgattgatttgttaataaagtatcttcccgtgtgtggcaacagcgggcataactctttaaaaaccttcagaagcaagaaaattaccaagtagcccaagaatgtagatgagaattttattgatcgccctgattcttcttaatatgtattaataaattccacaaccttttgtaccttgcacttgtcagaaaccagtgcttttacaaaatccataaaaggaaaacatttttctttgcagaagaaccaaaatgacacctttgcatttctctctgtccttcttggcccagtcagttttctaaaacttctggattctgagggtcagagtttccccttttcttaaattattttttcctttcttccttcctgtttgccctccattatcagggtgtggggagagaaacctctgtttagttctcctacagggagcccgagggacgctttcgcggatagtgaactgctggcaaagaattgtctctgggctgaaagctcccagaggtccggccccgcagaggtcagggtgtggttcctctgagagccgaagcctcgtgtagccctccggggcgcataggaacccggagccaggcaggaggaccgagcgggaggacaacgcagggaccaacccatccatggggatccgggcccggccagctgcttggcctcccggccctcgcggccctttttgcctccgccctcctagagacaccttggccgcttcttagccccaagggatctttcctttggacccctggggtgggatgtctcagggcccgcggaatccgactcaccttcccgctgggctgcccgggactaaattaaccagcctgcgcccccacccgcttgtcctggacccggccctcttaagcgcgttctgcctggttgtgtgtggggggaatgcttctgtgcgctggcgccagggcactctggcttccctccccgtccgtgcgtgtccacttggaggcccctagagctgagactttccttccgccggttgggcccaggggccgaagcgggggacgcgagtggggcgggctggccgagcgagccc

SEQ ID NO: 24770 - DNA, 1593 bp, Homo sapiens
tccacaattacacggggaatgttttcctagagatgtcagcctacaaaggacacaatctctcttcttcaaattcttccccaaaatgtcctttcccaacagctctcctgctgctaatacttttttagtagattccttgatcagtgcctgcaggagtgacagtttttattccagcagcgccagcatgtacatgccaccacctagcgcagacatggggacctatggaatgcaaacctgtggactgctcccgtctctggccaaaagagaagtgaaccaccaaaatatgggtatgaatgtgcatccttatatacctcaagtagacagttggacagatccgaacagatcttgtcgaatagagcaacctgttacacagcaagtccccacttgctccttcaccaccaacattaaggaagaatccaattgctgcatgtattctgataagcgcaacaaactcatttcggccgaggtcccttcgtaccagaggctggtccctgagtcttgtcccgttgagaaccctgaggttcccgtccctggatattttagactgagtcagacctacgccaccgggaaaacccaagagtacaataatagccccgaaggcagctccactgtcatgctccagctcaaccctcgtggcgcggccaagccgcagctctccgctgcccagctgcagatggaaaagaagatgaacgagcccgtgagcggccaggagcccaccaaagtctcccaggtggagagccccgaggccaaaggcggccttcccgaagagaggagctgcctggctgaggtctccgtgtccagtcccgaagtgcaggagaaggaaagcaaaggtcggtatgagcagagttgccaccccagcggggcgcgcagcccgggaacccggcagagagggagtgccggggtgcccagcgccgagccggagcccgacttggcaggtgctgctccgcctggttttagaggggtgatctcagccctgagatagtccccgcttctcccctgctgccctggccctctccgccagtcctggccccacgctgatggcgcccgggcagaggaaaagcttgccggttttatttttcctgagctagacctgaacacaacaaaagagcgcaaaggagacctgcggctcataaacacgaccacagagcctcttttctcctgctcagatttgcagttccagttttgccttgagcccaatgatcatgttaaggtgatccagggcaccgtgttcgtgttcaagtgtatgcaccccgcatcctgcgagcttgggggtggtgaggggaaagagatggctgggctggttggtgcttgagttgggaaacagggcttactgcctttgctgggctaggtaaccttggctttgtttaggaaaagtgctgcagtctttgcaatccgtcggcaaagagggcaaaggcggagggggagagtggaacccgcattgccctccctgcaaggccagccttagggctgggctaaggcaaagagccagggatctggctttttgagaaggaaccctcctcctctcccccagtgcttagaggtgggccacagtagggggctccctttctgggggaatgctttagtgtgggggcaaga

SEQ ID NO: 24771 - DNA, 1207 bp, Homo sapiens
aaaccaaaacaaaaacaaaaacaaaaacaaacaaacaaaaaacctcttgatttttttcttcttctccctttaattttgttagaggaaatcaagtctgatacaccaaccagcaattggctcactgcaaagagtggcagaaagaagaggtgcccttacactaagcaccaaacgctggaattagaaaaagagttcttgttcaatatgtacctcacccgcgagcgccgcctagagatcagtaagagcgttaacctcaccgacaggcaggtcaagatttggtttcaaaaccgccgaatgaaactcaagaagatgagccgagagaaccggatccgagaactgaccgccaacctcacgttttcttaggtctgaggccggtctgaggccggtcagaggccaggattggagagggggcaccgcgttccagggcccagtgctggaggactgggaaagcggaaacaaaaccttcaccgctctttgtttgttgttttgttgtattttgttttcctgctagaatgtgactttggggtcattatgttcgtgctgcaagtgatctgtaatccctatgagtatatatatatatatatatatatatatataaaaacttagcacgtgtaatttattattttttcatcgtaatgcagggtaactattattgcgcattttcatttgggtcttaacttattggaactgtagagcatccatccatccatccatccagcaatgtgactttttcatgtctttcctaacacaaaaggtctatgtgtgtggttagtccatgaactcatggcattttgaatacatccagtactttaaaaatgacatatatatttaaaaaaaaaagattaagaaaacccacaagttggagggagggggacttaaaaagcacattacaatgtatcttttcacaaatgaatttagcagttgtccttggtgagatgggatattggcgatttatgccttgtagcctttcccttgtggtgcatctgtggtttggtagaagtacaacagcaacctgtcctttctgtgcatgttctggtcgcatgtataatgcaataaactctggaaatgagttcactccctctgctttctgaaatggaaatatgttatggtggaaatgaaagcctatggtgagattatcttctggttacactccctgtttggggcatttgggcaggggagtgatagactagtaggggaagggagatggggg

SEQ ID NO: 24772 - DNA, 1042 bp, Homo sapiens
aggtcctgcctgcagtttcaaatagcttccagcagttttacaaaacacatcctttccatttcttccttttaaatgtttccctaagaacgatccatttaggtgctataagtcctcagccagggagtctctgggacactggcattcaaaattttaaacttccgccccaaaaccaggaacattccaagacagaactcttttagggggccatttcctgggggtgggggagagggcttggaatcaatgctagattgaaaacgttgtaatagctttgccccagacttaacaccggttgggcaggaggagggtaatttttatttagccgtttctccgatcatgtggggaataccattagctgttgatagcgggccatgtatccgaggaaagcctgagctacaaggcaaaggcatcccatctggaacaaaatcagaaagctattggcaaaggtaatcaatcaggccataaatagccatttacccgcttccttttcggggctggaggtgggccgggagccctccaagggtgagctgggcaacttgtagagcaaggaatatgccctccgctgccggcgccccggccgcttttgtctgggctcccagccgggcttccgaggctttgtaccatggatttgggagtgacaatgggcatttccctcagattcaaggctgctcaacctcacctctgtagggggaaaaaaatcagaagggagtgtcccaaggacctagccattcggccgaattttttagacattttgggagtctcctccgaggcctttaagtgcgaaccgcgcgaagcggccctgcccggggagactcgctgaggcagggctgaggcggcgggcgggagcaagctgctctagcatttgggttctgccctgtggcgtgttctcttccagggcctttccagcatcatcggagaagacgaagcaccctggccgccactgtccgtgctgcgccaactcgcccggccgcccgcccttccgagggcaggcagaagcccctctgtgtcctccaccgccgcgccccggctcgcccctcgggccgcg

SEQ ID NO: 24773 - DNA, 1056 bp, Homo sapiens
gagctcctgcttgctgctcttgacttgttgacagtcacaggaatgaagcattattagtgtcagcagtccaagccccaaattgaagaacgagattagaattggtttgagatgaataaaaattaaattcagtggactggaggtggcatttggccactagagagcgctgttgctccactttctgatctcgtaaagctggaattgcggcggagaaaggttttgattaaaaatattaacaatcttatttttaatccgaaattaggataattttaaccaaaaataaacaaggtgtactattaatttctgtgtttgctgggcataaaattttggctcgatcatggcttcagaaactttggactgtggcacagctgaaactataaaacatgataaattaatgtattatatcaaaacagaaagctgtaaaaagcatagatcttttcttactaagttaatcgcgctctttttctactcatattataaacggaatgcttaaataaatgttaaaaactgttttgtcccaagaggaaatgttgtaacgttttctaaatttggcctgaatgtctataaatgaattttctagtgttcatttttcttttattcccccgaggaatcacacagttctacaagatgcctggtattgttgagatccaggctctttcattttccccccccccattccattccaaaatccactcatttatccagggttcaaacacacacacacacacacacacacacacacacacacgccaaactgaaaaaaaggggcacaattacaaaggtagctccaaggctttattgacaataataatcttttaattgggcatttgcaagattgaaggacaaatccttaattgtcagaatcaattcgttcgccttcggatttaaagaaagtcattatacttggcaataaccagcagaaaaaaaaccccacaaaaacaaacagcaacaacaacaaaaaaacccttgctctccaccaccccaagtctgcactccttactaatttaaaaattaaataaagcatgcctctgtcatctccagattcattaacgattcctt

SEQ ID NO: 24774 - DNA, 1059 bp, Homo sapiens
gttttccccgccttgaagaacgactcaaagggaagcggtgcccaagatgtgacatttctgatccacataacaaccttcagagtgttcattggcaacgaggagatgctgcttgttcggcggaatagggtttgcaaatcagaaaggacagttgaagcttttaatacatgttttcctgaaaaagaaaagtgtgtttcctgcttcttgagatgaggttcccaagctcctctgcatccaggcgtagaagcagtgcgcggtaccttatccgcactgcgcggtgcaagccggccgcacagctcacggtcccgcagcgcccgccacacacccgcgccagaggtccagcgcatgtgcagtgaaatggcctagcccgggaattcgatcggcaaagcacgggtgtgggggcgggggggtgggggggggcgagtggactcgagcaggaagatacacccgatctttccattctccctccgtcaaggctcgctactcatcttgcctttatctcagccttccctgtatagctgaacagttctacctttggctacatttccaatcattatgacttatcacctcaccccagtttaaatctgtacgctagacataggctgaaaatacgagacgagggccaaaggaaacactcttctttccagtttatatatatatatagcatatatttgcccctcggggaaggctgtagatttttttttttcagcctgctgctactactttgggaaaaggccttttctcctggcgcctgttcaaaccgccacacttcaggccaatccttcggcctgaccattcccggatcttgttatgccagcacagcacattcgagggctctggggggcagcagctcggcgaagagcagtcaaataaataaataaataaacaaataaatgaacggacatataagggcttttcccgcctgggttcgcttaaataatgggggacaagcgcctctgggccacgagcttgttgtttgtcctgggatggggggtaggggatgagaggtggcctcaggtccctcttgctccttccagccgccccaggggacactgtagaacc

SEQ ID NO: 24775 - DNA, 1027 bp, Homo sapiens
ttcctacatggctaatgaaacaaaaaaaggagaaatggatgccttacaatccaggctaatagccccctgctttctagctaatgacagtgaaatcaggaaatgggtttgaaaatgcatgtagaatgggtggaaattgggatgcaaagagatctttgtatgaagggatctcttttatgggcttgatgggtctttctgatgggaacagttgcaactgaatttgatttagaaatcatatgtgtgtgtgctctacaaatctccacagaacatccattattttcatcagaatagtcaaaaccacacgtttttacactgtttggtggcaactctggtgggctattgaagggtgctggggggtcaattctctttttatttatgctccttggtgggagctgagggcatctttccctctctcttacccccaccccagcctcccccaagcagagaatgccacattttcctagagagcagcttcaggcccaagctctttccttggctttctcagcaggacagcggcagtgtactactctctcttcctctcttaggctctctccctggtgggggcagcagtgtgggtgtgggggtagtgctcctaaaactcccacccagttttgagcccccaaagttcctgagccttaatcactgtgcttggagacaccatgggagtggggacatctgacttcctaggcttggattccttgagagtctcatttgcttcctcacaccctgtcgccttcacaccagggctgttttattgttttataaccttctttggagctttagttgccaaagattctaatgaggctattctccactttctcactttaccaaaccccaagtcttgctgtgttaagcagtttggtcacttgcaaaggctttcctttcagatctaagcgaattacagaaacctctaggcatgtggctaccttcaactttgtccaagcccatgcacaacaatatggagggagccaagtgttaattccaactgctactcccacccccaaacccacccagcctctccctaaccacc

SEQ ID NO: 24776 - DNA, 1055 bp, Homo sapiens
atctagaagtccacaaaagttagccttagagtttttttccccctgaagttttaatttttttaaaaaccaaatctaaggaagttttcctcagctcattaattagaagcagaatttgtaaaagtataaaagttttcaagcactcgtctttgccttgagaatagtggttttttaaagaatcactctcaacaggggagatgtcctctagtcgtttttcttctgcctctcctgggaagggttcaaagttcatttttctaaaatgctgaccctcaagcataaggaggaagaagtcaaagttaatggccagagttcatatactcagatgaaaccagtcttcccaaggcctcaggctccaaaaaaggttgtagctatcaaaaagtgaccaaagtgggaaagggagaaaggataagcttaaaatttaattttaagatccagaaggggggtatttttttcagtacttcaaaaacactttagaaggtttctgttgtaatttaaaaaatatatttaagtgggagggaaaaaagagtttctctgtaggcttgttctttggctgtgtctcctgagagctgagggcaggtattcactgcagtccctaggctgaaattccgcttctctgaagtgtcttccaagccttggtcttttgtattagaccctggggactgctctttgtttctccttggggtgagcctggctctcagacttgcacatggcaatacttgaatgtcaccacgtcgggatattaaagatggatattcgtgcattattcacatcattgtttctatgacaaaaagcacagagttcatacatagtcaagacgtcttttttctgacgccctcacgttgagaagctgaaaaggtattttaccgaagttcgggtaaattacagaatcaggttcatccagaggacaaattttctatttgattagctgtatttcagccgggaggactgacctctaaacccctaaccttttggactctaactacccttctcttcttttttcctctctaacatggagagcagtctttggatgtaccatttgaaaggagccgctatcctta

SEQ ID NO: 24777 - DNA, 1034 bp, Homo sapiens
gaattcttcctttgtagtgatcattagttcatttctaaagaaaacaaacattccccaagatgtaaagtaataatatttcattaatgaaacataacaagtataaacaccttgtttactcctgtttcttatacaaaatgggcaaaaatgtcttcaaggatttataaccattttgtaaatattaatgtggcttctgctaggggtggacaacttcccggcttctatgggaggggccacttagaaaacgccttcagataaggttcaattcttttgtatttcagcaaagtcagcccacgcatctctatttggtttgacaaataatgcaactcctactacatccccgatgacacgaagtgaaattcctattgtgtggaaataatttaacttctaatcttctggtggaacaacaatcgtttctatttggatgtttgtatttcactaagtaatgatggctcaaaataatatttagtttccttgttcctttgtgctgtttttaaaatggcatgttagatttgggggtgggaggggatatccttttgctaaatttcactttatctgagcaggtttaaaatatatatgttgtagaagtgtatcaacagaataaatgacttcaatcgaaggcacattttacccactttcaaggcttaacattgttttctatgaaatttgcatccataggcagaatttctaattgtcttgtaagaaattattttttaagctattagagaaatcaaaggagagctcactgccttgcagggattacaaccacctttcttaactggctaaatattaactagctgaattgtcaggctgcttagattcagcccgattttccctcatctcctcttcctaccataaataataataaaaatacgtaatgtgtcatggctccaggcgttttccagcacagtgtgttaccgcaggagtatctgctgagtctgcgggtgtctgcaaagccccaagtgtcatttgcggcttagggtttcatggattagactttaaacggtgtctagcccggctgacattagcttcctctc

SEQ ID NO: 24778 - DNA, 1035 bp, Homo sapiens
tctgaaatgtatgctttttccctacaccacctgtatttgcttaatgtattttaaatggttatgtttaccttagtcacccctaatcccacctccctttttgttcttcacctgctcaacaaaattagatcctagagggcaatgacagttttatattcatctttgtattatagttgtgggtacattttggatgtttatcacctatttgttcatttaaatgcctttaatattttttagggggaatcctctgagcattttctactgtgttctcatactcttaaggaaattcttgaccgttacctcatttcctgtttccttcttcttggagaatcttgcagttttgtcagcatttcaggtggtataataataagtcagattctctgtgggggataatttgttctataactagctgggaggagtgaaggaagaggaatagagttttttggttagctagcttgatatgagatagcaaagtatatgtacagtacctggaaccataatcacatagtagatacttaaaaacataggtgctgacattacagtgattgtatttggtttagatgggaagaactacttagtttgaaggatatttgttttctgtctctagagttagatttagagaaccattaaactattgcactgtgaaggttaatgttgttgaggtctcacagttgtgtggggctgtttttgtatctgttttttggccagatggattagacttttactcttaaccagctgtttttctatagttctgctgttgatctcatattcatttttagttctgagaaaaactcatagtatcagtgcttcttttttttttaaatttcagattaccattttaaaaatgaaaaaagtttgagtaacaattacaagactcttctgttaatttatcattatcatatgtagttggcctgctttttattggaaattaatgaaaaataatggatttttttcttttttttttccttttctttttgtgatggggtcttgttatgttgcccaggcgtgcctcaaacttctgggctcaagggatccttc

SEQ ID NO: 24779 - DNA, 1058 bp, Homo sapiens
tcttaatgtacataagactttcctgttgagaaaacaaattttagtaataatgaatccatttattattccacacatctttcttaattatattctcccataatacagctggaagaagagagattgtagaaaaattaatttgtcgttagatcttgaagtcatcactgaatgtttttggtttctaattattttttctaatgcttaattttaacaggttttgagatgctttagcttcctattttttaaaatcagtattatctttatgtcagtagattaaattactgttttaaataaataattcaaaatttttaatataaaaatgtgctacaaagctgataaataaatgttatatataattatcatggatgattattgtaattatggttttgttggagcaataatacgtagaattactcctttttgaataaattattaagtataactgattggtataagtgtgtaacattgctttttagggagacatttttcattttgatatgataatttaggagtgacttgtgttaaattttttttttccaccttaagtttttaagggtggtagaaattgttaaaaggtatgaagacaccccttctgtacataatgttcttttatataaatacctggttttagaggtttatgaatatacatttagaaaacatttccataaaataatttctaggcttgtaaatgtaaacatattttagattcttggagggcattcattgactcatttttgtgttggttttatacgtagattttaggaactacagagttctggtgaaataagttatgttgtgttttgtccatccttttcctctatgtagtcatacaaacagtttgtatatttatgtaaaaaggttagaaggttagtaatctaatgctaaagttcagatctttggcaagtgagatatcaatatagtttatctacctgtttcctaaaattactatacttagtgtcatttaggtagatacctattttctttttattagattgcgcgaaagacaaacataaatattctagagacatacaaaaatatacattctttcataggagtctcct

SEQ ID NO: 24780 - DNA, 1078 bp, Homo sapiens
cagctcactgcaacctccacctcccgggcttaagccattctaccacctcagcctcccgtgtagctaggactatagccaagcaccaccatgcctggctaatttttgtattttttgtagagatgaggttttgccacattgttcaggctggttgtgaattcctgagttcaaacagtccgcccacctcagcctcccaaagtgctgggattacaggcatgagccaccatgcttggcctatattgttatttctaatcttttaaaatattttggatctgaggttagttgaacctacgagtatgggacctgtgggtgaagagggccaactgtgttttctattgtaaaagttaaatgctacttactcacattactctcatttctacttttaggcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtatggatgttacatttactttcttttgatttttctgaaagtcattcactgaattttacacatgtggaataaacagtgtcttttctaaggcaagtaatttgtgttacatactcccaagattcccttgctagttacatggtgaagcagataatgggaataaacgttcttaacaagtgtgcacttagaaaatatggatggttttaaggtaattaaattttggtgcagatttgacatttaagaacattctttatatag

SEQ ID NO: 24781 - DNA, 1028 bp, Homo sapiens
cttattaaatgttccatgtgcaatagaaaagaaagtttattttgctgttgttgcatggaatattctatcactatcagttagtgaaagtgttggatgatatcaagttggttgataatgtagctgatttttctgcctacatgttctgtcaagtattgacacacggatattaaaatgtctgactatactggtgggtttgtctgtttctccttgctgttctatcagtttttgcttcatgtattttgaagctgtcatattaggagcatagatatttaggattgttctttcctcttgattagctgacctctttatcattatgaaaagacatttttttccacaaaagtctttgttctgaaatgtactttaatagcataaatcctccagctttctttgaattagtagtagtatgatatatctttgtccattcttttacatgtaacctatttgcatctttatgtttcacagtgagtttcttagaagcagcaagtagttgagtctttatatacaatctgacaatgtctgccttttaattggagtgtttagaccatttacacctaatgtgattattgatataatgaaatttgaatatactttcttgctatgttttatgtttgccccatctgtttctgtttcctttcctgtttttctgcctgcttttgttttaaatgtttattttttatcttaacatttctgttagttcactacctataactcttcattttgttatttagtgattgttttaggacaagcttgtctaacccattgtctgtgggctgcatatggcccaggatggctttgaatgtggcccaacataaatttgtaaactttcttaaaacattatgatttttttgcaactttttttttgttgttgtttagctcattagctatagtgtattttatgtgtggcccacgacaatttttcttccaatgtggcacaggaaagccaaaagattgcacacccctgttttagggtttctagtatatatctgtaacttataatggcctaccgtcaagtgatactataccatttc

SEQ ID NO: 24782 - DNA, 1032 bp, Homo sapiens
aaaactttttattttgtaggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggtattttaataatacattgtgtaatatgtgaaattgttgtgaaagtttgtttcttgacttaatatattactttatttgtaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttggtaagtagcaatttatggtaacttgaatgagaaagtagaactggtttttctgttttgaactaaatttgctaaattgtaattttctgttgcgtgtaatggcatttatagtgtatagtcaattttcatagtgtctgcctgtgtaatcagtatccagatcaagaaataaacataaacatctcagaatgctccttcattaccagagtcactacctgattatgtcttaatgggttacataatgacagagggtatctcatatatgtgcttttccaaacataaaataactttttgttttgtttgattgaaaaaaaatttagttcagaaataccacactattaatgggcataattgtgaagtgaaaaaggccctttctaaacaagagatgcagtctgctggatcacagagaggtgagtaggaccatacacatgtatacagtggatatgagtggtgtttgtaaggttcttaaaaatctcccttgcctgtattaaaggtcgtggaggtggatctggcaattttatgggtcgcggagggaactttggaggtggtggaggtaattttggccgtggtggaaactttg

SEQ ID NO: 24783 - DNA, 3098 bp, Homo sapiens
gtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacacatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgttttggtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagttgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttagtcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttatataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgt

SEQ ID NO: 24784 - DNA, 1027 bp, Homo sapiens
gcttagttgagaaattgtgtaattcaggtagaagggatttctggttaatatcagatttaccagtgttctaaatgtggaatcttttatgttttatttaaatagaataatgcctaatacaatagaaacatcgatgtagagatcggcttttcaaaatcttctgaaggagtaaaaattaatcttctgaacttagaaaaccgaatttctctcttctcggacactgtcctcatttctccttctctttttctctgtgtttggaccttgaaggtatacagtatttctgttttatggaacagggtagatagtcacttgtatttcagcaaagtcttctgtacagtactgtaggccatgtaatggtttatatgagaaggtgtgtgtgtatgtgtgtgtgtgtgaaatgaatgactagtcataaaacatcacaggtaattataccttagtgggtcccatgttttcaggatctcgttcttattttgggtgttctggcacttgatttgtcagtttcctggaagagatgaggctgtaggggtctgacacacatgccacacttctaagaaactgatttaaaaaattagaacctcagtgtattcatttatggttagattattgctttttcagggtatggaatacttgttagtgccctttctgatgttagggtatctagagaacaacatttgcaacttagatattctttggagagcatacattcagaacaaaggagatttgatggtcttgatagagatttttatacaggctgtaatagaaccagagaatttatctgttggttttaatgggttactaccactcctaccagaatgcattccttaaaggcctcatttctttgcattgttgactcctaagtcagagtccagtgggggagagggagaataagggttcatctgactggaagagcctgcaagggagaccaggaaagtgaatatctggcaaatttgcattagtggagggtagcttttgccttccttcaagacttacaaaaaggataattccccaaacgtataaatgggattta

SEQ ID NO: 24785 - DNA, 2015 bp, Homo sapiens
ctgttttgtttatacattcacctgttgatgaacacttggattatttctagttttgggctattacaaacaaagctgctatgaacgttcatgtgaaagtttttgtatagacatatacatttgtttcctttcggtaagtaactggaaatggaatgaatagatcaaaatggtaggtatatatttacctttttgagaaactatgaagttttttcccagagtgattatatcattttatattcccaccagcactgtataagagttccagtttctccatatccttgccaatactttgtattgctagtctttttaattttagtctaaactttagtaggtacatagtagtatcttattgtaggtttgttttgttttgttttttgagacagtgtctcatgctgctgcctgagctggagtgcagtggcacgatcatggctcactgcagccttgacctccctgggcttaggcaatcctcccacttcagcttcctgagtaactgagaccacaggcaagtgccaccatgcctggataatctttatatttttctgtagagatggaattttttgccatgttgcccaggctgttcctgaactcctgggctcaagtgttctgcccaccttggccttccaaagtgttgggattataggctcgggcccctgtgtctggcctcattgtagttttaatttatatttctctaatgactagtgatgttgaacatcttttcatgtgcttatttgccatccatattctttattggtgaagttctccttaaattatttgcccaattttttttttttgagatggagtgtcgctctgttgtccaggctggagtgcagtggtgtgatctcggctcactgcaagctccgcctcccgggttcatgccattctcctgcctcagcctccccagtagctgggactacaggcgcccaccaccatgcctggctaattttttgtatttttagtagagacgggttttcaccgcgttagccaggatggtcttgatctcctgaccttgtgatccatctacctcggcctcccaaagtgctaggattacaggtgtcagccaccacgcccagcctatttgcccaattttaagattgggttgttttcttattattgagttttggaattctttatttattctgggaataagtcttttttcagatatatgctttgcaaatattttctttcagtctgtggtttctcttttcattttcttacactatcttttgaagaccagctgtgtttaatttttatgaagcccagtgtattaatttgtctttctatcatgcttctgctgttgtgtcataatgcaaggttatagagattttctcccatttgagttttataatttttagtcttagatttaggtctctaatcagttttgaagatttctgagttattatttgtatatggtataaaattggattgaagttaatgatttttgcacatggatatccaattgttcagcaccatttattggaaaagattatcctttcttcactgagttgactttgcaccatcatttaaaaaaatctgttgtctatatatgtctgcttctagttctggactctatatatgtctctgtgctaatactatactgtttggattactatagctttatcacgagtctttttcaaagttgttttggctattctaggttctttgtatttctatatgaacttcatgttcatatggaaatgtcagtttctgttaaaaaaagaaaaagtcccattgggattttgattgggattgcattgactctatatatcagtttgaggagactgacagcttaacagttttgattcttctgacctgacccatgaacatggtatatctttagttttttgtaggtctgtaatttctctcagcagtgtcttacggttttctatgtacatgtctttcatatatatatattttagagacaagatctcattctgttgcccaggctggagtctagtggcaccatcatagctcactgtaaccttaaactcctgggcttaaatgatcctcctgctacagcc

SEQ ID NO: 24786 - DNA, 1051 bp, Homo sapiens
tttgcttggtgtattttaaagctcggttattaggaggataaatgttcaggattgttatggcttctcgattaactgacccttttgtcgttatgaaatgacctcctttatgtgtgataacatgctttgctctgaaatctgctttttctgatactaaaatagctattggagttttcttagcatggtatatctttttgctttttccattattttactcttaattagtttgtatctttatatttagaatgtttttcttataggcagcatataattggttcttttctttttatctaagttgacaatcactaccttttcattgaggtgtttagatcatttaccttcagtgtgatttattgtggtttagtttaaatctgtcatcttgctattcattttctgtatttcccatctgtttttgttcttctttccctcttttactgcctttttgggatttttttttaaatgatatgctttatctctttagtttctttagtagttttaagtttttgttttgttttaggatttgaagtatacatctttaacttgtgtcagctacctttgagtgatattgtaatactttgcagtatcatttaaaaaatttaaataatatgaaagcatcttgtgtatttacccatctagttaacctttcctatacccttaattttgtctgatgttatttgccttctgcttgaaggacttcttttaacatgactttagtgtgggtctgctgttggcaaattctaattttgtctgaagaagtctttatttcacctttgtttttaaaaaagatatttgaagtgagtatataattgtagattgatattctttcagcagtacaaagatgttgctccactgttacctacttcattgcttttcatgagaaatctgatattatctttgtctttgtttctgtgtatgtaatatgctttttccccctctggctactttttttttttttctttgagacagagagtttcactcttgttacccaggctggagtgcagtggcctgatatcggctcaccacaacctccgtctcccaggttcaagcgattctc

SEQ ID NO: 24787 - DNA, 1321 bp, Homo sapiens
ttcacttatttagtaggaagttagtaagattttaaatgaagtaaatttaaattggtgtggtagagctcattcagcatggggaacatctggtttttttggtatctgtatcttttgctttacacaattcctggtatatagtacctgcttgtaattggagaagataatgaagtaacctacctgacaaaagaaacaaattaatcgtatatataatattggatatactgatagaaataaagtgtaacaccgcactgttaatactagacagatcaacgagacagaaaattaacaaggatattcaggacttgaactcagctctggaccaagcggacctaatagacatctacagaactctccaccccaaatcaacagaatatgtattcttctcagcacctcatcacacttattctaaaattgaccacgtaattggaagtaaaacactcctcagcaaatgcaaaagaacagaaatcataacaaacaatctctcagaccacagtgcaatcaaattagaactcaggaataagaaactcactcaaaaccgcacaactacttgaaaactgaacaacctgctcttgaatgactactgggtagataacgaaatgaaggcagaaataaagatgttctttgaaaccagtgagaacgaagacacaatgtaccagaatctctgggacacatttaaagcagtgtgtagagggaaatttataacactaaatgcccacaagagaaagcagtgaggatctaaaattgacaccctaacatcaaaattaaaagaactagagaagcaacagcaaattcaaacactagcagaagacatgaaataactaagatcagagcagaactgaaggagatagagacacaagaaacccttcaaaaaatcagtgaatccaggagctgttttttgaaaataccaacaaaatagaccgctagccgactaataaagaagaaaagagagaagaatcaaatagatgcaataaaaaaagatacaggggatatcaccactgatcccacagaaatacaaactaccatcagagaatactataaatgcctctacacaaataaactagaaaatctagaagaaatggataaattcctggacacatacaccctcccaagtctaagccaggaagaagtcaaatccctcaataaaccaataagaagtcctgaaattgaggcagtaattaatagcctaccaaccaaaaaaagtacaggactagacggattcacagctgaattctaccagagatacaaagaggagctggtgtaccattccttctgaaactattccaaacaatagaaaaagagggactcctccctaactcatttt

SEQ ID NO: 24788 - DNA, 1055 bp, Homo sapiens
acatccaactcagaattgtgttttatctcttcttctcactttcagctgcttgaccaaagttttatcttctttgctcattaacattctaatacaaacagtccccttcattttttttattataccccattctcaagtagttctagactagagctgcttatatcaaatctttgccacttcttttggataacaccatctacctatagtggcaagtcaggaaattttgatttagcccatttagcttgaaattatcttacagtatttgtacagaacaagagtacatctacattgtagtgtttacttactaccaaattcaacacaacttcagaagaagaaaatatttaattataaggtgttaattgaggtgataagataaacaatttttcctttagttgactaaagttaaaattttaatttctgtatgataatggaaaaagcataattaaaaactatttactaaaggtagtggaaaaacagtattcattcattgtcttttaaaataagaataacttttacaaacaagagtacttggactgaattatatatttgtatgggattaattctaactagatcatcaaatacaatttctatggatgaaattttccaattgaaagagatagtttatatgttcatagtagtaagaccttacctgtgttggtcttgtgtttgtttatacattgctttataaaatatttctatgtaagtatgttttgtctctcatttaaatcataaatttcataaaataaacaccacatctaacattccaaatactatgtactcatcttgtattctggaagcttctcagtattggggagttcctagtcgtcacatttcttcaaatatgagtgagacagtaataacatatgaatatatgagtaagaatatgatgagtaaaataagaatacttgtgtgaagattatttcagcttatttgtttctcatagttaattctttctgtgcttttttgagaatatgggtagaagtagttgagtttatgagtcaattttatttcgtggataaaagtttgaaattaagatgaaacagaaatattaaaagtgt

SEQ ID NO: 24789 - DNA, 1025 bp, Homo sapiens
aataaatgagtgcattagagaaaaacacatgctttagatcagatcagtaatttggggatttttttgtttttttccccaaacacaggtgggttgaaatgactcattttacttgaagtgaaaacttaacatatgttgagttttctgccttataaaattttctttaaaatctctggacttctgtgaagctttctttccaattttgataacaaaacaatattgctctgggtaaagaaattaagtattataagttacttgtaatatgagtattatatcctctatactgtaaaatattttcgtagtagaagtgcctccagatgtttgatctattctgtcacttcagatagctgcactatattactatgttttctaaatttgtttttaaagaaaagttgattttaagaaaaaaatctcctcattctaaacaccttccccctgcccctcacttcttgatcttcctactcctttgatcttgactaattttcgatattggttaatttactatttatgccactaaaattctgttctgtcagtattctctacatgtacacagactgttcctggatagaaactccattcactaaagaaataaatttgagttcttgccctgagtcaggcactctgcctggtgccaaggatacagagaataagacagacaaggttcctttagttacggaggctgcatctcactccagggacaacttttcagtgctcttatgaggtggatagtaaagagtggatgaagttaaatgagaaacatgtgatactaacaatgaatatgaaagactaacagtgttattgattcttctgcatctgttgtagtttcttgatttttctgtttgtgtcttaataggacttggctttggaatactatgtattaggagaatcttttgagacttctgctccttgggacaggtaaaatatactaaagtgcctgatattattcaaatatgcgatatgaattgcttgaagtaatgtttctttttgtgtgaatatgtaagtttaaaacattttatgaagaaacattg

SEQ ID NO: 24790 - DNA, 1027 bp, Homo sapiens
tttggtgaaataatttattttttaggaattattgggttgaagttgaatctagcaacgtttgatggcatattaatttatttagaggttttgcctcatttaaatagaaatcttttatgtctatcctatttcttgtatttttattttctatgtggtcaaaatatgaccgcatggaaacagactctgaaatacctggttttctctagtgcttagaaaaagaaactttgataagtctgaatacaaaacatactttaggtatgctgataaaatgaagatgctttcccttttctattttttttctcttctaaattgctaaatattggagtcttccagggctcagccctcagaccttcatttctctatattcactcatttatttgatgattatctcaagtttcacaatttaaaagaccatctgtatgctaactcccagatatcaaaagataacacctctataccactaccctagttgcaatcactattttctgcagtagcctcctaactggtctttcttccactctgctactgtattctcatttctcttgctgctcgattaatctgttaaaaaaatcaatggtttcttctcacattcagaacaaaatgaaaactccttatcatgaccttcaaggatacattgtatatcactctgtcctcagctttgattactttgtacctctagcagcattggccttcttgctattcctcagacatactaatcccttttcccattcaaggcctttgctgtttgttccctctttttataatgttctttcttttgtcctctccttcagatatttgcatgactcactttctaccattgtttaggtctctaataaaaatgtcaccttcttagagggatcttccctgtcctcttgtgtagtttctgtaatccccatttgaattaaatttattgaggttaatgactttatcttgtttgtcactgtatttctcactccctaaacagtgactggctgctctacatagttcaacatcataaatgctcaatgaatatgttaaatgagtggataag

SEQ ID NO: 24791 - DNA, 1129 bp, Homo sapiens
gtctgcgcaacatagcaagactctatctctacaaaaactaagaaaaaaaactagctcactgtggtggcacatgcctatagtcctaactacttgggaagctggggcgggaagatggcttgagcccaggaggttaaggttgcagtgagctggcatcgcaccactgcactccagcatgggtgatagagagtaagatcctgtctcttaaaaaaaaagaaaagaaaaaaggcagtagtcttgtagttaatttagcttaacatttggtaactaggcctaaatattgaatagagggtcatatttagtcatagaaagtctcagtttattctctaatatttctgggaaagcatattagcagagtgagttagttattcactggagaagtagggtaaaataatgtgcatttttctgcaactccataccaccaaccatttagtgttcttccataaatgcattaagtatgtaaggtttcattcgaactttttgtcttaaaaccaatataaatttgagtggctgaacaacagaggggaaataatgtaggctatggaatcaaatctatattggattcctggttttgcatttaactgtgtgaccttagggaaataatttctctgacttacactttcctcacctgcaaaatgggaataatggtacctgtctcatatgtttattgcaacacttaacgtgttaatctatgtaaaacatctaaatgccttacatttagtaagtgcttaaaaaacaatagttttgtttgtttgtttgtttgtttttaataatagcaataaacagcaccaggtggcaatctgtttggcactcttgccttaaccattaaagaaaggattacagtgtatttgagaaagatccatacattcaagggatatgattcaacaatagttttaacacttcatttataaactacagttgatctcaccctataggaaagtttcttacaatcagcatgaaagaaaaataaatttccttcacagtattggctatgaaatttgctatcgaagaatgttattttcataatagcttttctgtttataggtaatcatataatttgtgtatttcaaatgcctgctgctattcagtataattgcataaagcagaaaccttttcaacataaattttaaat

SEQ ID NO: 24792 - DNA, 1022 bp, Homo sapiens
tgaggcaagaagctttgggacatgaacctagagtaaatatgtttccatttggtaagtaggcaacctttacttttaatagtataatgtagtatatgcaatctaatttgggttttaaagaatactctgttattgggcatctataaatttcacctagtgaataaaaatcttaaatgtagtttttttattcctaaaatgtggattatgactcctaaagttcttaatatttaacacttattttgtttaactgatttctaattatagttttctctgttaagttacgcattcctcatattagaaactattaccactgccacttttttgggtgagcttctgcctctatatagctgaccaaaaacttaaaaagacatatgtagagatcctctccgtatgagtcctaaaattttgttccagaactactgctactttaaaattagggctacagaaaggagaggaatggtaaaagtagaagctctaatagaaaaaggggaaaatgggtaatgaaagtaaggcctgtgaatgttatttgacgtaaacattcaggtaaaatacttaccatatttttcagttttgcatactaaacttctttctgtgaaattagactatgcatttcttcttatatttctgcattaaaggtaggggagtggggagagttgtctcttcttgtcattagtcccatcggtagttctgatgaccagaagcgtactacaaaatacagtgcctttattcagtacaatggactctgttttctagtatttaaaatgttaagcgaattgttggctgtgtagaaatctaaagatttacttttttttatattgtcggagaacaacaatctgaattttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtaaaataatgttcacattaa

SEQ ID NO: 24793 - DNA, 1063 bp, Homo sapiens
gtgacgcatgagtaaaatcaccttctgtcacttggatagaaaacgcaaatgggcttttttcctccatcttccaataaactctgctttatgtgtgctgctctgttcttgtcaatgtccttttaaaaactatcttacaaattttatttctacgtcatacatctttttatcttggagatcccaattcacaaaaattatttcaaattgtttttgtttagtatacaaaggagtagtttgcatgtaacactggaaaattccttccttcatcattgtggtgtaggggaagtaactgaaggcttaggtttcagttttgtccccatccctgccattgaatcagccatgtccttgatcagtggagcagccagaaggaagagctggctgctccttgctttctggtcccagctgccctgttctgccccagcagctgtctgccagctgattactcagggatgttctgggttatacgtcaaagattgaccgcagttattttaggaccgctaaagatgtccttttgggagaatataagctgtgcaatctagaattatgaagaattagtattacattctatgccaaaacaggaataagatgaatagtcttatttataaaaattgacgtgaagtcactgcaacatcaactgtcctagaacctaatccatagaaccttaactattttctgtttgttaaggaggtatatgtagtattccacttcccatagataagttaaagattactttgagttcacttaaatacagtacagaaacatcaaatcatatatcctttcagcctatttactagtcttttgatttcagattcagaaaggaaaggtccatgggagcatagatgtgggactctcagtcatgtcaattaaaaagaaagctcgaagaatagaccttgacaccgaagagcacatctatcatttgaaggtgaaatcagttttcaacagtttctctgccattatcaggggaaacgatttgcctacaccagtggtaggcaggagagttattttacaattactttctcctctcgttcattgttttaggtgaaatcccaggactggtttgatgcat

SEQ ID NO: 24794 - DNA, 1049 bp, Homo sapiens
aagttatgaagatttttttgagtcatcaggagaaaatgtccaaaaagctagaaaatattcattcatacttccgccacatctttgggtggttcatttgtttttaaatttttatttatgctatttcaccttgtttgtgactttgctaagggtaataaaatggcctttgtaattctagtttagttacttttgagggaaattgaaatcatctcatccctcaaagacactcaaagacaactgcctattggaagtgggagatttagttccaattccaagaagaaacaaatagacagtaagctgttaatcattcccagagaaactccacttccacctggactaaaacaaaaggtattttaaggggaacacagcagagcttggtcctatctgtggaccttttctgcttgcccaaaccaacaggtcttgcaggagcctcaggatactcattctctactactgggaagttcctccaagatccttcaaaattcacacttggctagggaatcataagttcatctaggatgagtatgacaacatgaaaatctttactcagtattttgcctagagagaggcatagcatctaattttactctagtggattaaagatacccaccactttctcctacctcatacccagctttttcccctcctgttttaaatgttttgatcatgagaattctatctaatgagtccaagtatttgttttgagtcaatgatcatctcaccactcaaaccactttcgctgatgttgcagccaatatgagaggctctcaagcagtgagagctcattttctgtccccactcttcttcgtaactaagtacaacagccattgtgaaggtgcccagaccattcagtggtggtggttgtggtattgttgctgctgttgttgttatcaatgttgtgttactgaactttgtattcagtattccatagtagttgtcattttgaaaaaattttaaatagatcattaaaaaaattgaccgcaagaaagtaaaaatgaaaaacatgttatactggatgtttgattgcttattcttgtgtaggttagattgtg

SEQ ID NO: 24795 - DNA, 1041 bp, Homo sapiens
tgctacagctactactgctgctgctgctgctaattaatagctgacatgtgtcaagtgaatgcttactatgtgctaggtattgtgttaatgactttgcatgtgttatctcatttgacactctcaacaacgctctgttaggtggtattattattccatttttcagattgaagaaaagagaataggagaacattcagtatatgggctaaactaaacttaagtgtataattctgtttatgactctccataaaattattactttatagcatgagaacttacactttttaacagtaatgttagagctttatatacagtggtgatatatgtaacaagatgagaggtttaactgatactaaggtcatatttgtaccaaaaacatacattttactagaaatctataggtacaagggttctaacctcttaggaaacgttatcccaggacaacttgtctttgacttaagttttccaccctaaatccattcacctccatgggccctgtgttctcagataacacttgtattcactcaactgcccagaatctagaagtatttctaaaatttgtcattcaaaaataatttgataatctcagttggaatcttcttttcaacctgaaatgtgcactagaatatatatatacatttctcttacattttttattgaaacttaaatagcttccttgaaaactatttatcacttattgaataaaagtataatttgaaataaggttcaatattccagtcatgtgttttattggttaaaattcatgatcaaattggaaagtgacgtatatagtctgtctcaaaaattagttttatagattttcttagcataactctagtagtttctacgaatatttcttcatgtttaatgtaccgttagaatatgacagacctaagaataagagaatgaagttgtctctacagtcaatcagggtattcatagcggcttaacctgactcagtatcaatcaatcaaagatttaaaatcaaggcacagtaccaacacctttcaactattccttttggggtctttagacacattggaa

SEQ ID NO: 24796 - DNA, 1074 bp, Homo sapiens
gaatgcatctcctacagctggtgctgctgagtaaccactctgatctggcatcttctttgatcaagttacagagcagagtttccagggctggggattgaagtcctgcctcctccctttgtctctggttgtcctcggtaatgtttttccctcaaggtactcatgatacttcccatggggtgagtcagggacaggtctctttccagggaatccaggatggtagggaggttggttgtctaccttgatctcactttttccattgtagaaactgtgagttggggaaagttttccacacacttggtgctggacagattgtggcaaggggcaccacagatataaaaatctgattcttttaccatgctcagagttttttcacttctgtgtccccaggaattgactcatcctcatatctgagttctgggatattgttggtgataatctcagtgctgtatatttgtttttggttttctggtgtggaagtgaagccagcttgcgtctacactgccatttttgaactagaagtccacctgatgccatgtgggtctgctctaacaaagatgcctgtagctgtctctgtaggtacaattggagctactacctcataaagtttgtggtagcccactatctggtttttggaggggctagactggtaaattaaatggagatacaatttgaaccatcatccccgaatcttttaggtcttttaggatggcattaatttctgccattccctgaaatattattttttgatttactgtattggtatggagaagaggtcaatttttaaagcttccacctggccacttggcctttatcactatgttagctcttaccacacacaccgagaaacctggtgccactaatcaagtgtatttatcacaattatacactcaaggactaggtgggtctgtggatatattgtgagccagacttgggccaggacaccctaggacttggcctccataacccttactctaatcaagggcatatagtgagagttctgtgatatcattgttaactcagaccctgtttccaacagatatcaaaatgttgagtattcccctttcaccactgtat

SEQ ID NO: 24797 - DNA, 1010 bp, Homo sapiens
ccttagcctcccgagtagctgggactacaggcatgtgctgctgtgtgcagcagatgtgtacaaaagagctttaaaggtagtactgaaaacagttcctttatagttctatgttgaaaataatttcttcccacttttttattgtcttaatttacagattttttgctgtgcagtaggttttatgttgtcaaatgtattaatcttttaacctaggttttaagttaaaatgctttccccatgctaagatttttaaaaagaaaaactcttccatgtttcctaatatttatactgtttcaaatttttatgttcaaatctttgatccatctgaaattcactttggtgtaaggaataaggaagcattctaaatagatgtcatacacatcaacaaatatatatatatagcccccacccaaatgtggatgtaaactgtttctacatcattattgaataatccatcctctcacccactgatctgaaatctcactgttgctatatactatggtcctatgtggattagcatctacgcctggattctctattcgctcctctgactattcctggcccagtaacttgtctgacaagttcagttttacagtatgttttgttctctagtaaagcagcacacccttgctctcccaactcttccttttcagttttcttggctattcttgagggtttttttccagataaacttcaataaacgtgtatcaaggtccaaaatgaacgctggtaggtttttttttttttcgagttggggtctcactctgtcgcctaggctggagtgcagtggcgtggatctctgctcactgcaagctccgcctcccgggttcatgccattctcctgactcagcctccggagtagcggggactacaggcgcacgccaccaggcccggctaatttttttttttgtatttttagtagagacggggtttcaccgcgttagccagaatggtttctatctcctgacctcatgatccgcccacctcggcctcccaaagtgctgggattacag

SEQ ID NO: 24798 - DNA, 1862 bp, Homo sapiens
gaaatccatttattctgcttcttctcacgcttctcaaggtagtaatttctaatctttgcacctccatcactggcaggtggcttccaggccacaacacaagaatcttttgtgacagcagtaatagttggtttgccaggagcacctggcttttctattaaacaaaaaaaagatttgagtcatgagatgaaacaggcagctttattaaagcttatttttttaaaaaagaatgttatatgagtccaaaattttgttaaaaaatagctattccagaaagatgaaattggttactttatactaagacatatcaaaaaccaaagttctatttttacaatggggttaggatatatatttctccttttagatatgcaaacattcaattaaagtgaaagaaaaggcacttgtactttatctgaatctttgctatttcctttcaaaatttctttctgtttaaaagaattttatgcaaagatggaactttaccataggaagatacagaaatcaagttgtactcaccaaatggactcttaatgatcacaactgaggacacttctagagggtcactgatgccgaaagtgttctgagctgaaacccggaagtaatagccagcattttctgtgaggttcacaattctacaggttgtcactgagatggctgaagacaccaattgccattcagccccctccttggcctcacatttttccaccacatagttggtgatccaggagcctccgtcatctgcgggtggtttccagctgatcactgcggagttcttcaatagagcttcgatcacaattggtcctgtaggtttgtctggtttatctgttgggggaaaatacaattgtggtggttttcatagtgtgtttttgagatttttttttctttaaaaataaaaagcactgaaaataaaaataaaataccttgtatttccacatcaaggatggcatcaactgttccaaaaacattgctgagctggactttgtatttcccagcatgagtcttacgttggacattcttcatgacaagatgagtatagtgctcagtgttttcaatagtaatgttttctgagttttgcaaaagtttctgaccatggaaccaagtcatggcaggtactggacgaccaatgtacataacatgaagccgaagtgtggaacccacagctccataatatttctctttcagtgggtaaccaggatggaactgcggtgttgcttgcaggagaagcttactactggtttctacttctccaacctcattggtggctatgcaggtataaacaccttcatcttcctgttcctctgtcattactgtaagagtgtgtgtgcgtccatctgaagacattttgtatttccggctttgtatgagctctttaccaaatctgtaccatttaatgtcaggaagaggccttccaacaatctggcatgagagttgagcagcttcacccaattttgtggtaacatccttcatttctttgcgtattcctggggcctctccagctgaacaatatgaaagataatattaagtgactgttaatactcaatctgtaatcctttgtccttgtatatcaggaatgaatttaccttatttactgacacataccatgatttacatattagcctaattcttaaaaactctttgaagtgattttcctaggatcatatggtaaatagggattcaatgagcacatcgtcacattttatgtagagtgtttttttctctttatgattggaaggggattaataatgtataggcttttaagggactgtaaattctctctataattctgtagtattcttgcccttacttaggttcattgaagtggcatacaattgttgacctttcaaatcttgttgggaaatattttt

SEQ ID NO: 24799 - DNA, 1033 bp, Homo sapiens
aattttaagtgtgatagaaagcatatattatgaatctcatcttaaagaagtggaaattgactccagagaagaatattaaaaattatttgccagaaatcgctagcagctggggtggggaagggactgattacaaacggacacaagggaactttacggggtaataaaaatattccacattttgattgtggtggtgattacaaaacagtacatttttcaaaagtcatagaactatatatttcaaaaaggtgaattttcccacatataaattgtaactcaatcaatttgactgatacaaaatgtccttaccaattggatccatggcaacgatgggtttggaaggacgacttggtttcccagaccctcttgcattaatggctgtgacacggtgttcatattctaagccttcagtaaggccagtggagcggtaccgtgtcattgtcacaggtactttatttacacggacccatcgatctgctctcacttctttgcgctccacaatatatccagtcacttgggagccaccgtcatcctctggtgggtaccaagtaagtgtcatgccatcacgggaaacatcaaatatctgtaatgtttctgggggtccaggaatacctgcagcaagacagaggttaacacgatatggcaatatgaatacgttaaaacaatgactcatatatttgtgttttccttaggttttggttggtattttaaaaggtacataaggcacatgactatttttccaatagtttcacttttgtactatttgtaaattttaatttaaatcatttaattatttaattatttttattaaaaatttttgacttttagcttcaggggtacatgtgcagtttgttacatgggtatattgcatgatgctgaggtttaattttgtactttccttgctgttcctcattttcttcaattctacatttattaagcatgcactctgtatttttttctcactataacattgccagtcctccttcctttcctctcttcctccttcccttctctcttttcttccttccattccttt

SEQ ID NO: 24800 - DNA, 1024 bp, Homo sapiens
tataatttaatattattatcttaagaattaaattgctttaggaaagtagatatttcttccctacttctttggccagctttactgtgtgttctctattagctaagctcattacttaaagtacccattcttagggacttttctttagttgcttatctttcactgggttagtatcacttgccaccaatacatttctaatgaatacaagaattggtttccttagcttccccaattcagtcccagtgactattcctttatagttcttgggctcagactctgtaaaaggatttgccacttatttttgaagctcttgtcacaattactttgtcagtaacttatgaaaccactagaaactgtatgttcctgctaaacctcttcttaaaaggagttttgccatttttcttttcagttattacagtacaatgcatttttctctaaggaaaatttataaaatagattcttttcatattgatagaatattttttcattaattggaaaatgctgtacaacttttagcaattctaattgctaacttaacagatgtaatagttaaaatgttctctgacttaagctatatttatgatcatgcaaataagcatgtgcttttctagaccattcataaattctaaaaattcttagagattgtgtgttggaaaattatctgtcatatagttttgaggagcattgtatttatgtatgattcttggagctcacatgatggttctctgcatgagatgaagttggaagcttcgctgggctcactgttaccagctgcattcactgcggtcacccggaactggtaatcacaaccctccatcaggctggtcaccttcagcctggtatcatacaccacatagtctttgttgacacgtgtccagcgcaggctcttcttctcacgtttgtctactaggtagttgctgatttcattgccaccatcagattcaggttttgtccactgaatgatgatatgctctttgccagtcccaacttcttcaggtatgccgggtggtgatggaatagctgttta

SEQ ID NO: 24801 - DNA, 1038 bp, Homo sapiens
caactgctttaattgtgccagtcacttcacagctgtcgccttttccagcaccattgatagcactaactcggaatttgtattcttcacctgcttgtagatcagtgactgtatatcttgttttcacacatgcctctgcattcaccttgtgccagtctcctaagtcggccttacacatttcaataatatacccaattatttccatgccaccatcaaacactggtttggaccattctaagctcacagttgtctttgatgtgtctgttactttgaccactgtgggaggacctggtgggttgacgggctctctacatttaatgagtcttgagatgccacttgcaggtccaactcctgcagcattttcagccatgacatggaattcatactcattgccttctgtcagaccagtgactttgaatcttgtttcagagattggtcgtttgctgatcacttttacccatcttgtgcttttcttttctcttctttcaaggatatactgttgaatttcactgccaccatctgattctggccttgcccatgtcagggtaatgctgttgcctgttatgttgctaggttctggaatgccaggggcatcaggaacagctgtaaaacaaaaacaaaaccccaaatcaattagatgcatttgcttggaaggttaaacttttgacatagtaccgcttagtaaaaacgcaaacttactatattgtatttgagcaaccactggatcagaatcaagtggcctgccaacaccaaacttgttaactgcagaaacacggaattggtattcattgccgtttattagtttaatggcagtgtaactttgggcttcacatttatcctcaattagtgcccaggcaagtctgctggtttcccgtttttcaatgatgtagtgggttatgggagcacaaccgtcattgagtggggcatcccaccacagagtcatcttctccccagtaatattggtgaatcttattggcccaactacttttcctggtgtatctataagaaaaagtttctagagttagtttctttttccttgtc

SEQ ID NO: 24802 - DNA, 1053 bp, Homo sapiens
tctatattctcttccagagattggtgatgtattaactttttgccagaggatgctatttctttctttcttttcaacatggaatccagtaacttctgaaccaccatcataaactggagcatcccaagttagtgacatgccatcagaagtcacattgtatataactggctttcctgggggaccaggaatcctgaactggtgttttgccacaataatgcttgagacaagtggttggctgactccgtatctgttttctgctctcactctaaactggtactcagcatctttgactagattaggaactttgaaagtcgttctggcaacacttgaacacaccatcttccagttagtttgtgaagtttcccgcttctcgatgctgtaacaagtaatttctcctcctccattatcttcaggtacatcccatgacaggatgacactatcagccttgatttcatcaaatcgaatgggtcctttgggctttgatggtgggccaagggtgatgactgtaatggggactgcaattctacacactgcattatcaagaataacagtgtattttcctccatgctccttcttggcattcttaatactcaaagtaattttgttttcagttttactgaagcgaacaaattcactttctttcagtggcaagccatctttcagccaactgatggatggtttgggttttcccttataaggtaattcaaggtgcacattgtgcccaattctcacagtgacttgtgccccagggatatctgacaggtcaacttcaggtgtaataataagttctttcactgtaattggcccaatagtgacaggatcactcagtcctttctcatttttggcaaacactctgaactccaggactgactgctccttaagttggctaacctcaatttcacatgtcttacttatgccagcgtgggaccacgtctgttcacctttacctttcctttctacaacatattctgtgatgacgctaccaccatcaaagtcaggtttggtccagctgaggatgacagatgtctttgttgagtctttcattgagagatcacg

SEQ ID NO: 24803 - DNA, 1051 bp, Homo sapiens
ccaagactcggaagtagtaagaacatccttcttgtagattttcaattctgaaagtagttttagtgcaattatttgtaatggtagcataggcttttcttgtagtttctcgtttttcgacaatgtagtttgtaatcttagctccaccatcaataagtggtggttcccaggacaacgtcactgagtctttcttcacttctcttatggtcaaattcacaggggcacttggtgagtcaagaactctgacgttaacaaaagctgttttggagccactattattttctaatgtcagattataccgaccactgtcaaatctggtaacattatcaatcaccaacattgtaaatgagctggtcacctctatctgagccctgtcagtgagaatgccttctgccttttcccatttaacttcgggttctggtcgacctttgatagtgacaaataagcgtaaagtagcacttgcacgcagaacgaccacctttctgagatcagcatcgagttctatttctggtggctctatcctctcctgagcaaccactgagccaggtagagttgcaggttcacctacaccttcagaattgatggcacaaatacggaagttatattcagtgttttctttaagcttggtcactgtgaactgctttccttgtaatcctgttggtggagtgcaggttgtccattcatccgcagcagcttctttgacctctacaacatagcctttaacaggtgcgccaccatcataaattggcttactccatgccagggagacagaagatctggaagtgtccgtcacttttggattgcttgggggacctggtggatacaaggcatcacacgcacggtagaaaacagatggctcactaggttctcccacaccagctgcattttcagcagcaactctgaattcataggaatggccttcggtaagaccagttaccctgagccgcagatccgttaatgttttcttgttgcacttggtccatctaacgccttccttatctcgtttttcaagaatgtagccctcaatttcggtacctccgtcgtctactgggcg

SEQ ID NO: 24804 - DNA, 1049 bp, Homo sapiens
gttgagggaggacctggtggcttataaggattacaggccgtaacaggcccagattccaagggctctccaattccatatttattcacagccatgacacggaaaatgtactcattaccaggaagaagtttagtaactttgtagttaagggcctgtacctcagttgaaacctgggtccaagagagtcggcttgtctccctcttttcaatgatgtaatgtgaaatattagcaccaccatcttgcaaaggtgggttccatgccaggtaacatttttccgcagtaactccagtaactttcagaggcccttcaggaggccctggcctgtcaagtacctttacagtgatgggtatagactttgtaccaccaacattgctgagtttcagaatatattgtcctccatcagtccgtatacagtctttgacaacaagagttgttttctgaatagtagatttaatttccattctagcagctgtttcttcaagttcttttccatcttttgaccaaacaacatcaggtataggtttgccacggatgtcggcttcaagaacaaaagtctctcctgcatgaacaacgatgacatctttatattttggatccagagaggcatttggtgcatcaatttcatctcttgcagtaatggcaccactactatcagatggttcactaaagtttccagctgcatttcttgcaattactctaaattcatatctttggtcttctacaagtccactcactgtaaattcagtttctaatacgttggtaaagctggctttcatccagcggccatcaggtagatctttcttttctacaatataacctgttattttgctaccaccatcataggcaggtttcttccatttcagtgtgacattgtttcttgtaataacaatggcttcagggcgaccaggtgggtcacatggatcacgagcaacaaagcattctgacactttgctaggcttgccaatgccaacaatattttcagcagaaactttgaactcatactcaaggccctcatcaagcccagttgttttgaatttggtgtcctgaatggg

SEQ ID NO: 24805 - DNA, 1055 bp, Homo sapiens
gtctttcttttccaaagtgtagtttatgatttcactgccaccatcatcaaggggtggttcccatttacaaaggactgaggtctttctgatatcttcaaatacaaagttgattggtggtcccggtgtatctaatatttcagaagagaacagtaatcaaaaatttgtgtgggaagggttgctatggaaaatataaatgtgagcatgctcctctgacatgatttgtggttttcccacatctatctttgtattccattagctaataaataacaagatcaggtgatttcttttacatggccagcagataaaatatgattgaggataacttgctgaagctatgtcccatttcttttaactctctcccaaactttttatttttatgttttactaaaacctttttccattggaaagtgtagttttaatgactcacctaacacactgacagtacaaggagcttttgcaataccgtggtcattttcaactttgatcatatacagaccatggtcaggtcggagagaatctcggacgcgtagctgagattctccctttttgctgttgtcaatactcaaacgctgtgtcagaggcaggacaaatggttcttcttcttgaacttcacccttccttctcctaaccaagggtgctgcacgcttcttaatttcctctggtacaataacattttcatcctttatccatgtaatagttgggtaaggtgatccagaaatacttgcatcaagtgctatttcatcacctcgtttcacttctaggcttgttctcagaatgactttgggggcatctatagtgatcataaccaataaatgttttcaattctgatgaaaataactgacaaaacattattttcatttatttcaaaatgggaaagtggcaactccatgaaacaaaacttaccaatgggatctacagctttggttggaggagtagcccgagaaggttcactaatacccgcggcgttctctgctcgcacacggaattggtactctttcccctcttcaagtccttttgctgtataggtcaggattggtaccaggtgttcattgcat

SEQ ID NO: 24806 - DNA, 1062 bp, Homo sapiens
aactaaggtattctagtggaataagaagtgtgaccaccagggaaataaatatttactttccacttctagcttaatgggtacatattgggtacttagcaggtaccaagtcagtagggaatttttttttttattacaaatttggtaaggctcacaagacaagacaattacaattatacaatccttggttgagctacctcaggaagcattagcaccgatgcattcttaaaaagtttttgtacattttcagtgaggtaaaggtaagaagttgtagcacataagacttttgtatggcatcccaaccttctgggatttcccctactctcatttttggcattgatgcagtgctgctcaaaactcactttagtccatgttttccggctgacttctcgtttttcaacaacgtatccagttaacggacttcctccatcatcatcaggtggttcccaagtcaaatgtactgagtccttggttatatcaccaaatttcaattctttgggtgcacttgggcgagctgaaaaaaaatgcactcacgagtcactgttaatagtctgaactaatatttgttaatactgccaaatcaccttagatgataaatgttttgttccttaccaattacattgacatcaatttccccagaaattgttttcacacggttttctaatttcagtgtataaatgcccttgtctgaacgttcacttggagaaatgacaagttcggcataggcagacaaggtcttcattttcacccggtcccctgtttctagtactttatctccaaaacaccaggttgcagttggccttggatagcctgtacttggaaccaggatcgtgataggatttgggacaataacttccagaccatctttaaatgcacttaaatccattgttggttcaactacaaagaagaaaagttaatgagtttgcagtgccatatttaagtccctgttgccccaaagtagctatgtgctattccccgatctaaaaataaaatatctatttaccaaatgcatcgtcagcggtgagaggaccaagaatttcagatggatctgaaacaccagcttta

SEQ ID NO: 24807 - DNA, 1028 bp, Homo sapiens
tttacgcaagatgaacactccaggttgttggcgttttccacagtaactgtgtatgttccagcatctgtgtcatctgcatcgttgatggtcagagcccgcatcaagccaatgacgcctggcacaattcggccaggtttctccaccacaatcttgccatccttcctccagaccacgtcacgctctttgtttaactcgcagctcaagtacaatggctgtcctttgaccactgtgacttcctcttccagtgtttttacaaaacgcacaggaagttctatggagaatttcagtatatatttcaataaatacaatattttcaatgaaataaaacttggaaataagaggttttgtaaaactacaatgcaagttgctactaaggtttgttacattaaagtttaatatagattatgttcagaagactagaaattaccttctacaacaagtttagccgtggaggtcttttctttgtttcccaaacgtaaaacacaggtgtattcaccagcatcggaaagttgaacatcaatgatgtgcagctttctgtctttaccatctgcaataaacctgtgcttgggactctcacggatattgctaccgtctttcatccaggttgtaattgcagtggaaggggagaccaaacattcaaagattgctgaagagccaacgaactctgattctgtcaagatgatgtctttgatttctttcacaaacttcagtggcacagcctttagctggtaggtgaacggggcttcatcaggaggtttctctccaccacttcctggccttaactttctcctttcggcttctattggtgaaggagtctttttgggtacacctaattcaaagtaaaataaaaagttgatttggcatctccttaggagtcagaaagttcatacttggctgcctgctggataaaaccagccgtaaagcaattagaagacgagaaaactaaagaccaggcaattgaaaggccaattgagtttatactgccttgtttcaggcaggaaaatgagatggtataaggaatccatgaa

SEQ ID NO: 24808 - DNA, 1072 bp, Homo sapiens
ttctaacttaaaagaagtgtaactatttcaaaaataaagcagtcaaacatgctagactgctcttgtatataatttcaagaaggaatattgtcctgtaaatgcttttgtaattctaacaggaatcttcaggagattaaaaaaatgtatatatatatatatatatataccttcaacagggggagtctcttttctaccaatggttatagatgctttttcttcatatattatttcctcaggagtctcttcaactttaaaaaacatagtattttattttagactatatttagaacagaatactgcaactactattctaacatatcaacctagttacattaagtaacactctataacagattattcagatgaccccccaaatatcaataacttcaatacagacagacaaatacgtaagattcatctacaatcaaagcaagaggatgaagacaattgtcatctttccaagatttatggagaagccgtgtaccttcagcaggtggaacttctggctctgcagggataggcacagacacttccttttctgggatgattttctcaggcactttgggcactttaaagatatgattttgtttactattaagaatttagaagacatgcaagattgtctaaagagcaggcaaagaatgcaggggcaagagcttcatcttagatttcatggggaaaatggcttctgagacatggcaccattttggacatcctaattttatatatgaatcttctcagctttcttcatttgcttctagtcctctgtgtacacttaaatgaaggtggtctaactttgacacttaaaaaaatttgctctacattttctgagtaattgttcctgcacactcaattcttatttacatgtgaatgactttaagatctacatctctaggcctgatctctttcttaagctcctgatacacactcccaacttttatgctttaaaggtgaaaagcacatctaccattttcctctaacgttagttcagagacccaatgaaccattcttttggccatctagctttaaaccttacaatgatcttgggctcctcaatttccctaatggtttt

SEQ ID NO: 24809 - DNA, 1034 bp, Homo sapiens
tattctagtcaccttctgagacatctaagattacattaaagcataaatcttcactaacagtgtgagaattaggaagtaatttaaatatgcctacttgtggtagaaatgaaagctaaatacctcaacaccatatagacattacatacattacacaagcagacaaagacccagttagcgtgatctggagtttagaaatgttaccaatacttgtataacacatcaccacaaataaatgaaatcaatatacacagaattaaatatattatagatggtttacagatgctattttgttaatacacagatcttatagaaaaagatacaagatggatgctaagaattatttttttcacaaatattattctaccttttggtgctgggggctccacttttttagggataggaacaggggccacttcttctggagctggtttctcaggtagctcagggactttaaaagaaaagtgccatttttgagaaagtgtgcatttgacaaggcatatgttgttgtaagacttagaattaaatagagattccctttttataccaactgaatgcaagaaaattatgctttagaaatgagagtaaatgaagatggctgaatggctaattagaaaatgtgactgctgtcacctttaactgcagaagcctctactttgtcaggaacaggtaggagcaatcctccctcggaggtgcctgtgtcagttcctcagaaaccagctttttatgaacatcgataactatgaagttagtttttttttttgtaacctttacttttataaagcagtttcataaatacaattgcattagatttttttgtgtcttaaatgtttaacaatttgggtgggatggagggggtggagccttgatctatagtgcttgcagatttccgatttccaaggtggtataaacactccctcccaccctggctgtcaaggtgatgtcattgtcctggagttggaaagagatgtgcagtagtacattatatggcatttccaccacacagacacaaagatggaaacaatctcagaaacaca

SEQ ID NO: 24810 - DNA, 1047 bp, Homo sapiens
tgcagagagtggaataaacgccctttctgattcttttgattgtagattaaattattatatttttgagaatcaactatttaaagagtatatacaagaactataaccataaataattagctaaaataaaatgagaaggcgtttattcgaactaatacagccataaagtcacaatgttatgcaaagaaaagcaggcaataaggatcacataaggcagctatctgcaagccagtgtaagagacatatcaatgttaaaatgatatatgtgaatgaagtgtaaaccagatgggaatgtaatgttttcacacaacctcagtaaagtagcatttcaatcataattcattcatgacattgcattctgagaatgacagctaggttattgtctattttcaatgtaattcaccgtgattttgaaaacaaacttctacttcatgatttcatgcattaagatgacaacttctcctaatatacacttttggaaatgactgcaaacataaagttgaatttggctgataaattttaaatacaaaattttaaattaacttacaataaattactgtgaaatgcatgtaaccatcaaaattctaaaccaagcatgcgacatagtaatatatactctaagagatatatttgtatatctatgtcatttttttctcaataatactaagagaaagaaggcaactcaaggatcctattaatcctttagaatttctacttaaatctcacatccattataacaatacctttcatttccatctcaatctcttgttcaatcctctcatgcaaaattgattcaggagctaaaatagaaaaacatataaagagattttagtgattaattgcatatattttctgcatcaattcatgacttgtatgattaaagttttctttttattataacaacagaaaactacattccccaaatttaccaaaaagtccatgccaaacaaactattgagctgataaaacacatgacaatgttgacagaaagatttaaaacatttttattttaggttcttcatgaaatttccacttttagttctataattc

SEQ ID NO: 24811 - DNA, 1035 bp, Homo sapiens
cgcggcggggccggctgggctgctcgcatcacttggcgcccggcgcggcgagcgctacccgcggcccccgcgcggccctccccacaaagggccgcggagctgcgtggccgccgccgccggccgtggctcgcctccgcgggcgcggaaatttgttgcacttcttggggctttgtttatttgtttgttttttctctgggtttcttatttttttcgttattttggacaaaatgtcggtccgtgatataaaaattgagcgaggaaccttggtggcattgggagctttgcagaaggtgcagtttgaattctgcttttcccagggtggcagctcggtcttggccggatgaatcttcgctgctggccgtggaaacagctagagcagctcgttagttgatttttaaatttccaagtgttgtgtttaaaggctttacgtgcactgaggaggaatcgccaccttaaataagcatatgggcgattaacagggtgtgttttcctctcggaaagggaatttggtagctttgaccaatgtcagtgtgtaaatatttagacgttattagtgacttttaaacatttttcagcgagatctgttatttacagtgtgtcatatgttattaatgcttgttgcctaagttccttggcaaatctgtttcatgccttctgagaaagtagacaattgatagattgtccaagagacggaaaaaaatgtgagtgggttttctaacttgagttcggcaaatcccttaacgctggcgttgtgtgacacatcacctcccttgtacgtacccctgttgtacgatgaaataagtgtgaacacttttgaagctttttcattacaagacgattttagatgactagaagaaaatgctgttggtttatttcctagatttaacattttctcctcctcctcccctgttctctttaaaagttttccaagagataacttcaccaagatgtccagtgataggcaaaggtccgatgatgagagccccagcaccagcagtggcagttcagatgcggaccagcgagacccagccgctc

SEQ ID NO: 24812 - DNA, 1074 bp, Homo sapiens
aactttcttaaaacatgagattttttttgcgattttgtttgtttgtttttttagctcatcagctattgttagtgttagtgtattttatgtgtggcccaagagagttctgctgctgctgctgtggcccagggaaaccaaaagattggacactcctggactagagcatatacagtatggataaactggacaaaagtatgattcaagcccaagtggatggagcagggcaatgtgagatttcatcgtgctacttagaatgaggtacgatttaaaacttaagaattatttctggaatttttccatttaatatttttggactgtggttgacctagagtagctggaactgtggaaagtggaactgcacagataggtagggactgctctgctacttctgttacgtgaccatgactgaaattacttactactcatgatgaaagggtattttcatttgctttgctttcttttttacctgtttcctaatagctgattttggtttctcagttgttgtttttggtttgttgggttttttgtcttgtaacttgtatgcttaagagttcttttctcttaaggtgaaactatcagtgtctactcgtttttaagttgttctttgtttactgggttgtttttccactttgctttcaaatactcttttaatcattccattcattctagatacacagtattacacagaaaggaagataatctttaattcttaaacacaagtattaagtaatacttaatactttggatgtattttgccttgcattatttaagtgcaattagactataaaaggagatgttaaatttttctggttgtgttgtgattacaaacaaacctagaaggctcagtggctcaatgtataaagatttatttctcactcatgtgaagaccactgtgggtccagggactatcttgggcagctcttctctgtgttgacttatatctgtgtatcttgtagctctgacatttggaacatatgcctcaagcaatcctcccacctcagccttccgagtagctgggactacaggcgcaccccaccatgcctgactaactttttttttctttttggagacaga

SEQ ID NO: 24813 - DNA, 1034 bp, Homo sapiens
cccattgtagtacttcagtatattgctgttatcatctttatagaatttcttaatttaaaaaaaacttcagcttaaattgctttgctctaggaaaccttagagggtaaaagtcatatggacctatttggtgtataacaatgcgagtacatacattcaacttaaccattgctctaggtattattttgaaaactgaatacttattgaagctgttgtttcaaacatgacattctcctagccacttccttgtcagttgtcagagataattaagtcttggcattaggagaactgagagatctttattataactataggtctgctttaagttttgaattaaactgagggggtagtttaaggtagaacgcaaacctttatcagaatcaaattaatttgtcacaataattgaacttaaatattaaccctgttgttaatatacaagaagcatcctcctttgtttagtgtttctcatcaggggcatcttggttatttttgactggattgtgctttgacttggaagacattgaacatcctcagactctgctgactaaatgctatgttctggccaccaaaacctgcctcttcccccccatttccaggtatcttggaggggaggggctgtcacttggcacttgcaaattactggcctagattccacattgtagtgatagcaaatcataatgctgtaagaaaccaattttatatagcattactttgagtaatatataataatttgtaatagttgtgtttcttacataaaatgtatgttgaccaagatacatttgtgtgatttttactgcatatgtaattgtctgatatgcaaaaaaaaatttcttcctctagccctttagtttttacacctccccgcaattctgaaccctcatagtacatttgaactttgtgcatgagcttaatgtgtacgtatgcacacatggctcttataaatatgtgactctgtgtatccctttgatctttttattattaatgaatttttttttttccacttacagggaaacttgtgttcttaaaaggatttctgt

SEQ ID NO: 24814 - DNA, 1102 bp, Homo sapiens
agataaagggctttggacttagacaaatggaagttcaagtcttggctttacaattgagtaactgtaaaagcttgagcaagttatctcctctgattctcagaaatgtgaataatacctgtttcatcattcttaagtgttttagatattatgtaactggtatattttacatataatgatataaaaagcagttatatggacaaataaacaggcatgtttatgaaagaacattttgaaaaatgaagtattaaaaccagttgtaataacaagatatacttttgaaagtggttctggcccacaaatagcaatgatcagtgatacagaataaagaatattaatacagtttggtgattgttttgtgtttccagctgccttttgcaatttttgttcttggcatttaacccaatttctagatgtattagatacatacatatttatagttttaaagttttgttcactaggtgttcagaataagactcactgtattataaaacaaacacctctttaaaaaatctattaaagtagctttctacaacatggggttaagattattaagtgacattgggatacatgaatagtgatttaaaaaactgttaatcacaacttctataatctaaacataagatggatgaaaatcttacattttgtaaagggttaagctattggaaaactttgcaaataggcatatatattactggttgaatctaaaatgttaacactgtacaactccagggggtaccattcatactgtactctgtattcagcatagcacagcacagagtaagtatagtataaatggtatcccctgagttgtatagtgtggtggccaggattagaccttaaagaataaccttttttttttttttttgagacagagtctcgctctgtcgcccaggctgcagtgcagtggcttgatctcagctcactgcaagctctgtctcccgggttcacgccattctcctgcctcagcctcctgagtagctgggactacaggcgcccaccaccacacctgactaattttttgtatttttagtagagatggggtttcaccgtgttagccaggatggtctcgatctcctgatcgtgtgatccgaccacctcgggc

SEQ ID NO: 24815 - DNA, 1061 bp, Homo sapiens
ggattttaagtaaaacccaaaacttttatttgcatatacttgcatactgtcagcctataagacaaactcagcactgtgtgtaagttacttttaaaaattgactttgaatgcctgtatcagaacttatttggttgcagcggcatacaactcaaaccaaaccagcttaagtaaaacataaatttgttggctcacataactgataaagtcagagtagatttggcatttggcatgctgtcagcatctgatttacctttccatttgcttgctttccttcctcttagttgactccatgattagacagactttctccttgtgatcataagataactgatagtacctcccagctgtgttcttcagattgagatgcagtgtgaaatagcgtgaatcttggccccagttttttcatcagaagtctaatgcatttcattaactccagctgagtatattatatccatatggttcatgcctaggccactgctctatccccaggataggaatggcattaattccattggaagcatgtagactgtgagaaggggtgcaaaggtgaactgggttaccacaagttaagtaaatgaagctgatgctgagtagcaaaattagtatgtatctttttggactgataggcattatctatttctccatagtccttacctcttcctattatgatggttcacttaactaatttatattacctgtgtggcaccttactgacatttgggtttgattcttctggtttataatttcctgttatctattgaataatttgttacggttatatagttatatattttttctatttaacagacctacatttttagctttaatcttttgtatatgtatttaatatttttgtgaatctgaagttacctttgtttgagttgtgaaatggcaaggatgtttataaagggtcaggttaattagtttttcaaatggctttaccaaacacaggtttatgtgttggttaaagctcagctggtagtcttgaactgcttctggcaatttcttagaagaggctgtagcccagattttggctcatgtgtataattatagctaagcca

SEQ ID NO: 24816 - DNA, 1023 bp, Homo sapiens
aggtttctgtctacactagtgctggacaggagaactttccacaatggtagaagggcttgatatctgccacatgtgggaaatcgaacacttcaaatatggctagtgtgaataagaaactgaatttataattcaattttaattattttaaatgtataaatagccacagctaacatttaatgaagtcttgaacccttatcaaggaaggtttctacaggaaaagtttgttaatccttattcttcaagcatccactgaaattaaagccaaacaaatacagtactttgtattctgaattgtctttttaatctggcttttaaaaaagtaggacttgaaaagtattgagatttaatcagtttaaagttgggcctgggtgataaaaataagcagttgtgacattatgggatctctgcggtatagacaaatatgatgggtatgccaatcaggcatatgttattttgcttatgatgttttgtttcttctgcatgaggattggatggaagctgtgcaaataattctgctaatatttattgaccaattactatgtggcaggcaatagtgtaagtctcaaagcagccttatgaatgttatcctcattttgaggtgagaaaactgaggtacagagagaagttcttccgaggatcacatggttggtaaaaggtgaaagcaagatttgaaatcaggcagtctggctccagagttcatgctcttaactgccacactgcactagtcttgtaaattgttcttaaagtggtcatagatgcttcgtatgtgcatttctagttctggctgaggtccaactggatatatacagcagtcctgactgggtaagggaatgtttccctgttccaagccatgctcagggcagcattaggggcagccccaggttctagcagagagaggaattaggcctggctgtggcggagtctctagtggtgagaggaggatggaggatttccttagtggactagttaaagggaacgtcagtgggaatgcttagagcaggtcagagagcactgggtgtgcct

SEQ ID NO: 24817 - DNA, 1050 bp, Homo sapiens
ctaatataagcccttcacttaataaaattaaagagagactaggtgacttgagcacagggtcttgacttttttttttttaattagttagagccagaacaacaattcagatttctaggcttcagtcctgtcttaatctgttttgtgttgttgtaatggaatgcctgagacagtaatttataatggacaaaattatttgactcatgttatggaggctagaaaatccaatatcagggtgctggcaggaccttctttctaggatgctgcttatcccatggcagagttcaagagagagaggtgatggggagaaaacgggggtgataaggaggtagggagagataactgcacacaagggcaaaagggggccaaactcagtcttttataattaactcactctagggtggagctcccgcagcccagttacctctcagaggttctacttcctaatactgtcacagtggcagtcaaatctcagcctgagttttggaggggacattcaacccatataacaagtccagtactcttcccagtgcacctaaatcaaaactaagtcaaaaattttttaagaaaaataatgcactggctgcacaggaacgatggtatagaagtgccattttaactgttagttgctaggtaatgtctttctattctttaacttccagcttaatgccagccttgtgtgagctgtaacaatttaatcattcaggtcctctggcaagtagtgttatagaaattggatcataccattatttgttgtttttattttggcttttaaaatgaatgaaccatgtgtcctccttttaagtgattttaggaagagcaaatgataaggatggactgtaacattttttccagttacttaatttcactttaagaatagtgatttttatttgttttaaaatttcctgagtgagggttgttaggcaaaatggactccatagagtgtatcatattttcctgtcactttagtgtctcagaattaaaccatcattttatgtggaagcatagctccgctttgctctactgcaaggtagagtgctcagttattaggtt

SEQ ID NO: 24818 - DNA, 1520 bp, Homo sapiens
tgtgttttatatttcttttgcatttgtaacctctcccagtactcatgtttgttactaatatggttagtcatttttctcctattgatactgtcgttgtaggtcaggtaaacatgtatgttcagtccttcactatgagtgagccaaaagttcatatgaagacttcagcattgagtccccaaaggattttttagaaagttcattaatatcttcatttgtcttcttccaagatgagcctcttgactgactcttctcagaaaatgattgacactttatgtgagagtaaaacttaaagtgagctatgaattaatgttaaaaccagattacgaaaaagtaagacttcatcctacgattctaccatcctattatccactcaccttgtacaaaaacaaaatccagaaacattttcaaaaaggaaggaaaattcagtcaagtattttggaaactgagttccagtcatcatggagtaaacaagcaataagcagattaggtagcgctgcaataaattaaaattgtaacagagctataaattagattctgaatgttttctaaatttattttcaaacttgacttttaatatatgtgattattaagatgtaatggtgatgtgctatgtagatatgaatctgttacagtaatctatttttctcttaacattttattatgaaaatgtgtaaacatacaataaagctgaaaattttagtgactacttatatgctcatcatctagattctatccttgagtaatctatttttataaaggtattgatgtaactattttataaatgaaaaactacacactaaaaaccaaatatgtgatctccagcatcacagaaatgaaataaggatttttttttaacttaggtaatattgcttgaactgtagtaattcaaatgtagcaatttcaaaggtagaatttcccatgtattactatactgcttcacatcagctctattaataaaagtagaacagttgcaaaggaacttttatgatctgttttgacaggacagacaatttaaaaagttgttaataaaggtttttagaattcactataagcctttcatgtggctttagttagccacatggagatacgttctgggacgaaagttggaagtattctcaagaagtaaaaaataccaaataatttataggggcacgagtggtttgaagtactgtttaggattagagtgggtcttggcatttgtccagaaaccagactactttgcacaattatacttgaattcctaatcatatccactagcctactctcttaaatagaccacagaaaccttgctcttaacatttaagacaatggagtgtcttgctttctagaaatgcttttatttttattaccactatgcaaataaatgtaattttcacagtgtcataacattgattttgtcattgaagatattatctattttttccctgacagtttatgttaaaatacatttagctttgttaggtaagagaactttgatacttccttttcctctttattgtgtatacaggtatatttgggat

SEQ ID NO: 24819 - DNA, 1047 bp, Homo sapiens
tgcatttagccttttcataacaataaattcaattagatgtcatttatttcttttatccctactacagtgcctggcttatgatgtacataaaataaatattagtggataggaaaatttttttataaagaatcaattttttgccacagtgcattttttcatggttgacatttattcaagaagcatttattgagcaactcttatgtggaaagcattatactggctgctttgagatatataaaagaactataacatctaaacatttaatgttagaatgaaatgtaatttctatttagtataaggtatactacaaattataggatgaaggtgggtaatcactagaggtttcagatggatcataggtaaaaaatactggaaaaacagtttagtctgatgacaaaggaaatcactttttagtagctatggtattcaaaataatcatagtttaaaatgtcatttaacagtttctggaatttttataaaatcattctccttgctgtcatattgttagatccagagagttagactgtgcagtaaatgagctatttttttaccttagaaaagcagaagacttgaattttcataagtagactcttagaggttccttctgatgcttcagcacatttccttttctccaaagaaatgcttcagggccgagtgcagtggctgacgcctgtaatcccagcactttgggagacccaggcgggcgaatcacgaggtcaggagatcaaaaccatcctggccagcatgatgaaacccagtctctaccaaaaataaaaaaattagacgggtgtggcagcacgtgcctgtagtcccagctacttgggtggctgaggcaggagaattgcttgaacccgggaggcagaggctgcagtgagccgagatcatgccactaacgacagagcaagactccgtctcaaaaaaaaaaaaaaaaaaagatagattttttttttcttcatatagagtgtcaaatagcgcttgaaccaaagccctttacctctcctcataggggcattgaacagtaatagaagcttagaacatactactttt

SEQ ID NO: 24820 - DNA, 1190 bp, Homo sapiens
gccattttatttttatgttcaatctaattcctttaaacaaaagactatgaaatactactacttttctgtaggccatgtgataaggttgttagggctggacagaaagaaaaaatatatttatttgccataccctgaatatatgaaatgaagactagatttcaaaaatcttactttcaggcatcacagtaatttacaaaaaggccaataagttacacaagcatttgtagtaatttatgtaaaagatgtgaagctggtaagggatggttcaaaaacttacatatcagaatctgcttaatacaaattttaggaaaagaatccacttctttacaaggcaatactctgatcactatttcctgaacagttattgaaggtgtttcaagcaagagttacatactagtatagatttttaatgcaaatggccatatttgttttgaaggtgataccttgtgggttttcttcaactctttcaaaacttgaattttatatcattttgtttttcctcccatccccacatcctaagtgctaaaagactctaaaactcatcttgtcacctgctgttttgttcaacgggattctcttcagaaatataatcctaaagtttgggagggactcttagagtagacacttaagcagagatggaacaaagaattaataatccaaattatatgaagcatttaaaagtctgtagagtagaagccattacagaatcacctttagtacgtgattagatacctttatttctgaatctgtttacattttatttttggcaggagctgggtaattaaaaatatttgtatggatttattgctttcaaatttgtggtgaagacattttagaagagaatcttagctctgcatatacgaccctaggcaagtcacttaacctttctggctcggtttctcatctgtgaaattgtgataaaaatactcgaacaggattactactattgagttagatgtgatataaagcacctggcaaagagtgggcactccataaaatgttctttctttctttagttatgttaatagtaaaatagagctctggtgtgctttgaaacttccttctttcttgtttcaacgtacagtaataggtaagacttgagtaataatccagtaatcctttcatgtattctagcttgaacatttttttaaaggaaataaaactatatatagttgaagtttcttcgtact

SEQ ID NO: 24821 - DNA, 1050 bp, Homo sapiens
acattttctttttggtactaactctttgaaatctggtatttattttacacttctagttcgtctcaattcaccttgccacaatttaagagctgtatatgcacatgtaactagtatatgctgtattggtcagagcagttctagaggggcatactctcctcctcccccactaaactagtgtgttggtcccctaccccctccctgtcatgcattcttttcaggaagacacttttgagagcatttaatgttttcctcccagattcaacttttgcgctcacagtacactgctagttttcaaatgatcagaaatttttttttttctcggcaactccaattatgaattagctatccaattagtgtttgtgattgttttgagacttggcagtgtttgttcttatgatttatcttcttttctcacacatttcagggatatattagtttcctttatccagtagctaaaaaccttgtttattttattttaatattttagcctaacaagacagtgaaccagctgtagaaataaaaggctaagaaacagaaaggcaggtagtgtgaatgattttaccaaccgtcttctaaatcctccagtattttctaacgtttggtaagaaattagctgaattgatactgatcttttctagtaagaaactgatgtaacttttatgttttaaaaaaaaatcttcatcagttcctcttaccttcggcaccaaaacatttcttttcttcctcactttctgtctttctgtatgtatgtgtacacacacagttgtatatgctgtggatgtgtatgcaaacagacgtacccacacacatagatggaattactgtatcagttatttaagtataactgatcagttcctcactttagttctttctatacagggtaaaaacaaaaaatttttttcaactgagtcaaaagcatttaattttgttattaaacctaatctaagtttagctccagtcaaataatttagtatcatctatgatatattacccttcatttttttttagtgttttaattggtaatacagcattcattttccttctgttttt

SEQ ID NO: 24822 - DNA, 1016 bp, Homo sapiens
aatattgtcagatggtaactgtgatgtggtagctagtctgtgatgcactttttacttctaatcctggtcttgaatgttcatgttgtgtattaccattcttactatggcaagtggccagcaaatacagccagaggcagagatgaacacagaaatctttgtctgccttgaaggtagactagaactgtgttagtgtacagatgtgatattatttctcaattggtaaaataccaaattgtaaggtttttagaaggttaaatttcttctttctagttgtaattctgaagtgttagatttcttgaaagttagaatttctttgcaatatttagatttgctaaacagagtataattgtgtgtggtggtggtgttttgttttgttttgtttccctgtgactaaggtaatcatctctggtcatgtaaccaaggttgtggtatatggggcaggtgtcttctccagtcctcaatatggaaatgaagtatcatcttaaaaatgtatagagtgaaaatattaacataaaaaatgcttccggataaagtaaaacgtgtagttgtgtgtgtcactagaatagcagactcctgtttgtcagtagaagtcttatatcagagtaaaattaaaattacacttacatatctgtttttcacttaaactccccacccccaacattattacagaggagcactatacaaaggtactattttgaagaattcagactttacctctgtgaaaacctaactaataatttataatggagtccaagtgaatgtgatgcaagtggagaccgtttaagttgtaaggttttttatcaaccgtagtttttcctccactgccaaaattgtacattctacaccctagagtaataaacttctctcttggtgctagaaaaacttaaatcatactgaatgttgggatgtttggggatgctatgattagacttcctttagttaccatgagcctaattaccaccgccaaactattttgcttacttgttggctgtgtccatactggtgtgggataaagt

SEQ ID NO: 24823 - DNA, 1049 bp, Homo sapiens
ttaggattcttaggtttgtgggctatgcactattttgtatgaagaagtttcaagagtgtgtgtaaatatatataagccatcttctgtagaagagtgtgtgtgtgtgtgtgtgtgtgtgtgtgtgtgtgtgaatcttctgtataaaatagcttcagttgtcctgtttcaaatgtgggtgactctaatgtttcaaaaatgcttagctcagtactgacacataatacattcaaaaaatagtggttcttctttattgtttacttaaatctattatctgtatgttatctgtaacaagcaggctgaggttaatagggacaattgataaactgaaccaaaagtttaaaaattaaaaggtaatacattaaaaggtagaagttgaaatgaaacacaatgagaaatttttgttggctgaagaaaaaaatgttataatgattaaagatcgatctgtgattgccatgtcagtaaggtatcttctttcctttggaatagctttacttgctatcaagaacctgaaggtgtagggtcttcaaatggtgcccatctcccacacaattaaaaatatccacatggactagtctttgagtctctgtagaatttcagatcagtggttgattcagatagactcctcccctcaaaagagaaggtccatatctcgcctaccctaccctctgtggacaaggtgtcccatatggtatattcatgccataagcagaagtgagcctgcctgtttatctagaatgcccagggtgagagacgttaggcatgagataccccttttagtcaagcaagttgactgcagagccagcaccaagagagttgcctggatagtaccgcaaggtgcttttcttcctgcatatatattgttggcctccttttacctccctgactccccaagagacatctcttctctcacttcttttgtaccagaggaaagtggtctctctgccaggagggtctgggcccagacttgctcgtgaagactatatctgaggagacccaggtgatttctacatgtccactttccacccgggcactctgcatcatcaggcttg

SEQ ID NO: 24824 - DNA, 1048 bp, Homo sapiens
aaaaacatgtatgaatgggagcctctctgtaccccacccatcactagcttccccctacttcccttaccctcccaggaccccaggttgggcattggctcattttcataaataacctcatcccagacaggggtgagggaaggtgttgtggctgttttgtttaaattggagctgtaagagggatcatgtcatattttatgcccttcctagaaaggggacgggacacctggtttgcattcctgtattgaccactgctgccgtcactcgtcacattgagttcacatctcctgagagtttgtataaattcaggtcagcgctgctcctatgcagccatccagtgtcatagaaaagcaattcactgataactgatctctccattcagaagtgtgcagttttaatgtatagcaataagaaattgttatttatctattacaagcctggtttgattaaaaacaaaaaataaaatgttattatgcttgatgttacatctcataagtaaccagcaattctgtgatatttattgaacatttattttgggtcagatgtaccataccaggtacagaatatgtgccataataaatgaaaatgaagaaaatagtggcacccttttttatagctctaccatcaagtagaaaataaaattaatacttgaaaacataagccttatttcgtggcaagtttaagggttctacctaataaagacctatggataaaaccatgtttatgcattttgatttgtcatgtgtgttgtatgagacaacccaattctttcttttaaaaacacaaaatcactgtttagtaaaacacttattttgtctatgatttctctgtcttgttttaattgacacatttaaagaagaccattcactatttttactcttttgaatgtgaaaagtatatgtatgtacacatgagaaattatttttgtggcatcaaaatgtcaatgacaaatttgaattattgttagagctgtaaaactgttgtgagcataggcaaattcccttatcaaaattactctatacctgggaaaagcccaagtaattttccagtg

SEQ ID NO: 24825 - DNA, 1048 bp, Homo sapiens
ggctgaaaaggctcatctgtatttttcctaaatatttgccttaatctagatcactcttgctaataacaggtactgtaagaattacatcgccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacaagggaggctgaggcaggagaatggcgtgaacccgggaggcggagcttgcagtgagtcgagatcgcgccactgcactccagcctgggcgacagagctaaactccgtctcaaaaaaaaaaaaaaaaaaaaaaaaaagaattacatcaaccacttcactaccaaggcttgttatttttttcatgtgttatgaagaatcaatatataggaaattctagagatgtaaccacagtggtggaagtataaacccagccctgattaaaataaattgctgtcttcccttcaatggctataaaatacttttccccactccttcttctcacatccctcttctcctcctcctcctctttctcttccttaccattcctgctcctctgttcctgtatgtatatattctgcacaaatctgactccagttattccaaaccaattgccattcttcacatgtgccatgctgcctattgcttccctgcccttgcacaggcatttccctgcctctaaattgcatttccccttttcttcacctgtctatgacctatggatactttaatctcatcttgggcatcattttctatgagaagccttttctaatttccaccacttcctcctcatatgctgtgttattagtctattcttacttgccattcctccccactagacaatgagtttcctattgtgatactgccctgttttgccagctcctggcaattgcctggaatatagtaggtgctcactagctgtccgatgaatgaataaatgagtgggcatatttgtatatgaaagtttgaaaaact

SEQ ID NO: 24826 - DNA, 1056 bp, Homo sapiens
aacgcatttctctccttaaggaaaaataattctgcaattaacattgctacttttatttccttctcaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattggtgggtatgccctacaatattaatgcttgatggggtgcggttcattcattaatcccacaatcctgcttggagccctcaccggttttcaccacggagatcttctttagagcgggggagagaagctacctgatgcatgcttttcctctccatcttccagattcttgcgttgttctaaccaatgagttgggcacattagaaggctgtagttgtttagagattatgagaagcaaaggacatagtatcacttgctatattagtttaaggtaaaccaactgagcttaacctgtgaaatctctttcttcttgacattggataaaattgacattttatcaagtgtcaataattgaggaaagccaggcatggtagctcatgtctataatcccagcacttgaggaggctgaggcttcagcccaggaggtccaggctacagcaagctgtcatcacaccactgcattccagcccgggcaatggaatgagaccctgtctcaaaaaaataataaccataaaaataaatattaaaaaaattgaagaagctagacttgattctgatttctataaataatatgcttgttaataatttactgcgactacaagctcctaagaaccgtcacctatgtccctctgtataggcaactctcaattatctgctctggagaaagtatcattgatatagctcatccaaaatattgtggtggggaatcccaaatcatgtatatatgactttataagtatttttgctagcagattaatgttcctaattatgttttatttaggctaatataagaataactactagtgaaatgagcctgtggtaggagaagagcatatctgggc

SEQ ID NO: 24827 - DNA, 1046 bp, Homo sapiens
tggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgccttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttg

SEQ ID NO: 24828 - DNA, 1039 bp, Homo sapiens
tcatttctggtagggttatatgagaagtaaaaaaccctatgtttccttctagtccctcccaaggacatttcctacaagtgaattctgctgaaaatgaaaattagacagctttaggaggtaaagaagtagctaaaaggaagaggtattacaggcaacgctataactgggtagaaagaggaagcacctgtagctcattgccacctttgtgttctgatgctcgtcagaggtcttttctcagtgtataaattgctgagggtgtgtgtgcaagctacttactaccactcatgaccttttttctgctatcttcagtgatttcacaaatctagctacatggatgtagaaagagtgaaaaatagaacctggggcattcacactgatttgccatttaatggagattgtattgctgaccatgttctgtgataaataaattgtgctattattgtttagttcaaaatgtattttaactgcctgcttttctttcttagattaatatttttggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactgcaagcagtagagaaataagacaagctttcaagaaattggcattgaagttacatcctgataaaaacccggtaggtaaacgtttgtttttaaaaatatttgattatatttttggtacattttgatatttatttaaattgctttaaatgatcaaatgcttaagaataatcatatgtcaaaattataattcaacttgtatgctagaaacaaaagcaccaaaatgttctggattatttaggatcccgtgaaggaatgtcagtaccaaaaattcagtt

SEQ ID NO: 24829 - DNA, 1042 bp, Homo sapiens
tttacctcaaatagaaaaataacctacaaatgtattgatttataattgttataggagtaaaaaatatttatgaaattaagagtttcaacaggcttattattttcagctgcattttttaggaagaataactcatggtctgataacgtctgtcaaccttttgaagagtcaattatttcattacttttcttacttttttttttttttttttgaagattatagtttcttaaaaaatacttcatttcaacccatggtaactcatgtcatgttgtattacccctccttatgttggtatatggtctcccagaagttactagattaattaaacctacatatatgttttgaagaaacttggattgtgtatctgaaataattgtattatatctaatattttttaacagaataacccaaatgcacatggcgattttttaaaaataaatagagcatatgaagtactcaaagatgaagatctacggaaaaagtatgacaaatatggagaaaagggacttgaggataatcaaggtggccagtatgaaagctggaactattatcgttatgattttggtaaggtgatacgatattacttatgaaatgtgttttatctgagtaaaagaaaagtgaattctgtttcaccacttagcttatatatttaagatgcgtcactttgattagctccttttaatttgctgtgggagtgaaatttaaaaggaatgtcagttggtatacagagatgatctgtacagatatgaagttgtattggttaaatcttgttaaatacttttaaaataaggattgctatttaataaaaaatatgcattcatggactgcataatgacatttcacttaacaatggattgtatgtaggacattggtcccatgaaattataataccatatttttactgtaccttttctatatttaaatacaaagatacttagcattgtgttacagttgcctatggtattcagcagtaacatgctgtacagatttgtagactaggtgtgtagtaagctatactatctaggtttgtgtaagtacactctgt

SEQ ID NO: 24830 - DNA, 1061 bp, Homo sapiens
ctttataaagaagaaagtaaaaattacttagaattttctcatgcagagatatggctaatcaaattttggtaactgtccttttaagtgattctataccataaatattttgatgctgaattttctctttgttatgatactaaatttcagaatttttaagtgatgctcaatgtataatgattcgtttataatttaaaattctttatcttttcataaccgtagtatacctaaatatattacatattaacatacacatattgaaataaattatatatagaactgcaactttatagttttttttctaagacctggataatggcaacgagagtagcatttttagagatttcagaggtagaatctgaggatggagaagaatggcaggataagactaactttaaggtatttgcttttgagtgactagtcactgacagaattagcccatatcggggaaaacaggatgatcagcactctcctgttaacgttctagacagttgggggccatttatcttgaaacattatcttgtagtaatttgcattcacattgatagtagaagctgacgttttctttggacaactctttttttcaggtttcctcaagcatctgcttcctacatattactacaatttgcacagtatgggaatatcttaaaacatgtggtaaggcttaatttttttcagttcagagttttgactaaagagggataagttgtgaattgagagaaactgcttctgaattttgtgggttttttttaaacttaaatttttttttgagttttgatataatacatcctttgaagtctggaaggctggaagttgcctaatttttgataaaaagagatatagtgagaagatatggagaattgagagtttgaaaatccacctcctctcacctcctttcttaaacagtttacagtcttaaaaaagatagattatgccaagtattatattactgttttccaatttgagctgcttttattggggataaaagaagtaggaggcagttcctgagcttttagagtttttagagctttatagctctaaaatttaaaaaattatcttacctt

SEQ ID NO: 24831 - DNA, 1027 bp, Homo sapiens
gatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgatatgtgtattagtctgtttgcattgctataaaggagtacctgaggcaggataatttattaaaaataagaggtttatttggctcagggtttaattggcttgtagctgtacaagaagcatgatgctttacttgtggaggaaagtaaagaagagtgagcatatcacatggtgaaagagaggaagagagcaggaagaaggaagttctagactctttttaataaccagatctcacatgaactcattactgcagggaggacaccaagccattcatgagggatctgcccccatgatctaaacatctcccactagtccccacttccaacatcggggaccatatttcaacatgagatttgaaggggacagatatccaaatgatatcaatatgtattgaacattttttgaaagggtgatttattataaaaagctttaagtat

SEQ ID NO: 24832 - DNA, 1043 bp, Homo sapiens
cagttgtttaatttccatttaattacatgattctgagtgattttcttagttttgatttccatttttattgtgctgtggtccgagagtgtgtttggtatgatttaaatttttttgaatttggtgaggattgtcttatggctgattatgtggttgattttagagtgtgtgccatgtgcagatgagaatatatattctgttgttttggggtggagagttctgttaggccccttggtcaaatgttgagttcatgtccggaatatctttgttagttttctgcctcagtgatctgtctaatattgtcagtggggtgttgaagtctcccactattattgtgtggttatctaggtctcttgtgtcggtctctaagaacttgctttatgaatttggatgctcctgtgttgggtgcatatattaatataaggatagtttggtcttcttgtggaacactttaccattgtgtaatgcccttctttatcttttctgatcattgttggtcgaaagtctgttttgtctgaaattggaatagcaacccctgcttttttctgtttactgtttttttgtttgtttgtttttgagacagagtctcgctctgtcacccaggctgaagtgcagtggtgcgatcttggctaactgcaagctccgcctcctgggttcacgccattctcctgcctcagcctcccgagtaactgggactacaggcgcccgccaccacgcccggctaatttctttttgtatttttagtagagacggggtttcacagtgttagccaggatagtctcgatctcctgacctcgtgatctaccctccttggcctcccaaagtgctgggattacaggcgtgagccactgcgccctaccatttgtatttttgtctgacagagttattttggagaagcagtcttcaggttctgagattgtttcctcatcttggtgaattctgctgttaatacttgtggttgtattatgaaattcttgaagtgagtttttgagctctgtcaattcagtagttctttcttaaaaggatcattttgtcttttatctgct

SEQ ID NO: 24833 - DNA, 1032 bp, Homo sapiens
gcagtggcattatctcagctcactgcaacctctacctcctgggtgcaagtgattttcctgcttcagctttctgagtagctgggattacaggcatgcaccatgcccagctttgtatttctttttttttttttagtagagatggggtttcaccatgttggccaggctggtctcgaactcctgacttcgtgatcaacccaccccagactcccaaagtcctggtattacaggcgtgagccaccgtgtccggccctcagtctctttttctgtcttatgcccctcagtcgaattctttcctgaggaggcaggaattgaggttgctgcagacctgtacagattttgcccatggtaactaggataccttacactggtaatggtgtgctttgaattctttatttttatcctgtgtatatctactataggtttttgctttgtagttatcattaggcttgcataaaacattttatactaataacaggctgttttaagctgataataacttaactttgatcacttgcacaaactcaactcttttactcccccctctcagtttgttttgttgacatgttttgtatattttatggtttgtgtcccttgacaaattagtagctgtagttgtttttaatagatttgttttttttgtttgttttttttttaaagaaaggtaggaggatcacttgaggccaggatgaagaaagcctacttaatataacaagaccctgtctctacaaaaaaataaaataaaataaattaggcatggtggcatgtgcctgtagtcacagctactgggaaggctgaggcagaggatggcttgaacccaggagttcaaggctgcagtgagccatagtcacaccactgcactccagcctgagtgacacagtgagatcctgtcaacaacaacaacaataacaaaacacaaagaaaaagtgagtattgaaatagtctaaagtgaaggaataaaaagataatgtcttatgaaaagggaatgttaaaatgaaagcttcctaacttgtttcaatgtagctagctcctgaa

SEQ ID NO: 24834 - DNA, 1030 bp, Homo sapiens
tattagcgatatcctactgtatctataccaaggcatgggaggcactgacgattgcaactaagacttaccaaaccacaggggttctcaaaatttagggtgggtaagaatcacttggagtaggttgggagttgaagaaaacttgttaaaaatgcacatttcctggctgtaacataaggtattctgaaccaatagatttggggcctaagttggtaatctgcagtttcagtatgctcctctggtgatcttgaacaggtggtccatctcgcctcctttgggaaacactgcaccaatgtttattatcgtagaagaaaattacatagaagaaatctagaagaaatttcaacgaattttagaacactgaagaatttaggggtccagatagctttcttatttttttgttgttcaaatcttatcttttgtaagagaaatttgaatagctagggacattggtgatatcagaaacctagatttcacttcctctatcattgtttataaaatcaaaacgatggagtcctaagaacagactaaatttattttataaacaccaaaagaatgtatttgataggaaactagcacctgatcaaagtgaatattgacatggagggagaaatttcctgagaaggctgtaaaactggcgttatgttagtttacaagaaaatgaagctgcatgaagaggatatttattaaatagtgaaacattaggtctctctgttgtttgaattatttacagcaaacaaaatacttttaggtaaaatatgtaaacgaatacgcagataagaaaatggacacaggtttttttcatgcgtcttgtaaccgtttaaaggagaccattggatttagtgcttaaccaatatatgttttattgtgcaaaccaagtatttggatattaatattttaaaaaactgataaagtctttatcaacttttactgaacaccatattatctacttgactgttacattgctttaagagtccagtctcgactcacctgtgatcctaagtgaaaaataaataacatgagatcattaaaa

SEQ ID NO: 24835 - DNA, 1044 bp, Homo sapiens
atatactgattctgtatgtttaagagaaatttgtacactgtataagcttgtttcactaaccagcagggctgcaactactatgagtaaatcaaatgtttatgaagccctgtggccttgcttgcctgactcttcacctttgctgcatggcaggaatccagaattgggagaagctcagcaggtgcttttgtgagcagtagactatccaccattgtggcagccccttcctcatttggtcttctgcccttgctgctgctgaagacctggaagggggagaggtttgcattatcaccaaggttgctaataaatgatgtttttcaatataaacatgtaaaagttttgccagagtagtcttactttccccttaaatactccccaaaattaccagaatattttaaattatgacacaatgaaaatgttattgctgccagagttgacatttttcttgcaaaaccaagctttaagtgttttaattttaaagaagacatttccaaagctagggttgtatgcataacaggattcctatcttttttttgtgccgtctattaagaggcaattcttttcttttctaggactgttcttcctttcatgttaagagaaaaggctgtttttggatgactaagaggatcccagagacatgaggatagcatctttagctgcttctgatacatattatgttcttcatcttgatgctattgatagcaccattgcttgaattcattcttgttcatcctcacttactttttttttgtctcgttacatagaaaaaacttggaagcattttaatgttgaagaactttctttcctctgcccaccccgccgtgtccattttgtctatgatatagctgaatataaactctaatacctttttgtagttctttattggccagaggaaagtaaacaacttgattgtgctcagagcctgtctcatgcctcattaggtactgggggtaagcagacggcagcagcattacatgcagaaactctgcagaaacatctgatttatttttatgagcaagttatagtctttaagacatgagcaccaaa

SEQ ID NO: 24836 - DNA, 1022 bp, Homo sapiens
attataaatagaataatatgaaactcaggatgacaaagacatattgcatatcttggcttcaacctgtaataacattgttttataggaaatatgtaaagtgtataccctttatcattatgtataccctttatgtatatgtgtaccctttatcattaagttaaacaaatattttgtttctggtcaaaataggttctggtcagaatattgaaattcagaccagaatctggccaagaggttctggtcagaatattgaaattcagcaatctgggggtgatagaattaaacagagtttgacatatgcattgttgagaattagagaaacttataaagtttcaggctcttgcttcctattttttgaaaaatgttcatgcaagtaatgtttttcagaaaaatgaaaaattctttggctcattttcttttgttatatattgtcctccatggctttatctattttttttttttctgaatgagtctattgaaattgctccaataaacttttcgggtaagaactttttcacagcttgatgatgacctataggaagaaacgttttttgagtgtacttatctgtgctatgttcttttatttgtttaattaagaaaatatctattatgaaatataagacacagataagtgcaaaaaaatcaaggtatagtataatgaattgttacaaagcaaatatctctttaaagcatcccagattaaaaacgagaacatcaacagctttcagaagttcctttctcccagatattctttcatctcagagagtagatatcacaaaattaattctgtggttaaaatgcccttgattatctttcttgtttagccacctatgtgtgcattcctagacaatacagttttggaaatttatgtaaatggaaccaggctacatggaatatttttatgcattattcttttactcactatcacgtttaagacacattcatctttacttcattttgagaaatcttaattgacttccacatgaaataattgtcaggatttcttagggtttactcttatc

SEQ ID NO: 24837 - DNA, 1145 bp, Homo sapiens
aaatgctttttctgcatctatagagatgatcatataatttttcttctttattttgtaatgtggtatgtcacatttattgatttgcatatgttgaaacatcctaacattccagggataaatcccacttgatcatggtgaattattcttttaatgtgttcttgaatttggtttgctaatattttggttaggctttttgcatcttggttcatcagggatattgacctataattttcttttcttttagtgtacttgtattgctttggtatcaggataatgctagtctcatgaaatgacttagaaagtctttgttcctctttaaatttttggaagagtttgaaaagaattggtgttagttctttaaatgtcttttagaattcagcaatgaagcgttctggttgcgggcttttctttgatgagagatgttttattactgatttaatctccttactcattactggactgcttagattttcctatttcttcatgattcagtctctgtttgttgtatgcatctcagaatttatttttttatagatttcccagttagctgatgtaaaattgttcataatggtttcttataatcctttgtgtttccatgatatcagttgtaatgtctctgttttcatttctgatcttatttgagtagtttcttcctttttcctagttagtctagctaaggatttattgattttgtctttccaaaaatttagtttcattgattttttttctcttactttctagtatctatatcatttatttcttatctgaactttgttctttccttccttctgctaacttcgggcttaatgtattctttttatagttccttaaggtgtaaagtcagattatttgtgacctttcttcttttttgatatagacatttattgccattaatgtccctcttaggactgcttttctgcacctcaggagtattggtatattttgtttccattttcatttgtctcaaggtgttttttaatttttttttatttttttatgtgttgtttaggcgattgttttttagatatccactatttgtgtatattcctagatttatcttgttactgatttctggcttcatgccattgtgatctgaaaagatatttgaaatgatttcaatcctcttaaatttgttaaggcttgtt

SEQ ID NO: 24838 - DNA, 1040 bp, Homo sapiens
tttttttttttcattcaaaaaacaactctcggccaggtgcactggctcacagttgtaatcccagcactttgggaagctgaggtgggagcattgcttgagcccaggagttcgaggctacagtgaactatgattactccactgcactccagcctgagcaacagagcaagaccttgtctcaaaaaagaaaacaaaacaaaaaacaactcttgtgggtcaggcagaaaacacaatatctgtcttaaggggcttacaacttagaaaaacaaggctgaccgatactcctaattcattatgaacaatgctgtgacaggaagcagagaaggtgcaggttggatggatctgtggttggggatttgctggcaaggtgagtggaaaggcacaggagagcaggatagagatagatattgggaaaggagcaatggggaaggggctgaaaatgtacgtttctaacaagtttccaggtgatgctattgctgctggtcctaaaaccacacactagtgggaaattaggaaaatagattagtcggccgggcacagtgtctcacgcctataatcctagcactttgggaggctgaggctggtggatcacctgaattcaagagttcaagaccagcctggccaacatggtgaaatactaaaaatacaaaaattagctgggcgtggtggcacacacctgtaatcccagctactctgaaggctgaggcaggagaatcgcttgaacccgggaggtggatgttgcagtgagcggagatcatgccaccgcactccagcctgggcaacagagcaaaaactccatctcaaaaaaaaaaaaaaaaaaaaaaaaaaaagaaaatagatcggtaatacagaacaagcagagggaaatagtattgcattgcatcttaagaatttactgtaggatgtccagaaactagaagacatatagatgggtaacagacagccaactctattctgaattctttaaaaattcactacaaaatagtatacatgtgcaatttttatactctttattattttttttttcacttttcccacctcta

SEQ ID NO: 24839 - DNA, 1034 bp, Homo sapiens
acctaacagaaatttatagccacaagaacacctttaaggggaaattaagactaaatatgagagagcttcaaacacacaaacatggcacaaacatgcaacagattgaaaaaatggtgggaaattctactttcagagaacttcctattggttattatgttgtcattatctggatgacaaaattatctgtacaccaaactgctgtgcatgcaagttacccattttacaaacctgcacatgtacaccttgaacctaaaataaaagttgggaaaaaaagaattgttgaaaatgctacttctgccgaggcgggcggatcacgaggtcaggagattgtgaccatcctggctaacacggtgaaaccctatttctactaaaaaagtacaaaaaaattagctgggcgtggtggcggacacctgtagtcccagctactcgggaggctgaggcaggagaatggtatgaacccgggaggtggagcttgcagtgagcggagattgagccactgcactccagcctgggcgactgagtgagactctgcctcaaaaaaaaaaaaaagaaagaaaaaaaaaaagaaaatgctacttctcctttttagctgaagtacacatgggaaacaatgtaaatcatctaaacctagtgtgcaatttatatttgtaacatttactattttgtaactagaaactgtggtatttaataagttgttgatcttgttgacctatcacttatcataatataattatttagtaggctttatgaggttaaattgtgtcttccaagaagatatgttgagattctactcctggaacttcagaatatgaccttatttggaaatagagtctttgtagatgtagtcagttaaattaagataaggttatactggagtagggtgggccctagtccaataatactagtgtctgaataagaggaggaggaggaagaagaggaagatgaagaaaagaaggagaagaaaaaggaggaggaggagaagaggaggaggagaggacgaggagaaagaggagaggaggaggaagataagagtg

SEQ ID NO: 24840 - DNA, 1047 bp, Homo sapiens
aagataatcgatcaatgagctttttgtggagcaggcaaaagaacctttcatttcaaagtctctgagtgaacttgtatgttacatgaaggagaataacttcggtgtaaagtaacaaccttttgaaaattcttaagatacaatatcactgcctttttttttcccaaagaagagtcattgatagttcagttaattactgcatgaaaaaaattcaaagctgctacatcaaaaatatacctgtacacaaatttttatctcagcacacttcacaattgcaaagatatggaaccaacctaagttcccattaactgatgagaaaagaaaatgttgtgtgtgtatatattacagtatgtatataatggaataccactcagccatgggaaaagcaacttggatggagctggaggccatttttctaaatgtagtaactcaggaatggaaaaccaaataaatactacatgttttttgcttagaagtgggagccaagctatgggtatgcaaaggaatacagagtgctataatagacactggagacttagaggagataaggatggcaggggaataaaaaactatgtattgggtacaatgggcactactcaggtggtaggtacactaaaatctcagactttaccactatataattcattcatgtaaccaaaaaccactggtactcctaaagctattgaaataataaaaaaagcaataagtaaatgtcaagaaatgtaaaaaaaatatagaaacaaatttctctggtttattcttggattattcagccgtatgcatatttctatgcatatggagacatccagtagagctatcttgaagcttaactttctgtcaaacataatttaatgtatctggggcctcaggcaaccataagagaaacgatatacatatccatgcattattggctattttacgaagtgatacagtgagccctctgaaaaagaaggatggtgacattgacatggcttgggaaagttaccatttttcttggctcgtttagctctcatccacaaagacttgttaaaggcagtgtatgggcaggct

SEQ ID NO: 24841 - DNA, 1028 bp, Homo sapiens
caaggaggaagtggcgggattgagtgatggtctcagaaagagtttgtattccagctctttcctgaaggactgatagcaaacttctccagtgagaagttgtctgtgctaagcttaagagagtgactctagaaccttatgctgtccactttcagctattcactgtaaagtggtggcggatatgtgtgaaacactatcactatgtcaccattagagccactagggaaaacgtgaggcagatagaacccatgcagttgctggaaggttctcactggatcacagagcttcatttttcaggatcctagtcggaagagcactcctgattggtgggagaagatgtactgagcattgagatagtgcaggatgattgctcctacttctcatccaaatccccctttagctataaaacctccctgcagaactgactttcatgtattggtatgtttggagaactatacacctccataaagtaaaaaaggaagtagaataaaggctcattaggcttagtactgcaaagagtaaagacaaagtagggtggcaatatgaaaatgtatgattcactgaagtccatgtttattagcaagcagcctcccttcccctttcttacacagtggtaacttagcctgaatgaggagagtagaagtttaaggacagactcaaatagtccaaaaataaatatagcgttcttgatcgaattttctttatgtatcttaaaatatgtttctttatgaataaagaaaatatgctgtgatgtgtgttttccaagaatgaaaagttctcatctaaagttttacgtaaattcttgatgcatttaatttcattctttttacttgaatctcttggctacttgctttcagcccacttaagactcacaaaagcagggctagtttgtttcttttattgattttgtggatgtggttgttggttgttgttgaacaaaagaaagtgaaaatactcttctgcagtcttctttagtagagtagcacaaagagcagtagccaaaggctaaaggagttattgaaattgttctg

SEQ ID NO: 24842 - DNA, 1028 bp, Homo sapiens
cataactgtgatatagttttaatttcatagaacaagaaataagtgaatatttagtagttctccagaacatttctggataagttatagggcttaacagaaaagaataaagtttatcttccatctaatctcattctttttatttagattttcccagttaatcattgtgtaagcaattgcttactgaatgaagacatttggtacatcctttttggaattgatttacaaagtttgtcttaattatatatttaaataaatacagaatatttctgtatactacatatttaacatggaatttaaatatccctttaatcactttaatatgtaatttgggatttgtcttgggaaacttggaaatcattactaatttgttcattacattctattatttggtcagcattttagtatctcataataacattatatctatttcactgactatagaattcaaaagaatcagtgatagttttgaggtcacacaatgagtcaatattatcaagcagatttcctgactccagacatatttcctttataatttatatgctaaattatggaatatctagggatcattatgataatatgattaagagatggtattgtgttatctgtttggtcgaaggcactttatttttccaattgtctacagatgtggataagtagtgccagattcacagaataatttgattaaatttgttttactactcatcctccacatgcaaatatcactcatttctgtcggacctaaatgccttgtttctgtaggctgccctgcatttctaatatatgaaatactatgttccgcaagaaaagaactgctaatttactaatcggttcacaaaatatttgttatttagttcattcaaatttatcgaggtgcctcaattacaaagcactgttctaggcaccacaggctctgtattaggcactaaataatacatgctaaggagcattttgggctgctcttgctcattttgaatctgttaaaaaatatattcacatcttttgacatgtttgtaggtttcttgtcactc

SEQ ID NO: 24843 - DNA, 1025 bp, Homo sapiens
gagaagtgtcacaattattggtagtataaaatgtgtagtaattacttgattgatttcattagttgtaaacttaaacatcctatcgatatttttataattttagtatacaaggaatggtatcataaatggtagtaaatgtttaataagaagatagctgcaatttatttcacaattatttggatttttaatagcatttatttttctgtatctttaatttcctataataagaataattaatagatgataactagataatgacagaagcagacagaaataacagacgaacataaacaaacattcaagtctgtcagttttggaatttcagaaggctagaaaaaaatgtatgtacgtatataaaatactcaaaattttcacatattatctcatacatttttagttctattttcaaaatatagaatcatttagaaaaataactttccagatgaaatatatttctttttttaacaacactggtagataatttttaaatcattgggataaaacttagaaattgtaacaaatatcaagtaagatacactatacatttgcatgttgatcccagcaacaaattatttcccattaccagcacttgtattaataattatgtatgtgcatgtatttgtatatagctatatatccatgtatccatatttctagatggacaatccgacataaatggcttcagaatttgtggatttaatttctgccgtattgttcctggataattacactatgctactagagaaagtatgtgtctgcattggtgtgtacatattcatttatttctatatttctgtaacaaatgtctattgattgcctctatgtagctgatactctactaggagtattaatacaatgtcctttttttatagattgtactgtttagtgcagtggtctccaaagtaggatgcatgtaccccaaaaaagtgtgtagtataatttactggcagcaagtagaaatatttttaaaaattatctggatatttgtgattatcttatttaaaaatatttctataacattttat

SEQ ID NO: 24844 - DNA, 1048 bp, Homo sapiens
gtaactttggataattccttaaatagctctggattatatgttgatatattgtttatttattttgtgaaatataaacagccattcaagcttccaaatcagcttgcaaactttgtacatttctaggtttctttgaattaagtgtgtctccagacagtgaaagcaaattttaccatatacgtaagcaaagcatagataggaaatctgcaactcctttcactctgctgtcccccagcaaaaataaaagcaatagtagaaaacaaatatcaagaagtcagttctaaagcttaacacaggtgctttggagttaccattattgcactaattttttatattttaaaagttgtaaagtgcaaaatgttatgccggcttcattaatatattattctaggtgataatactaaaagtcactggcatatcatcttttgctatgattgattctgcatatttaattaggtttatttaatactaaatttgggagatttctcaatatattgaacaagaacaacccggacaacactggcactgaccaaataaaatgaatacaagcagctaataagttacagttcatatacagttaatatcagggttcatagtggaattctgtccactttttcaaagattaatgaaatgaaatttggtaaacaatctctttgttatgttgatgtctaattttaacatgcagatttctctttttcccttctaactcaattgataactttgatttatgaaacaaaatcactccaaaaagcttattgtctgcattgaaataaaggaagatagtatattaaactagaagtaacttaacttttatgaacctttgatgtaggacacttggatttggagaatgtgaatatgaagttggggatcaaacagaaatattcctataaaagggagcaaagtgtataaagaacaaacatagagaagctggcctacaaagtaaagtaaaatatagatacaaacactcactatttgacttagaaagaatattaagtaataacggaatgtcagacttgataaaaaatagattttcatactgatgttgggaact

SEQ ID NO: 24845 - DNA, 1050 bp, Homo sapiens
ttattttactaagtaccatttagtgttgcttgtttgtttattttttgagatggagtctcactctgtcgcccagactggaggcaatctcagcttactgcaagctccgtctcctgggtccaagcaattctcccacctcagcctcctgagtatctgggattacaggggcgtgccaccacgcctggctaatttttgtattttttagtagatacaaggtttcaccatgttggccaagctcaagggatctgcccgcctctgcctcccaaaaagctgagattacaggcgtaagccaccttgcccagtcctacttagttttaattgtcaggctcatattcaaatgaaatggcttaactatcttatattccctttctaaacctcagaatttcttattttgttggggtagaagaaggaaaaggggaagacaaagaaatgtgttccttccctatctggccagagtttagcaaacattgctagtcatatatagaaggttatcagtctaacattgactacctatgaatgcctccatgtagcaaacatattggtctggggactgaattcttagaaagtaatgcttagtagttttgatgtgtgattctctcatatccagacgaagtttgaccttttctacccagcttcggctttgcttaccaaaacattttgcttctgacagcccccaccccaccctttcttttttataaacagctctcttgattagggtgtcagaaagatggccccaaatcttagtttattctatgatgtttgcctgaccaacaggaagctcactctgcattgctattcccaacagttagcttttaagctatcaattctgtcctctctctaccctgctataatctcttaattctactttatgtagtcagagcagatacatgtatctattgcttcaacagaactcttacctgggaatagaatgtcagttcttctatcttgcaaacattactagtctctgtaacagattcttttgggatttttttaaataaaaagtaggtggcggaagaagtgctacttaaaattgctctatttcccaccaggcac

SEQ ID NO: 24846 - DNA, 1034 bp, Homo sapiens
tatatcctgttcttattaaaatgtctttagtaaaagcatgcaagagctttcttgttgggaactatctcacacatcgtgattagggtgtcagaaagattgaatgattatttgcttgtttttaaaagacagcaagagctataggaagttatttaagatcatagacttagcatacactcattgactagttgatagataatgatatgttaaggaaataccaagaaagattgttaatttgcatctattgtgcctgatgggaaatgaaaacaaataacagtttgattcttaaattccactactatttgaaaatactggaattcttaggtttgtattttaagctattttatctttcttgtccatttttataattctaacatggattatgaagtaaagttgaagtaagtgaaaattatttttattattttccaatagctcttaattttttatatatgcatgtacacgtatacccactgcataaattgtataggaagaaaaaaattactttgctgatagtagaaaagactgaaaaattatgcctttaatcaaatattcagtgactcaatggctttttttttaatgtttctcccattaaaacagaactaatactatgccactgaaatgctgatatttttattttcttgttttcttttgtgtgtgtgtgtgtgagagagagagagagaaagagagagagaaatatttgtgttttttctgtctctcaactaggtgcttgggctaggacaaagcattgtgagactggctctagggctgtgtgtgtgtgtgtgtgtgtgtgtgtgtgagagagagagagagagagagagaggtaaatatttgtgttttctctctcaactaggtgctttggctaggacaaagcatgtgagattggctctagggctgtgtgtgtgtgtgtgtgtgtgtgtgtgtgtgtgtgtgtgtctgtgttagtgtgttcccccagtcataatgaaaaattgttccaaagcagtgtgtgtacttcactgtttttttctttattatttgtcctagatccttttttttgt

SEQ ID NO: 24847 - DNA, 1056 bp, Homo sapiens
aagtttatttgaggtcttgtcctgtttttgttctcgagctctttcaaaatgttctgccaggtaatgtatctgaggtaaagggtaattttttcattctaatttatgttttccaattaggtctctgttttcaagttgaagttctttaactgctaaatatcatagaaaacatttttgtctatcctgaaaatatctagcagtttcctattttctttctttgtgcatttgtgagatagaattctttttagtttgtttgtcatgctctatcttccaggctggagtgcagtagcgacataatggctcacggcaggccttgatctcatgggctcaattgattctcccacttcagacttcctagtagctggaaccacaggcatacaccccaatgcctggctaatttgtgtatttttggtagagatggggttttcgccatgttgcctgggttagtctcgaactcctggactcaagtgatccattctgtttggccaccaatagtgccaagattatagacttgagccacagcacctgatgttgcctatgagattgaattctaatcacttgcttttaattgtcaatgtttcaggaattgctcttagtagactttgccctacttttggggctttttgttttttgacgctcaggcttattaaaagggattctgtacatcccttttccgataactctatttagctttttacagagcaggatttatcatctgagatttcttacaatgtatacaatttggtgtatgtcaagaaacctgagtatatgcacccaaattaattattatttttctatgaataatcactggtcttctctgggtttaggaaaattcttaattatgattctttgtccagtttgggctgaaagtttaaattctacagttgcctgaatacttatctaatgggagggatggatttttataagcaattggactatttggagtcattatgaaaaggtagttggtctagaaaggggaagaggagaaaggagttaacaggctgtggaaggagagagatcaaatggataattggagtatggagaactgtatataggaaa

SEQ ID NO: 24848 - DNA, 1046 bp, Homo sapiens
acataatgaaaagggcctttcactattcataaacatattaggaaatttagaaaatgccattaaagagttaacatcaaaaatgtatacgaattaagtttcttttttcctaagttttatttgtaacttgatccagttccagatacatttaaatctcagcttattatctgtagtgtggagaacatatatgttaattcacatataagagaattcttgtgagaattaaaataaatctttttgtgtgaaaattatttaaaatttctaaatagctatcatataatgtatctaaccaaaataaaaatatctgtgttttcataatatcttcaaattattaagtctatttcaaaataatgaaaaatcaagcattcttaatactcattgctttgaggcaatgtgatctcttggattgaaaactaattttcagtatattctagttcaagtttttttttaaaagggcaacagaatcaactttacaaaataagggctccagttatctcagatgtaaatttaaaaagatcaattaggacagctataacaactcaaaggacatattattttctatgtgttaatgtttattttaaaaaatgtttaataaattataattgtatatatttatagcatacaatgtgatgttttgatctatgtgttcaatgtggcatgattcaataaaatgaattaacatattcatcacttcacttacctatcaattttatggtgagacatttgaaatttactccagaggacatgttgctaagtgaaataagcctgacactgaaagatatactgtttgtgttcacatttataataaattacaaataaaatataataacctgctaattttttgacaattgaatttaaacagaacagtatcatcattgattatataattgaaataatgttattacttctctccatcaacaaattagcagaagaaaatgtatgattttctttttcttcacaataaaacatggtaggaaatttagttgccagaagcaacaggagcccctcagaaggttcaaaaactcttgagataagctacaatggatcct

SEQ ID NO: 24849 - DNA, 1031 bp, Homo sapiens
aacagacacagtttcaaatcgtatcttataagccgtagttccttagaaaaattattgaattattttctgaggttcagttttctcttcatttaataatacgtatttcttaagttaaaacatgaaaggcaagactggtaaaaagtaatttctaaaaattattgatctccttctttgccaccctggttctttatacatccactacccacatgaaatgttgaaaatggctgatgagtagttgtgaaataattgaatagatccacaaatcacataaataagaaaactattttcaaatttttatggctgaagagtttaaaattacatcaaatatcattaaaccatatgtcagtgatcctcctggatgacttggttgccacatctctctctcacacacacacgcacacacacacacacactcagaatattttttttctctaaattagtttcagctttttaaggacaaataataatttgtgttatttttatacttgagttaattacatttatctgacaaatatgaagactttgtaagccggcaattttttcttccattctcttactaagttgtattgtttgttaattatttcagtgatggtctgtggcttttaaactatactaatgtttgttcatatgaaaattcatttatttttcactaagtttttaatgatagcttagcagtgttaaaattctagcttaacacttatttttgtgaagcattttgaagatttttctgcctaattttctgaaagtgttagtattgcctaagaagtcttttgtcagcctaattgctattcctttctatataaatatgctttttctgtctgatagctctatttttttctgtttattctgaatgttatgtactatcagcccaatgtatttaattgttggtttgatttaattaacctttccagtacatggtttgtatctttaatcagagtaccccagttattatatttctaggaaattctcacttttccctaaaaaatagagcttccccattatgccctttattttattttttttctggaact

SEQ ID NO: 24850 - DNA, 1938 bp, Homo sapiens
tttaatatgtaaccacctcaggctttcttcctgctttaaacatctcaaggatttcccactgaactcagaatgacattcaaactccttatcttaagtctatttcaatcttcttactactgtagtcccatctcccacttcacacaccctcgaaactccattgagcctccacgtggctgctctgttcttgtcattcagctctctccagtcacatgtcatctccccagatgaaaccttcctggctatcaaatccaaacgcctctgcagtttctattacttcagtgattctaccttcttgaggaatacatcaccatgtgaaatgaccattaatatttttactgccatgagcaaggacttaaagagggtttgtactgccctttggggtatacaacaatcctccacttggtctggaatttgaattcagaatgtcagtgcctgcttttactctctgaaactaaagaattttatctaaagaaacaagttgccttcagatcttcttttactctcacaaatgaaaccaagtcatgtagatatgaatcagatatgaagtaatattgaaaatatatttgaattgcatttatatactttaatatagaaaattaaatgaatatctatctatctatctatctaatacttctgatttctctgaaatttttttcctgtttccaatattattctgagaacaatcctgtaagttaaggaagtttaagaaggctgatatttcctgactataaggaatacttttgtatatttgaaatatttaaaagtggtacagtttgcacatgagtgtagagtttactgtaactaaagtatcaaaaaaacctcgagtcttctctcagaaacaatctaaaaagaattattttagtagatgagaagttaccaaaaaatcgtttctaaaggtgacttccaaaataatgatttttgcatatacttttttaaaaaacattcttggctccaaacataaacttcctagtgtactgctttccttctttagacttttcatatatatatataaaatattgtgtattttaatatgaggaaaatatatttttatagtatatattataaatatataatatattttaagactgcataaaacaacaaaaatcacataaaagcataaagtataggaattcttccacatttcctttatattaatatacctaatttagttatgtaaatatatagtatttatattgctttgtgggcttcacaccaggagttcaaatagtttttattacaggaaatgatacatttgtatctgtttttttatttgttattctttttcttaatacaatggaagaatctccaagttattaccttcaaagtggtcttgtatttttaatttaatgttttattcaggtataattgacacacagtaaactgtacatatgtacttacaaaattgtgtaagttttgaagtacgtgggcatgggtgaactgtcactataatcatgataataaacatatccatcaccctcaaatataccttgtgcccctttacaataatatttttcctactgttgtgagccctgaattcccaagaaaccattcatttactttcattcactgttgaattgtttgcttcttttataattataaagaatttataccatatatatatatttattttttgtgcctttaaaccacattctgaaagcaaataccttataattttaatcttcataaattttaccctttctttcttgcttttattgtagtgagaacacttaacatgatatgtagcctctcaacaaagttttaagtgtataatacagtattgtgaactctaagcacagtgttgcataacaggtctctagaacttattcatcttgtaaaactgaaactttataccctttgaaaaagaactccttatttttttctcactgcagcccctagcagtcatctttctattttgtttttatgaatttgactgtgtta

SEQ ID NO: 24851 - DNA, 1044 bp, Homo sapiens
ctgtaagtcttcttgagtaatgaggacactttaccaatattaagtcatccagtccacaaacatgggatgtctttttatttttttgtgatctctttaatttctttcatcagagttatgtagttttcagtgtccaagtctttcaactacttgattaagtttattcctatgaagttaattctttttgatgatatcaagtgggtgatcttcctgcctcagcctcacaaaacagtctacttaatttttggtggggagttttaccagacatagtatattcctgggttgcaatttttttatttcatccttttgaatagataatcccattgtttactagtctgcaaggtattgctaagaaacccattgatagtcttattgaagctctcccatacatgatgagtttatttcgatgctttcaaaattatctctttgtctttaatgtcgacacgttggctgtaatgagtcttggtgtaagttaaacttttggttgattctgtctgcaaacttctgagcttcgtaaatctcaatgtctatttctctctctgtatttgagaagttttggccattatttctttaaataagcttttgattcctttcttttgttcttccagaactttcataatgcatatattagttggtttgatggtgcccgtaattctcttaaactttcttcactcctattcattcttttattctttttgtttctcttataatttctaatgaccttcaagctttctggttctttcttctgatcaagtctgctgttgaactacactaggaaatttttcagtttagttatactcatcagctccagagtttctctttgcttctttgcatagtttctgccctttgttgatatccttgatttattcctgtatcatttttttcttatcttatacagttgtccatctttgttttttgtaactcactgagcttctttaaaacaattatattgagcgtttataaggaaatttatagatttccatttctaatttaggtaactggagatttatttattttttaattgagtcatgtttccccaattctttt

SEQ ID NO: 24852 - DNA, 1035 bp, Homo sapiens
gagaagaaaataattttttgtttgtattaaatgtcagattttctttttgtacttcgtacatgttaataaactttatactcctccaactgtcctcttttgaccacagtgtagaacaccctggaagagcctaggtggaaaccctgtcataactcctctctaaaatcataatataataaacaccaagcactacaggcatcccatcctggcagggtatcagatgtaaagacaaacgaattagacataaataaataatttgaattatgatttactgaaatttattgaaaaatggcagatggagataatatttataaattactatgcttcttaaaattagtttttgtacgtctctctctcatgatccttcttgtgcagcaactgccctgaaatcttttcatttatttttgtcttcccagttttttagaattattttcccaaatttctttcaattatgtactcttacctttctccagattcttttttttagatctatttgctgttgttttgttggtttcatcagtaactctgtcctgctgttccaaaataatttttcaacatccttttaaggcacctcagtgcttccctttacccagttttcaaattcttcacagtaaatgtccaggtttcaaattggcaaaactagaattctttgtgttgaatacaagataggagagaagagagatactgtgaattcacacaagtaagattctcttttgccgccatccattacaagaactgtggaaaagggttattgcattacatgtaagttggcaaacaaaccatggtcacttttagagtatactcataattatatgtattttattttatttttattgagacataatatttgtgcatgtttatggagtacatgtgatatttcgttacatgcatataatgtgtaatgatcaagtcaggttatttagtgtgtctatcacttcaagtatttatcatttctatttgtttttaacgtttcaagtcctctcttaaagctattttgaaatatacatcatatcaaatggggaaaagctcaaagctttt

SEQ ID NO: 24853 - DNA, 1060 bp, Homo sapiens
gcaagctgttggtggacctaccattctggggtctggaggacagtggccctcttttcacagctcaagcaggcggtgccccagtggggattctgtgtggggattctgcatgggggctctgaccccacattaccttgcccttcccccacactgccctagtagaggttctccatgagggccccatccctacagcaaacttctgccagggcattcaggcatttccgtacatcttctgaaaactagctggaggttctcaaaccccagttcttgacttttatgcacttacaggctcaataccacatgaaagctgccaaggcttggggattacaccctgaagcaatagtctgagctgtaccttggcccgttttagtcacggctggggcagctgggatgcagggcaccacatctctagactgcacacagcagagggaccctgggccccacccatgaaaccattttttttttctcttacactttcaggcctgtaatgggaggggctgccacaaaggtctctgacatgccctggagacattttcccattgtcttggggattaacatttggctcctcattcattatgcaaatttctgcagctggctggaatttcttcccagaaaatgggattttctttactatcatgttgtcaagctgcaaattttcggaacttttatgttctccttcccttataaacctgaatgcctttaacaacaagcaagtcaccttttgaatgctttgctgcttagaaatttcttccaccagataccctaaatcatctctctcaagttcaaagttcaacaaatctttagggcaggggcaaaatacagccagtctctttcctaaaacatatcaagggtcacctttgctccagttcccaacaagttcctcatctttgtctgagaccacctcatcctggatttcatggttcatatcattatcagcactttggtcaaagccattgaacaagtctctagagagttccaaactttcccacattttcctgtcttcttctgagccttccaaaatgttccaacctctgcctcttacccagttgcaaagtcacttcca

SEQ ID NO: 24854 - DNA, 1049 bp, Homo sapiens
aatggtcattttatggctcaatattagaataagatgattttcaaaatgtttaattttttttaaattgggagaaaaattaaaacaagtatatttggattaaaatgtcatttcattttgcatacatcatagaagttactttgggctgtattgtaactataaatactgaagctgattttcctgcatggatatcagtttcattattttataggaacaccattcaaccattacatattagtgttttcatccgaagttgtaaaaacacaggttactttaatgaaaacattttttaagtaagctctttatttcagttaagtattggcttattgctttcagtctatatattggtctgttaaatgtatattttgatcactgtgaaaacagcaatgattttccatacaagattgtgtaatccctagcaaaactgtaatgattttggtcactagattggtctgcaatggtgtaggtatttggggatttctatattcaacaaagtatttattttgcttctgttctaacacttaattatgtattagaaggacagatacatagatggatggattttaaaaatctcttttattcttaaaaagttagttgacatattgacatgaaaattaacatacttagaaattaatgaagatccttatatactgtagaatctgtgaagttcaacatagttttggcagttgttatatatctcttataatattgtgcttattcttttacttctatttctcttcctcatcaaaatctcctagcactcatatgtgaattaaatttttctaagctatgcaccaggaaaaggccattgtaatcctgcttcaagcagctggtagtaaaagaaacacattaataaactgtgcataaattcttaaaagatggaagaagaaatggctttgaattacatttattactttatgtaagtaaatgaagtaccgcatgtagaatatatgtatttaatgctctatgtacatttatttgtcttaagtgaagaaaaatgatagctgctataatttaaaaatgtacacgattttgaaatcatgatatttccc

SEQ ID NO: 24855 - DNA, 1033 bp, Homo sapiens
actaaatagtggtggtatttatgaacattcttgtgttttttctgttttaaagaatatattaaacattggttcattgagaataagttttgttgtagatgttgttacttatatcaaattttaaaaattccctttactacttttttttgtttgttttttgttttttttttgagatggaatctcactttgtcacccaggctggagtgtagtggcgcgatctcggctcactgcaagctccacctcctgggttcacgccattcttctgcctcagcctcctgagtagctgggaccacaggcaatcgccaccatgcccggttaatttttttctatttttttttagtagagacagggtttcaccgtggtagccagggtggcctctatctcctgacctcgtgatccacctgccccggcctcccaaagtgctgggattacaggtgtgagccactgcgaccggctttactactcctttttaagctatttttaaaatcatgaaatagtgttgaactttgtcacgtgaattttctgtaataattgataaactgtatgcattttcttctgtaatacaatttaatgatttacaatgatagtcatttgtgtaaaaccttatacttggtgcttttgaacatgtttatgtaattatcattaatatctctctaaactaaaaaataaacatgacttgctgacctatttacttgattttaattaataaatatgtttaattttctcatatttatttcaaattatatttgtctatgccattcatgagaactaaggtgttataaatattcatatggactttcatagtaatatacatttctgtagcctatatgaataaactcttcgacttgaataagtattaactgggtccaggacaagaattgcatttgaaaagataacctatatttctcaaaagaaaaataaagaaaatatcagatctgtccaggcgcagtggcttacgcttataatcccagcactttggaaggccgaggcaggctgatcacctgaggtcgggagtttgagaccagcctgaccaaca

SEQ ID NO: 24856 - DNA, 1024 bp, Homo sapiens
gtagagacagggttttgccatgttggccaggctcatctcaaactcctgacaagaagtgatcctccagcctcggcctcccaaagtgctgggatgacaggtgtgagccaccatgctgggcctcatgactattctttatagaactaatgcaaaatacagatatacaatagcttacctccatacacaaccactcaatgtcccaatactttaatctcccctgctcttcagatcttacatgttttagcctttttgtctctgcctgtatgccttagctgtaagccaaatataatcaaataattgaaaactgactatgattagaatcagtgcagacattctccaacattcatttctatatttaaacattcattttcttcaaaaaaattaactcagttgttgaattaattgaaatagaatgaaatacaattttcttgtaagatttatcacttgtttttctgtattttagtcaaccatctgtgacaattttgttcatgacttggtaaatgaatcctgaaactcattcaacacctgtttaaattcaatatttcaagggactcatagtctcatactgtgccacattagtgcttcagtcaactccataagtggaatttcatattttttgtatattcttaagactcctcaagtcaccatcttctctattaaggctcatgtgcatttgttagaaatatcaaatgtgactagcaccaggtgaatatattttagaaatgcccaattgatatttatggtcacaataataagcaagggagatgagcaagttttctaagggtgttaaatagcattagagtgttggcctctttacggtgcttacataatatgcttagtgaacactatccaaagactgcactttgattttctgatgacgctgaagaacatgtctcaaaactcagaatatttcagaagacaaatcttttatttctcaggcatagatttattagttttttcaaaattatctttccctgtgattaaataaaacctcaggaaacttttagaaagatgatagctgtgagaa

SEQ ID NO: 24857 - DNA, 1063 bp, Homo sapiens
tagaaaatataggcctctttattttgaatttccacaaataatattaaaatattaaaatgggagaaataagagactcccaagacttaaaatatttaatggtggtatattttgtatatatctatacttagtttattcttactgcgatttaatttataacagaataaactggaaatgctataaatttgatgagtgtttttagaagcactctctatatagcattcaaaacagacatgaagtataaaagcctaaggtgaagggatttagtagtataagaagtaattagctgcctagagaatcctgtaagtaatgtgtggtcatcattatattgacatctatgtattagttttggattcatatggtaatatcttattttaaataagcattaaaatgaatccattttctattacttaaaataaccacttgttaatgggcacaaataacacaggaagtggagaactgctctatttcagctctaccatctcctagccatgtgagcctttatgtatctaggtaaatgcctttacttttctgctcttcattttctttatctactaattagaactatacataactaccctttataactcatagattattacaaggatcaaaccaacacattgcaattattttgtattatatacagtataagtacatcatattatcatagaatgtactatggtctgaatgtttgtgtctccccaaaattcatatgttgaaaccctaacccctaaggtgattttaagaggtagtgcctttaaaaagtgattagaccatgagggtgcaaccctcatgaacaggattagtgcccttataaaagaggccctagagagagccatgccccttccaccatgtgaggacacagcaagaaggaatatctatgaaccagaaagcaggccctcaccaaagtccgaatctattgcaaccttgatcttgatcttccaatactccagaaccatgagaagggaatttctttgttttttaagccacccattttatagtgttttgttatagcaaaccaaacaaagtaagacataatgtttccaaaaacaataatatggtttcc

SEQ ID NO: 24858 - DNA, 1562 bp, Homo sapiens
tatacagcaagactagtatgtgcatatattatttcatgtgtccatttttaagtaatatcctagaaaatgattaaatggtcttaatgtgtgtatgtatatacatagacatttaaatacatgtgtgtataggtgtacgagtgtgtataggtgtaactatgtagatacatgtgtcttttttcataaatacatttctatttctaacttgctatttttggtaaacaaaatactctaaaatttgtttccctgcttttataactgatatgttgaacacaccagagacaactgggaaaatgagcagtttagtgccaaacaatttatgactttaaaacttagctcagtcttccatctttctaaacagttattttatgtaggtttaatcagcaacttcagttttcctctacgtctggtttaaacattccacaagtctcaaggtctccactaaattcttgctttctcatgctgagctgtcatattaatttatcttacatgataaactctttcagtttccagagctgtagtatatcaccatctgatcacgtgaccacatctttaatattgtaaaaacagcttcctactctcataattcagttgaagatcaaggaagtgatcttcagagggtaattgaaattcatgtcaatgtgaacttcaggtttgttccatgaatcaaaagggaaacctgacccaaatccttgcacaaagtctgtattttcctttccacacactctacaatgtctaaacactaattctcacctcttaaacatgtgcaggttacacttccttcatcatctcctgcttgaattattgcaactatctccacattaatcttgcttgttccttgggatatctgttcctcttaaatcaatattttattttactactgatttttgactgtggccttttatttaaagaccaagtcatcttacatttatgtttcttggatgcttttctctttcagtctttttgaatgacaataggtatctatggaaaattataacacaatgcaatcaaatgatttgaaagttgttttgtttgtcattatagtttgaagagtagaacattcaccttaaaaaacactggctagttctgaaattatgtttaatttgtattttttaaaatgttatctggaggatgctgtacttattctttcatccttgccatgagattcaaagtgattatgtgtaggggtgtgaaaacaaacaaaacaataaaaatatctaatgtaagcagaaagacttagctgatccctctagagcttgaataaatagacatttcagtcttttcctgtttggagtttcactaattttcttgaagggaaatagaaaaacttgagaaaccatttgaagatttcccttactgtgtagccttcttctgttttattgatgggctctttctgtttcaagaattgcaaagcctgggaggtattgttgcttagcattgtgcaggaaaagctatcataatggagaattttaaaagaaaacattgtcaggagtgcttgtagactctactatggggaaatttgacatctcttttgcatattgccacatatttctgtggattcttaa

SEQ ID NO: 24859 - DNA, 1039 bp, Homo sapiens
aatagccaaaatgtagaagcagcctgccttgagctgaactgtgtcccatgcaaaatttggaggttggaatcctaacctccaatggtactgccttcagaggtagggtttttaaggaagtaattaaggttaaatgaggttttagggaaaggccataatccagtaagactggggtccttataagaacagcaggacataccagaggcatgcaactacagaaaaaaggccatgtgaggacacagcgagaaagcagctttatctacaagccaaggagaaaggtcttagaagaatgtaaccttaacagcaccttgatcttggatttccggcctccaagactgaggaatacatttctgttgttaaatctacccagttgatagtattttgttaaagctattctgactaacacacaacccaaatgtccactggtggatgagcagatagacataatggagtatatgcacacaatggaatattacttaatcttacaaaggaaggaaattctgaaacattctacaaaatggatcaaccttgaggaaattggggttagtgaaataagccggaaacaaaaaacaaatacagtatgattccacttacatgacttatctgaagtagccaaactcatagacacagaaagtagaatgagttaccacgggtttgtggaagggggaaatggagagttgtttaatgggtatagagtttcagttttgcaagatgaaaatattctggagatcacaaaacaatatgaatgtattgaacactgctgaactacgtgcttcaaaatggctaaggtggtaaattttatgttacatatatttgccacaaagtgtcaaacaaacaaaagtcaccactcactttattaaaatgatcaggctacttaaagataagtctttaaaatattattaactattgcttttgaaatgtaaaagtaaaattataatttcaatattaggagtaaaaaacactttaggtaaaaatgtaaggaattacaaggagtctaccttcttaaaaagttcaaagggaaaaacaacatgaatagtaattg

SEQ ID NO: 24860 - DNA, 1053 bp, Homo sapiens
aatatctaaaatcaaaactatctgaaatgtaaaagatatatagaaacccaaatttttgtaccctcctggcatgagtagaactattgtggaaaactggcagtgtcaataattctgaatatataaatattagatattctataacccaaaatcttgtctataggtatattcaattgaaatatgtgtgtgtttgtgtatatttcacccaaagacagatacgtaaataagaatattcagagcaacataactcgaacactacaaacaactctcatgtaaatcaacaacaaaatggataaataaattttgatatattaatttacacagtggtatgccatacagtatgaagatgagcaaactaataccacacacaaaagaaattactctcataaccatgctgttgggcactggaaaccaggaaaaaatatttacattctttgattctaactatgtgcttttaaaatagtcaatactatttcaacatttttgaaattaaaatattggtcatttttgacaataaggttgtagtgcttgagaggagaaaatatcagcaatgtatagctgcataacaagtcaccacaagcttagtggcttaaaaaaaaacaaaacatgtatttaatatatcacagtttctgtacgtcaggtgtccagacaggttttgctgggaactccacaacagggcctcatcaggctgcagttaagatgtctattgcagttaagatgtctcctggggctagttggggtggctcatgcctgtaatcccagcactttgggaggccaaggaaggaggatcacttgagcctaggagttcaagaccatcctgggcaatatagcgagaccccagctctatacaaaattttaaaataaaaaaaaaaaagaagatgtctactggcctttctcatctgttagatcaactggataaaagtctactcccaagatcacttcagttggcagaattcactaccttattgttagaggactgaggccctcagtttgtagactacctgcagctcctggcatgtggacatttccatagacaagttacgatgatgcccactt

SEQ ID NO: 24861 - DNA, 1015 bp, Homo sapiens
ctaatatctgtatcatatgggtattaaacagttcttttagatttttgtttgtttgtttttttaacctggtcatcaattctctctccaaccaatacctgtatctcacacctctgctgtgaaaatagaataatgcaagtggaaatcctggagaatcaatgcctctggtctctatttcaattgacacaccattagaccatgagcaagagaacaaacctgctaacaatggtcaggaagggaaaccaagtagccgattaaaattaataggtctaaggaaataatggcattcatagcaacctggttggaattgcagaccattattcttagtgaagtaactcaggaatggaaaatcaaacattttatattctcactcataaatgggagctaagctatgaggatgcaaaggcataagaatgatacagtgaactttggggactgagggaaagagtgggaggcaggtgaggtataaagactacaggttgggtacaatgtacactgctcggtgatggatgcaccaaaatctcagaaatcgccactaaagaaagaattcatgtaatgagaaaccacctgttctcccaaaatccattgaaataaaaattttttaaaaaattataaatgattaataggtctagcaagctagtatcaaacagcaagaggggagccaacagaaaacaccatattgaagtttagtattaagtgttaatgtaaagtcaggagacaaaatggtagaatttagggcactactgattgttcacttcatctgcacattgggtttgaatcgagagctgtgtcagtaaaaattagaaaaatacttagtctgctgtcctccacagttatttattcaaaattgtctgtcttaacaactttcctaaaatcttgccttttttaggtattttgtgtatttaaaaaagttaggaaaggaatcctactatttgatatgtatatagtgtggggaatttaaaacttattctatggctttgttggtgatgattaactgcttttatttgctgttgaatcg

SEQ ID NO: 24862 - DNA, 1059 bp, Homo sapiens
gcaacaaataggaaaccagtatattcaccaaggtttcaagggtctcagttctgtgagacagtcttcattataaaaaaatttcgcaataatttttgtattagataccatggtcccacaggctcccaggcttcacaggttcacgaccattctagaactttctaaatgtgtatatactgactgtatgtacagctcagactgtgtgatatctccattataaagtctacctaatactgattaaggtatgagtaagaacatgcccagtaaaatgtttccacacaggtgccaggttttacaactggccatgttatgtagtaccagagcgaaaatttcagccaaaaggcatgttgatgtcaaacaaacaaacaaacaaacaaaacaactatgtagagttacggagaagggtgaggctaaatcaccactggaagggtttaattcttagtgaaaccagtaaataataatttatatgctacgttttaaacttttttaaaaaaattatggtaaaatagacttaggaattattccatcttttacaggtaagaaatctgagaactgaaaactgagaactgaagaattattcttaaaagtggttcctgtctttctgtttgtttttccatttgtgcttattccatttcagaaccttaatcacagatggagggaggtacatgaaatgaaacagaaaatgaaaaatggctctaaactcagaggttaaacctgatgggagtcaaggcaaactctggggcaaggtttttgacaccagagcttcttatactgttgaagtgaaacgaagaaaagcttttttatcttggagaaattatcccttccctagacatcttgaaaccataaatgctaggtcttaaaaattctggctacactttaaaaattctcttcaataatggattgagtgcaatgagcagtaaactgaagactagagacttgcatttcaatcatggctctgtccttaacttcagcaggagctatcaattagttatttactccacttgcatcacaaatttctctctaggggtgggttagtcttctgaaaaggacacaagtaacctg

SEQ ID NO: 24863 - DNA, 1089 bp, Homo sapiens
ctggccatgaagggccatgcctgtagtcccagctatgcaggaagctgaggtggaaggatcgcttgagcctgggagatcgaggcagcagtgagccatgatcgcaccactgcattccagcctgggtgacagagcaagaacctgtaaacaaacaaacaaacaaacacaaagtgttgtgtgaaagttttgtaagtttaactgcatgtaatatgatatttattactaggaatttgtaataacataaaaaggcaagccagaaattgggaaaatataactgcaacttacaaaaccaagaagaatttagtattatgattttattgtagaaatatgaacacatatgaaaaatagaaatggcccagtagaaaactgaacaaaaatatttgaggacattttacaaaaaaggaaacactaaaggcttatatgtgtattagaaattgttcaaaaataagcgacagttttacaacatagatttaaaaaatgttgataatatcaagtgataatgtggatgaatagaaaatattacacatcatttttgaaagtatgattgatttagcaactcaggaaaataatcttgtaaatttatatattaacatattaaaagaaaacaaatccctaatgttaattctaataggtatgaacaacaatatttgtaaattaattaggatataatcacaaaatgcaaaattattctgcagtgcaaattaactgtaggtaggtgtttcatgaaagaatcttagaaataaaaatagtgaacaaaagattgcaaagactacaccttttttatattcttcaaattaaagcaaaatgtaatgttttcattttcaaggatacagacatgattaatctctctttagaaaatggaaaatgatgaatacaaaactcaggatagtggttacttcaagaggtgatgtaggatgatgggataccataggagacgtaaccatgtgaaatatattctaattattaaactggatagtggtatcagagttattcaacttagtatataatgctttatgtgattgcatacatctcacatcacatactacataataaatcattaagccaggaaatatcataataaagcaaatatta

SEQ ID NO: 24864 - DNA, 1024 bp, Homo sapiens
tacagacaactattcactatgtattgtaacattcttgtggttctgaggtgaaggtaaatcaacaggagagattactgcttgtaactggctttggtttaagcgatttttcacatttttttctaagcataccttcttatcaaaaatgtagcaattacatgttactgagggaaaatagtactaggttttaatatttgcaaccaactacttcagctgacacaggatgccatcaactgttaaaatttattgatcatagttagattttctaagagtgatcgacagatagcaaagatggagcccttttgggaaaaaataaaatcccttctaccccagatttgtcactgttaagaggttataaaggaatgttaaattatttaagatatttcaaaaaaaattaagaatggaagagtaagttatgctggaaaagatatgacagctttaccctaagcaaagtaaatcatctacagagatgcagcttagctttttttattacaataaacatacttccataaggtgctgtaactgtgcagctagttcttttctttgtacaaaattatttttactgaatgtttcactcatctatgctttttcaagcttctattgttaagacacattttttaaaaaaaaattagacttgggagaagttataatataggcaaacacaagttattgtgtaacctagtatcatcaattcttcatttattgaaattcttttgtgtcttagtaatcaattattctgtggacagacaacttttttttgagatctcatgtttcttagtctgttgtgtgctgctgtaacagattacattgagactgagtatttgtttggatagaaatttattggctgacatgtctggaagcagggaagttcaagattaaggagacaacatctcctgaagtccttcttgctgtgtcatcccatggtggaaggcagaagggcaagacagagcaagagggtgcccaattcactcttttataacaacaccaataccacctatgaaggcagaagccctcatggccttatcat

SEQ ID NO: 24865 - DNA, 1060 bp, Homo sapiens
cccctcccccactcacgccgcgagccctccggaaagccacttccccgctccgggcttccctgggagccggctcgcttcctcgggccacgtgttcctcccttaggcctgtgtggcccactgccccttctccagcccctgatgacgctagctctctcattactatagtgacgctgctggcgcccccgcacctgggctttgcctctccgcccacacgcccgtgttcacccacccatgcacccgggtgcgaaatgacccctcgggactggcacagggttttatccttcgctagtcctctcagaattgaggagattttccaaggttatgtgtgaagaaatacgctgaacggtctcgggccagcgtctttctggaagaccgactcatgacgagtctttgtgttcgttatttctttacccgtcacccagggatggtactgttagttcttttgaaccaacaaattacgacttggtggctttttcgatccacctctgaaatgtttaaagtcccataaagaatggaaggactttccgtcacaacccagggtcttgaacgcagagcttggtacttacattctgaagtggattaaataggataacgccttaaaagagattaggtttcagtgtcactaattgtgtgaagtcccgtaacccagtttgagatatatgtgtgtgtgtgcgcgtgtatatatgtatacatctatgtgtgtgtatatgtgtatatatgtgtgtgtatatatattcgtttaacacattgagcctgtagccctttaatggccaaggaacgctattgacgttcttacatgttgtgcacttgttttccaacaactgaattgagtttccttaaaagatgaaccatatttgacattacgtaaacataccatacagaccccaacgaggtatttcttccctcgatttctgctattaatcctcctcataattaaataggacctcttgtactttggatataattagaaaaagccatgaccattttaccgcataaggtgtaaagtctgctcattggatttaagaaaatgcttaagaattttgctatacttggccaggtt

SEQ ID NO: 24866 - DNA, 1030 bp, Homo sapiens
cagtaggtagcctttgtgtccttcttcttgctttcacaccatgcagtgtttttgagatccatgcatgttgtgtatatttctagtatgttccttattgctgaaaagtattctcttgtatgggaaccattacaatatgtcaccttttgtgtttagtgtctctctctacttggaggaaccaaaagacgttataattgacgcttgaaaaacaaacttaggattccaaaatgggttagaggcggtgtttgttaaaatctcggcagccagaatggattattttgtggctaatggagtcatctgtagggaccttaaccttggggcatacgctgagttggcatgagagtgtccaatcatctgtatacattagagctacaggataggcatcattaggggatctgggtggtgtgtctatttctctgggaaggactggtcttgactacaccctcagttaattgcagttgttgagcttcttgcttttgctgaatatgcttgcattttgctttcttgtgttttgtgctatcattctttaacctaacctgcagtaccgttggatgtatgtctttgaggccatttctttctgaagactgaggtttgggtatgggttcttagtgaacaagatgttcaaatattccatttgtttctcagtgatcatagtttgtttcctttgaaatgtgtccacttgcctttaagaaggtcctcctagcctgacatcttgtaatctagatgttcttttatgttctggtccagggacctgatgagctttttcaaaaaatactgcaacaaagtttgtcagactcatgtgcaacattgatatttgctactactggagaggtacaacaatattttgaattgtagtgttaagttacagcatttgtgaaattagatttatagagactattctgttattcagcctggttaggaaatgatatagtctgcttcattatataggcaactttttttttaaacttccctaaaagcctagcacgtctcagtgactattccaagaagataattgatctctgtgactgttata

SEQ ID NO: 24867 - DNA, 1050 bp, Homo sapiens
ctactttttctcctgacaaatctgtcctttttaaaaacagttttattgagatataatttaccataacattgacctgttttaagtgtacaattcaatgaatttttactatatttatagagttttgtaactattactacagtctaattccagagcatctccatttaccctaaaaagaaatgtgtccaacatcagtctctccccatttgtacctccagccctaagcagctattaatttactttctgtgtctacatatttttggttttggatattttatataaacagaattatatgatacatagtcattcctattgtagcatgtatcagtgctacattccatttttattgcctaacagtattcaacggaatgaataaacattttgtttataccagtagatgcacatttgagtgttttctgcttcttggctattatgaataatgctactatgaacattcatgtgcaaatctttgtggggacatatgttttcctttctcttgtatagatgtctaggagtggaattgctgcgtcatatggtaatctatatttaccttttttaaaaactgtcaaactattttcaaaagtggctgtaccattttacatttctattagtaatgtatgagggtttcagtgtctccgtatccttgtggacactcatattctgtcttttttatattataataaccatcctaatgagtgtgaagccatattttattgtggttttgatttgcatttacccgatgatgaataatgttgaacatcttttcttgtgcttactggctgttatttcttctttggagaaacatctattcaaattctttgctcatttttcatttggttgtttgtcttactgagttgtaggagtttttcgttttttttttcatattatttaggatacaagtttttaatccagtatttgataagcaagtaatttccccagttttgagggttgtctttccactttttaaatggtgtttttgtagcacaaaagtttttaattttaattggctaatatatctactcttttatcattatgcttttggttttctaaatc

SEQ ID NO: 24868 - DNA, 1031 bp, Homo sapiens
cagtagtagtagttacacataggggagccaattattatctgttattaataattattatctattatcctcatgacataggcatccatataaaacttgttgggttcaatcacaacatttgtctgtgactatatatctttgttagtgtgcttgtgtctggtatgttttgggaagtggagagaaagggagatagtagggtaggcctgagaaggagaattgatagtccttagacttaaatgtcatatatcaacaacactggaaggatatacatgtaatatattgtgtatatacatgtaatatattgtgtccatgatctaggaaaacaacaagcctcattacctgattgtcattgtgttggtagaataaacaaaagacaagacatttagattgaagcactatatgcagagaaaaaaaataaccctatttggtacatatattacaaatgttaattgtctaaactaattggatgaaatataaacatttcattttcatctttttatccagatggctgcatatttcggattttctgtagctgccactgacattaatggagatgagtaagtttaaaaaaaaatgtttccagaaagttatcttctcatgtttacgaatactttactcaaactaaacatttttttcttctgtttttgtattccttttctgctaatctttctgtttaaggaaacaatttgaagcaaccttaatcatgaattctagaaaacctcatatgtttgttctgttttttttcagtagcttttataacatgaacaaataaagtaattttatgaattattcatagtttcttaaaagaattaaaggaagtttcaaatttgaaatgagtgctctggtaatcattttgtgtttcactgtgggtgtgagagatgcagaaagaggaaaagtgagttgtagtaagaaagaaaatgcctactaagacatgaaatttgttcttgctttggtgagaagtttctgttcttctagttatgcagatgtgtttattggagcacctctcttcatggatcgtggctctgatggcaaac

SEQ ID NO: 24869 - DNA, 1027 bp, Homo sapiens
tctttattttctgtccttactgctcactatatactgagtggtaaatattctgtcatactaaattttcattcactattttttaatcatatctaagagtttatatcaaaatgctgatgtaaaatgtttttcattatcatttaccaccattttattaatgtgattgcattagatctcatctttgcaaacaactgaaaagaatgacacggttgccgggcaaggtgagcgggaccatctcatcactaagcgggatcttgccctcagtgaaggagatattcacactttggtaagtgccatttcaaatatgtgcaccatagacatttaaaaatatgtgactatagaactgacgccaaagaacatttcaaaaataacaacagctgtgcttgaacaactacatttatttttataccatgcattcctctcactttcctttttcctagtcagattaatgccatattttcttcaaatgagctatttttgtagatggctaataaaactagtttatgtcccaactttgattctcctactctagttctttaactgtcctctttctgggcctcctcctaatctctgaggctttagtacgatactaaaaaatccagaaggtcccaacaaaaatacattggaataataattagcacttgattaacctttgttgagttagcctatataatggctataatgtttttaaaggcaattgtttttcttttttcttttaattaacaaatctccagatctctagtagagaacctggtatagtgttttttgtttgtttgtttgtttgttttttgacacagagcctcactttgtcacccaggctggagtgcaatgacacaaacacagctcactgaggccttgacctcccaggctcaagcaatcctcccctatcagtcccccaagtagctaggactataggcgctctcccccatgcccagctaagttttgtattttttgttgagatgaggtttcaccatgttgcccaggctggtctcaaattcctgagctcaagcgatctgcccacctcagcctc

SEQ ID NO: 24870 - DNA, 1035 bp, Homo sapiens
gcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaa

SEQ ID NO: 24871 - DNA, 1074 bp, Homo sapiens
ctttgcatgattcattactgcagtctcaactccagcttctttcctacttcatcattgcttcagttctctgtacctcgggagtgacaggttttgtgcctcagtgccttaacacaggttgcttctctgtttttaacactacccacatccaacacaggcagtgcccatcctccaccccaatcacctggataattacattcaaacttcagatattagcttaaataccactttttttttttaaaaaaaaaaaaaggtttttcattgactttcctgtctgagctaggttcctctgttatgcactctcagaggcatctcctacttgtgaaaggtctgtaattaattggtggctaggcatctgttccatatttccatatttatcttttcctttagtttggaagccagatcaggccaggtacaataattgctttgcttggggctatatccctgtataaatatttattgaatgaataaatgaaggtctcggtatagataattatttgggtaattgaatatgttctttcattcacatgcttgagctggcttctccagagtatataacaaaaggatcttatgtagggaaaaggctgtaggaccttgggactgaagtggtcaaagtatacaggttttggatgaagagcaatacctgcttcgaaaagcaaaatttggcatttatgcaaatttaacacatcatatgccagtttatccatagggttggtgagaatatacaagattcctacaagactgatttcactatttttttttctttttaaacaaaactcattgaatgtctatgtgccagataccatgcatggtgccaaatatatagaaataaaatacatcatcattgcttgcagagaacactcagttgagacatagataaaaagaccacacataataatagtgtgataagtatatttgaggtgtgtatagctactgtggaaacaggtatgggggaaagtaatttggcctgagtttcccagaagaaagcacacttaaagtgagtctagaaattatgtagaaaggaagaaaaaggaaattattttaatttttgactgagatctattttatctttctgtg

SEQ ID NO: 24872 - DNA, 1047 bp, Homo sapiens
agactgtgtctcattcatgctctgctattcatgctgtgctattcgtgctgtgctattctttaaggcactcaatgttctcatagcacctgaatttgtatttaccggtcagtattcctttcagatgttaaattacagggaaaaccgtacaatttactaaggtgtcagagaaacattggagaaaatgctccatctaattctgtttaaatctaaccactttccccactctcccagcatggtgtgtctcatctacttaaatgaaatgctgacagaaggtttcaaaccctttctaaaagacatgccgaagcttgtatcttgcagtttctgagttccatttttttcttcattgatctaaacatactttgcgcattgatagaacaaggagagaaaggcttctgtaaaagggaaaaatggatatttcattaagttttccccactttatttcactgtaaataaattatgtgagtttaccaatggaatcccaaaacaacaaaatagtatatggactgttgttgctctctatcaggctattgtttgtgtgtttagttttctttataagaagctctcttaatctatcaagagactgttgtgagaaaaaaacaaataaaacaacaatcttgggaatgaaagctaagttaacggaaaatataattatttcaaagcatactgagcattaatttccctgttaactccctgcggagacaggagcagtcacattgatatattgactacagtaaaataacataggaatactctcctgtttacattataaattggcatcacattctggaaagcattttagcaatgcacatcaagaagctatgaacagttcacagctttgacctattatttctcctccccaggaaacaattgtaaatttagacaaaggtatatgaaaatatattttgattaaagcattgtttccaaatgtgaaaaattaggtctaaacatacagtaataagaaaatagttaataataacccatagaattttcttaaataagaaacaagataattttagaaatatttagtaccatggttgtgtgtttgca

SEQ ID NO: 24873 - DNA, 1025 bp, Homo sapiens
ttccagcttgtcaagacttcttaggatcatttagcaggatcatgatatacacacgatttatgctgggggtcctgtgtttttgctgccctggctagttatgttacaggaatgtgtccacatgaccaatgccttgacagctttggaccctaagactcaattggccttccctatgtagagacactttgcctgtgtccctgcagctcacagctagaagaaatatgtttttcgtgttgttttactcttcatcctttactataataaagcataattgtgagtataacctatcaaaggacatttgattccttttggtgaatcaccaggcttaaggtggtcttgggacccctgaaacacgggaaagtcagattgggaggacaggagtcatgagaagtgtcattttgacaaagacttttagaaagtgagggagtatgccatttggatttcagagagaagacaattctaggaggaaggaattacctatgcaaagacctggaggtgagagcgtgcctggagtgttcaaggaagtgtaagaaggccattgtggatcagaatggatgaagatgaaggaggggaaatgagctcagagatgcagtgggctcagaaaaggacattgagtgcagaggatgatgtcagttagcacatgcttgctgaatgaattgctaaattctcgtctttcctctaaggaggaatatcttcttatgtttcatcagcttatgtatttctatttttggcagagcctttacatattcttcttaacctctttgttctttcctcagtttttaagaatttttgctgagtaggccaggcgcgatggctcacgcctgtaatcccatcactttgggaggccgaggcaggcagatcacgaggtcaggagattgagaccatcttggctaacacggtgaaaccctgtctctactaaaaatacaaaaaattagccgggcgtggtggcaggcacctgtagtcccagctacttgggaggctgaagcaggagaatggtgttaacccgggaggcggagcttgcagtgagc

SEQ ID NO: 24874 - DNA, 1074 bp, Homo sapiens
caatttatataacatttgatttgtgcttgcagtggatggcttacaagcatgccagcctataaaatatgtatggcactgctttgctcatttaatatttgtctttcaggtaatttagtacagttaattcttatatttaattgaaaattttcagtaagccactacttggcctgtttgacggctgaagccattccagatgataagcagtcatgataatgaggactctttctgtggctgccaagaccctccactcttgcctgtctcccctgctgccctctagccctgtggccacctttctttcctgcacctgccaagatcacttctaatttggaggctttggacttgtttattctgcctggaaagttcttgaaggttcttcccatttggctgcagctcagatgtgccctcctcagagaggaggcctttcttgaccgcctaattatgtgccttttctagattatcatgcacttacatttgggtgggggaaaaaactgatgaggagtaaatacatgggggcaaaaaaggatatttgataggaattattatgaaaaaatattgcagacaatatcagaaatatatttactgtgtctttggggcccatatgagtacatggtgctggtagggactttgtaaatatttgttaaatgaatgaacaaatttctagttttgaagccaaagattcaaaagtgtagaccaaaagcaaatagataaaaagtatactttctcccatctatttgtagaaatactgtaattttaacatctgtaatagttttattcttcataaatattctggtatatattataactttgtttggcattgctaatatttcaaaagcaaaagaaaggcactttctgctccctctctccgcccagagtaacagacatctatagatagttcctgatatttaagaaagcgtactgtaaattgtattagtaaatctttaaaaccttaggcaaaacaatataaccaattctgttatctccctttctcctgcttttcaagctttgaagtctagtattatatttaaaatctaagtttatattctttcagttgtatgaataatcaagtatattaac

SEQ ID NO: 24875 - DNA, 1010 bp, Homo sapiens
ttagtaggtgacagagacctcctcttattaacttaaatagaagttggtatttctatataattctgaggtacagtgcagaggatgttgaggaaggaggagtggggaaagcgggtattcaccagtgtgaagggaagcagtgtatggaaagaatgtgtgcaggtgattcttagaccaagtcacagaggatgaggatgagttgggcaggcattgaaaagggacagtgtcagtcagagcaggtgggataggcaagaaggcatgaagccatgaatgtggtttaggagaacaacttgtggattttacagttatagagatgttcctcctttatgtttccatgttcatgaactaaccattagtaattacataaaggagttttagctggattaatagttttagctgaataattttagctggattatcttgcaaaacaaccatcttgtttttctttctttttttccatttctccagacctgatcagcatgtaattggaatcacaaggagtaggttgtgctctcgatttcatatttatatttaatttcagaacatgcaaattaaaaaaatttttaatcacagcattaactatattgggaggagttatgatttggctctgcatcttgtcttatatttgtttatttttcatatataaagaacagatgtgttaaatagttatctacttggtagtaagtaactgtgccagtattaacaatttttatgaataatattgaaaaaataatttttttctgaacatatggaaacttgataatttttctatgcatcattgacttatttaagattatatatttggttatatggtgtggattacttactgatcattgttgataaaaaatttaaatgtgtgctaagaagtttggaaaacgaatttagaatatgtacaagtacaacaaattactatcttatgaaggggacctataattaaaacatatataacataatttagttcgctatattcccttctttttgcttggcttgaccattctgtgagatacatctat

SEQ ID NO: 24876 - DNA, 1030 bp, Homo sapiens
tggatgagaaagcacatgttggcttttgatatttgtcctatctggaatacatgcttcttcaaattgctacagggatcatcttttgtcacgaggagattcagcttgagggcaaaacaaatgccttaaaatggcagaaaaaatataaaaccttgggtacttgatggaatcattgggttcttgactccctactatatttctggatttactgctgtgtgagataatgaatttctttctttttcaaaccaacttgaataaaatatttggctacttaaaatagtatcctaattatagccattattaaatgatatcttaattttgtaaataaaagttttagaagtagtaatttagattattgaagaaactttacagactacttgggttttgtaaattttagatatggttagtgctattagtctataaaaacttattattcaaatcaccatgcattaagtttttaatacagtagataagtcaatcatcttattaactagatttattttaaaatgaataaattatgcaggaggtagaggctagcaaaactaggaataatctaacaagctcagacaatagagaactaaatttaaaattttttgaaatataaattcataatctaatcagttcacaaaattataccactatttattggctgtgtggtatctttagtgtattgaaaacattaaatatacataaagaaatattgaagcaatttcagtgcctggtctgagtaatttaaaacttacagtgtgatgttaagactaattagtaactatttaaatatagaagataaagctgataaaagtaaaattttaaaaaatggtaaactatagttccactcacagaggtataaaaaaatacagacatacagtaaacttttaagtaagagctagtgacaaagattttctccttgaccaaatcctggtcaggctcttgtgcgtcctcttctcaaccaggccttgacttttgggcttctgtgttctgatctgcattgccaaatttagcaagaatcctgctaagtgtctttggccatcct

SEQ ID NO: 24877 - DNA, 1032 bp, Homo sapiens
atttaaaataattcttaagattaggtaagtattttataaaaataaacttatctattttataattagcaagtatactacctaagtacctataaataggtatatccataaaatactgacatgtctatgtaaactcaggtagacatataaagtatgtataacacaagaactatgtttgaaaatattatttgtctttttggtgggcacttttaaatgtcagaaagtgagagtaatcactgattttcctgccaaacagaattaaattacaactctgagaggagaacataaggagtgttattgcagctatccttgaaatgtcagactgcttttaaaatgtgattattttaagccctttgtttacactgtggcatctttatatgtaaaaaaatttaaacacttgggcattctgtgatttatgtctaacttttagtattttgaataaaaggcaatttgcaatagtaaagaaatctttattaccaaaaacagtagactaggagtcagaagtgtggatttctagaatattttgtcaccaacaagccatgtaaatttataatactgaacttctctgggcttcgtattctttgtttgaaaatgaaaaggttcatctggattactggtgtttccacagttccatagatgtctctctctcagctcccccgacaatgggtcaggtatgccaaagatgcctgggtccttcactctgtttcaaccagagccttgagcttttacttgttctttgttagtgctactaagaagatgttttgaaccacaagatcaccagttaaatggtcttaatcttgtgtaggaaaaaaaagtttcaattagttatgtaccaagtttttgttagatttgagagctgccttatgactaaagcactccctacaaaacatatcccgctaatttcacaaccatcttcccaggtaactattctttttgttttctttttctttttgtctctgaagtataattgagccttagcattctttaattatagagtcttaggatcttacagttgagacaggccttagaaataat

SEQ ID NO: 24878 - DNA, 1036 bp, Homo sapiens
atgccaaaattctagattcattatacattgaacttccaagaaaatgatgcaaagtagaggtaaagaagtttgctaattcataaaacaagatgacattgatgaagcacttaaacatatttatatatttataatatatttctactttaaaccattaaataaagtcattttccctattgaagttgatcggtaaggttttggcagaaacatgagctaagtttgtatgcaaaaacttatgataaactataaacctggaaaattcatgggataataaataagtaggtatacaatggcaaagtaacacattctttgagtatttaccatctggcaaatgctttatgaggttctttatatgaattattttaggaaaagacttggtagggataaggaaaacaaatctgtagtagaaaatactaaataaaaaatgaaagctgacatttaccaagtgctcactacatgccaggcactgttctaaattctttatgtgtactaactcgtttatcctcacaacaggttatgatgatcttattttaaccttacgactgaacaaaatgagacacagagttgttagttaacttgcaaggccgctctctgaaaagaatgtcttggtggagccactctactccattttccctgagaaatcattgctgtgtgctgcccataggggcctgagctgaagctacacattgcctctgaggaaacagtgctttggcagagctactccatctacccattgtagtcactgtgccagagctcaggtagcaccgtacatcccagaaaaatgatgccttggctgcctagagcagtcaccgctgcctgtgcatgagctgaagcagtatcctggcccctgggaaaacagtatcttgaatgcccagagtaggtatgcttccctcctccccatgacaggaaatggtgtcttggcctcctagagtggtaatgtaccctagtacccaagctgaagaggtgccctgtatcccagagaaacagtgctttggtcacccagagcagataccaaacccctcctacccctacagagggc

SEQ ID NO: 24879 - DNA, 1042 bp, Homo sapiens
tgcctgtaatcctgcactttgggaggccaagtcggtggattaactgaggtcaggaggtcaagaccagcctggccaacatgatgaaaccccgtctctactaaaaatacaaaaattatctgggtgtggtggcaagtgcctgtaatcccagttacttgagaggctgaggcaggagatccccttgaacccaggaagcagagtttgcagtgagccgaggttgcaccactgcactccagcctgggcaataagagtgagactccatctaaaaaaaaaaataaagaaaagtgtatattatatatgtataatcttccacattgtttaaaaatacaccatttagaaataatatcaagtatacatttatctaattaatatttattgaaaacttatacttatcaagcactgtgattagcaatggcagtgaggatggtaaacattagagaagggaaggcacataaatagttccttgtcacctctaactttcaataaaatatggcaagataagaaatacgttttggtttcttatgtttaagtaggctgtattaagtgacaagaaagaagtaaaataatagggcagtttgtaatggtaacactttcagcttgggaattgaggaacactttcacaaacaaaagaccacttgagttgtgctttttaaggtagagaggaacactgacaggcaaacatttaaatggagagtcaacttggagcaaaggtactgggctggcaaaccatagggatgggatgttcaggaaattggaaagagagattagatatagcagagtagttggaagtgtgttctgtgatttggattcttataactaggcatttgtgtctcattattatatggagaggaacaattgcaggggagccagatgaaccatgctatcctttaagaagttttttttttaaatttttttgttattattatactttaagttttagggtacatgtgcacaatgtgcaggttagttacatatgtatacatgtgccatgctggtgtgctgcacccgttaactcgtcatttagcattaggtatatctcctaatg

SEQ ID NO: 24880 - DNA, 1097 bp, Homo sapiens
cctaaatccagaataattttatcttaagattctgaactgattgcatctacaaagaccatatttccaaacaaggtcacactcagaggttctgggtgaacatgaacttttgtggggcactattgaactaccatagtggggtacattgttctgttggtgttcctagcagggtctgggtaagaggtggagaggagagatgatggtgacgaggctagtgtaacagatggtaaggaaacatgtaagggatttgacattatcctaaatgtagtggagtgccactggagggaattaagcaggtggatgacctaatcagatttgtgttttacaaagatcatattggatacaatgtggagacaaggagtaactaagcaatgctggaagaaaaaagctagctaggatattctatagtaatttaggtttgaaatgatgatgacttggagaaggacatgctgttgggaatgaagaacaataaattcaattctggtatgtttacaaaagtggaatgggctttgtgtgaattagagacaaaggatgctagaggaatcacatgtaatatggcccaggctgctgggttctgagactatgtggatgaaagttctaggctctgaaattggaagagagtggtgtgtttgtgtgtgtgtgtgtgtgtgtgtgtgtgtgtgtgtgtgtgtgtaagagagggagagagagggtaaataatgaatcagttttggatatttcttttagttttggttgctgtgagacttccaagtgagcatgttcaatagccagttgtctagtggcctgtatgagactagtgatgttgaataaacaaatcttagtatgttagtatataaatggtacctgaaattgttagagaattgaaaaaagtatatatgattactatagccaataaaggagtattatgcggaattaaataatgacatatagaaataatttttaatagcatatgaaataactattataaaaagctgagtgaaaagaagaaaactaggacacagctgtatctatagtaagatctcgatactatatatttggctacttttaataataaacactataagtgaatgcacttaaatgtagtggctatttctgggtgc

SEQ ID NO: 24881 - DNA, 1030 bp, Homo sapiens
cttaatgcggtaggcctcattttcaaattgtagcttatggaatagcgacataaaaattaactgaggcatttgcaaaagtaatttctaaggccccaaatttgcccccagaatcagaacctctaactgtggaaatctgtagtaaagatcaatggcataccttcaacttcccatattaaagagcaatggcattcctttaaacttttcaagacgtgaatttaagtcctctcaacaattatcctgtctaatcttctctattattcaccctcaatattcaattacaaacaaagatgtgaagatttactttagttacggcgattctaaaataactactgctaaggtggctgaaaacagaaaaatgaaatggtgaaaagatagtagagggttgattcaagcatataatgggatatatgtagtttgctgggaaacaaggcaattgaaagcaaggtatgaatgagataaattcattaggcaattagcagttacataaagaacaatagaccaaggaagcaataaattacagaaggacaatgcaatcaaaagtgtagcaacaaagtgtagtcttatgtgtcatgaaaataagaataatcctattcctacatcttcttttcaaaattaaaaggatatagagtggtaaatgtccagccggaatagggtatttgtaggccatgcttatgttgaaagtttttttctacaccatatgaattaggtagctgttttggagtgtgtgtacatgtttgtgtgtgtatgtgtaattaatattattttcaatttcttatctgaaggtttggggcttgtcccagcacacattaaaatatataaagctgataatatactttatgtatcattttcgtatgttcttgttattttttatttgaaacgacctatggtatattctaaactctaataatttcactacgttcatataccataatttaccaaattattcttctattattgaacatatggaatgtttcaaattttttgttagttgataatcacgtttaaatatttacaaaatacaaacacaatt

SEQ ID NO: 24882 - DNA, 1030 bp, Homo sapiens
aaaagaaatgatagaatctacaaataaatggagagatactattttcagttcttcatactgatgtatagatttaacacaattcctgtcaaaattatagcaaggttgtttgtagatatagacaagacaagattattctaaactttatatggaaaagcagaggaactggaatcactaaaacaatttcaaaaaaagagcagtgaagtgaaagtaattcatctaccctgtttcaagacttattagatacctttactaatgaagactttagttttggtggagggaaagacaataggtcaatggaagagtgaacatataaattaacacacagaaatatgcccagctaatgtttgtcaatgctgcaaaagcagtgcaataggggaaagaaggttttgttttgttttgttttgttttgttttgttttattttgttttcagacagtgctggtgcaattggactttcataggcaaataaaatgcaccttgacctaaacctcacactctatctaaaaattaactgaaaattcatcatggacttagatataaaaatacaactataaaacatttagaaaaaaaacacatgggaaatcttcaggatgtagggctaggaaaagagttcttagaattgacatccatagcaggatttaaaatgggggaaaatgatatactgaacttttgaaaacatttttctatgtataagtgctttgttccatgtcttaggaaagcattctttttttatcataaagtaaaatatctgtattttgtttagatgctccttatcaaattagggatgaaaagacggggagaaagtattagcaaaccacatatcagacaaataactagtaaaaaatcattcaacactcaacaatatgaaaacaatgaaattagaacatgaacaaaagacaacaagatgcatttcattgaagaggatatacagatggaaagtaagcacgtgaaaagatgtcaaacattggtgtccattagggaaatgcaaattaaaatcaaaataagatattactacagaattatcagacagg

SEQ ID NO: 24883 - DNA, 1414 bp, Homo sapiens
ccaaagtgcagcgattacagtgagcaactgtgcccggcccacccccacaatattctgcatatgagtgtacgacaggtagttgttgaaggtaatgcaagcatgactgaaagagcttttataaattgccttagaagccaaaaaaaaatgagtcctgtggctttgttgacattgatcttatgaatcaaaggaagaaacaggctttaagaggctgtcacactgtgacgcttcggactcatatccatgtaaccagtactgttcttataccttattcattataatgaggtccattgtgtgtttgatttgctaagcccaacaattcattttttaagtacttgtcaactatatattatgtataacatgctgcagtgacaaaaactaagataattttaatattgatcctgccttcgaggagcttacagtctagtgaggaaaaggaatactcagtaacagatttttcttactgtggtcctgtaggaaggagctcataagaagagattacttcccaaactaagaaggacggagaagattgctgagcaaatgacatttgtgctaggcctagatgatattttaagtggggaatatggacagaagacatttcaggtggggaggacagtgtaagcaagaaagacagaagtgatttctgttgaacaggctggtacagttagctagtaagaatggtatatattaagggaggtagtgggaaatgaggttggaaaggacacgtgcagccagttgttggttgttgtttggaccaaagagaatggttttttaattctttaaggggacggcggtaatcagttgtaatttgattgtgtttcttcaataatgttaacctgaaaactgtaaaactctatgatacatgttggtgagtggagaaatgagagctgggtaggctgatgtacataaagtacagtgatggcatagaagagggagttacatagtcagttttaccttcagtagtggttcttgcagcaatggcaagagtttgcctcaccagtaatactgggggatggaatgccaggcaaacaagcttgaaatctgggggccttgaaaactggggggattgagccttctatgtaaagtcagtgtaattgcagcatagggtataagagatggcaggaaaagactctggaagaatagagaccaggggttagaagaccagtgcaggcatccaagcaagaaatcacttttgcccaaactaaggtaatattgaacatggagaaaagagacagggttttagagtgatttcacagtcagtgtcaatggggagatagagttcagttcggggttattaactctaaggtacctgtaaaacaaccaggtggatatagctagtagtaggtagaaattcaggactgaagtttggagaacttggtcaagatttagagattttttttttgtcatctatatataa

SEQ ID NO: 24884 - DNA, 1028 bp, Homo sapiens
aaattctatgcgttcctgcctaaaggatttagacctacctgtcagtgttctgagaaccccctacatgaagtacaactgcctagatatgaagataccaccaccaccaccaccgctatccatacctagcctaaagatgtagagccctctgctggggctgaggaggagctgtggggtgctttctaagtagactttccaccagcccgtctggtttgtctagtcccattttcaccccacatccagagttactattattaccaactcctgagcatttgcaggattctgtagtatgaattgggatgcttcttggctttccctacagccagcttagaattgtgctttctcaggtctactaagttcaataccatccttcagcctgctctccagtttccaacatgttactgttaaggccttttccctcattttctatcattgtgagtatgtgccctttgaaaacccttttgctgtcatttttgtgggatttggtgaagaagcagtggtaaatgcatgtattattctgtcatctaagtgttcactgttagctcttctcataagtgggatgctaggcctcagttgctttctctgtgaaatgagaggatcatactaactggataatttgtaaaattcctttcatcccagactttttatgattctgtagtacttactgttaagtcaaacacagttcttccttttttctgaaataatttctctttgtcttaaatccttaaagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgaggtaagtaattatgaaaaccatgtgaaacagattaaatgcacttaaagcacctgaagttggagttttgacacagtcaatctgtaatttgtatgctgtacaactttaatacccaaactaaataactaacaacaaaccgagtaacttaaccttgtga

SEQ ID NO: 24885 - DNA, 1369 bp, Homo sapiens
gtctgcatgttggtcaggctggtctcgaactcccgacttcaggtgatccgcccgccttggcctcccgaagtgctgggattacaggcatgagccaccgcacccggcctggtgtatatcatatatttttaacaaaaggtataaaccttgtttagtaactgtagtccttggcatgattgctggttatgaacacgaaaatccctgtctggtcttaatgggttacctaacattttgcaagtctaatcactgttttttctcctccagcttttcctgaactgtacccccacacagagactcctgttgaaaatgatctgtatattcacaaactgcccgtttggaaaaccagtacatcatagccccttatcccatctctaattttaaaacaaccccttaagggattttcattgagcatactttgaaaacatctgacttaaggagtttttctttatttcaatagattaaagaacaaaaaattgtggtggatgaactttctaaccttaagaagaatagggtgagttattataggaattctgaataatatgtgggaggtttatttatgttaactatatattaaagttataagaagtatatataagatttaatcatactttaataaaatgtatagtatttcagcatcttttaaaattgcaagtgtctagattctttttttaaatggatagatctcatagctgaagatgtcttttttctatcatatgccattcacattgcctttgcaacaaatgatactagttgtattttggtatcttggagctataatcactaatgatgttttatacctgaatttgatgttttcttttgatataaacgaactttatattgagatgagaagaaacttttcttttaaatgaatgtggataattattgaacaaaaaaggatacattgcttcccctccctccaaaaaatttttacatagattttcctaaatgtgtaacatggttatttaatgccatttccattaatatgttacaaacaagtaagctactgctttgtgtatggttatagtgtcaaattgcattttaacattcaggaagaaatgagtttgagctcttaaaagctttgtaaagattatgtaataactggctggttagatatttctgatattgtcacttatggaatattagaagttgaggcacatacaaaaattagccaggcgtgtgcctgtaatcccagctactcaggaggccgaggcacaagaatcgcttgaacctgggaggcagaggttgcagtgagctgagcacaccactgcactccagcctaggctacagagcaggactccttctcaaaaaaaaaaaaaagaagttgaggcagaattaatacagactttctctagagggcaaattggcaaaaagt

SEQ ID NO: 24886 - DNA, 1033 bp, Homo sapiens
cagcaccttatacagtgcatgacttatagtaaactttcaatacatatagaaattaaatgggtaataatagaatataagggaattggttgggcacagtggctcacacttgtaattctaacacttgaggaggccgaggtaggtggttcgctttagctcaggagttcgagaccaggctctacaaaatatacaaaaattagccaggcatggtggtgcacgcctgtagtcccagatgctcgggaggctgaggtgggaagatcacttgagcccaggaggttgaggctgctgccgtgagccaagatcataccactacactccagcctgggtgacagagaccctgtctcaaaaaaaaaaaaaaaaaaatagaggttaaagctgtggaaacttttgtttcccctcattcccctcatcctccaaatttcatttgatccaattttttattaaattcttttttattatttactttcctatgactgtacatattccttccagctaatttacataatgtgcactttgttttctgaattttttttttaaagggacaagctcttactctgtcacccaggcttgaatgcagtggcatgatctcagctcattgcagcctcagactcctgggctcaagtgatcttcctgcctcagcctcctgagtaactgggactacaggaacttgccaccatgcccagctaatttttttgttttttattttttgtagaatgttgtcccggctgggacatttcctttctttaataactttctttttcttttttttttgcttctggtccttgattcagggaacattatttttcatgatatgaacaatcgtggtttttttttccagtagctaacttctccatgtacttactactaattcagttccagtctttcaaagggaaatattgaattcttcttgataaaaaaatgggatatgaagttccattttttccttagagatgtctctcttgataacttcatcctcttccttttgtcagaactcattgctttaagcccacttcaccttcctttagcacccctccct

SEQ ID NO: 24887 - DNA, 1029 bp, Homo sapiens
ccttctgtatactatgtgtctttccttttgtattttttcctcattctcaaagtaaggattagatatattcagctgctatccgggtcttctggaatagtaaatttaaaatttgtcatttacatgtatactctttcatacaaagaattcttataattgtttagatgtgtctaaggatatgtctttagtaacataactcatattttagaaaaatttagaaaaaatacgagattgtgctgctaatacatttatagaagattcaggatataaagaatattactcaataccagtcatggaatttcatggaaaaaggtacggagctttcactaattactgacattaactacaattttttgcacgttagtagagaacaaagaaaatgacaaaatgcaaaggttaatgtaaacctttacaatggcgattccacaataataaccaccatgaatgacttatggactcaacaaaatattaaatgttatagttattacttcatgtatttgatatagtctgtgtaacaatccttagagcttgtaattagttcttataattaacagagtggttaaataggggtagagatggggatcaaatcccagcctatttgtcttttatgtgttgtggttcttggatttttaaatattggacactgaaatttggaaatatgggaagtagagctcagaggaaacattttaattagaggcaaagatttaaaaacaaataaggaagttttgcttgttggttcgtttgtttgcttttaaggcatgcaagcagttgggaggataggaccaagtctggaactttggagaatagtaactgaggtgggaggattgcttgagcctaggagttcgagaccagactgggcaccagagtaagaccctatctttgtttttgtttgtttgtttatgagacagagtcttgctctgtcacccaggctggagtgcagtggtgcaatcttggctcactgcaacctacacctcctaggttcaagtgattcccctgcctcagcctcctgagtagctaggattacaggcatgc

SEQ ID NO: 24888 - DNA, 1038 bp, Homo sapiens
tatagaaattcagagaacagcaatagatatgactgtcaggtcccagtagaacaatcattctttattccaggatcctcaaacagggaatagtttctttatattacatatatttaaattacatttaataacaaaaaatttctttatcataataatgtttagcattaatagcccctttaaggttaacctcatttaaactttaaaagctatttttgtgattattaaatatgcatggatattttataatcattgaaataaatttagctagaataaaaacagagttgaaaatgaaattggtggccctccataactggaaaggaaaatatagataaattgtcaggggcaggtgtagtggctcactactgtcttgccaacactttgggaggctgaggctggaggatcactttagactaggagttcaagatgagcccgggcagcataacgagaccccctgcccataaaattaaaaaaaaaaaaaacttagccaggcttggtggtacacgcctgtagtcctagctactctgagaggctgaagcaggaagattgcttgagcccaggagtttgaggttacacatatatatgtacatatatatgtaaattgtcaggaatggccaatgcaacaatattggcaataagaagtggtgattttatatttaatgaagtcagctatcttaataagctatgttaaatttttacagacgccaaaacaaaatgttttgctttaaccgtattgaatatccataaattctgtactctatcagtatgattaaaatgttttgatattcagattcttctgttactgaaaatattcaatacataatacataatgaacctaattaaaataagacacaattcaatcacatttaaatgcaataggtaacactatttaaagatgtattactttaagccttttttagtgtggaaaaagtctttgataaattaaaagtttctcatgcgccctctgactgcttgagtttccatttgctgagaattaggtagattttgaagtgtggaaaacatagtactctacttccaatatta

SEQ ID NO: 24889 - DNA, 1063 bp, Homo sapiens
tttagacttggtgatgggctggttatggagaaggaaataagagggaggtgccaaagagtcttccagatttgtggtctgtacaactggctggatcatcatatctctcactgatttaggaagcaataaaagagaaccaggtttggagggaaggatagtagttcaattttgaatacattaagtttgaggggatgtgtgaagatgctttacaagatgtcaaagatatagatctgcaaatcagaagaaatcagatctagagacataatccttggagtcatcaagttgtatatggtaagcaaagccactaagaagagaaaaaggcccaagattgagccttaaagttcatttggatattaggacaatgagaaggttccaaaggagactgccaaggtgtaaccagtagggttggacaaaaattgggagtgtgatatcacaaaagccaagggaagaaattattttaaataggaagaagtggtcaatggtgtaaaatactactgagaaataagtaagatgagaattgaaaaatgacagttggactttagtgagaattcactcactatcatgagaacagcataggggaactgccctcatgatccagttacctctctccctcaacacttggggattacaattcgagatgagatttgggtggggacacagagccaaaccatatcaggtagtaaaggtatgaattgctattatgctttgggagaataatttggcaatatatattaccagtaataatgatgctgttgataattatacagttttacccagtaactctcattattgggaattttttttttttgagatggagtctcgctctattgcccaggctggagtgcagtggcatgatctctgctcactacaacctccgcctcccaggctcaagcgattctcctgcctcagccttccaaatagttaggactacaggcacgcaccaccatgaccagttaaattttttttgtatttttagtagaccccagtttcaccatgttggccaggctggtctcaaactcgtgacctcaggtgatccacccacctcagcttcccaaagtgctgggat

SEQ ID NO: 24890 - DNA, 1058 bp, Homo sapiens
caccactgcactccagcctgggtgatagagccaaaccttgtctcaaaaaaaaaaaaaaaaaaaaaaagggtggtggggagggaatgttttaattgtaagtaaaaatgcaggctgttgttttaaaatacaactatatcaaatacatctataactatctaaatctatcttcataagaaatagtacatgagattatgccaaatgtttgattgtgtttaggtggtaaatctagccagttttgtttatttctatttttctttattttctctaagctttttataaatttgattttataatatgggaaactaatgatatgctgcactttgatattcttatttttcataaggtttatttaacttgttcttaaattcatttgaagatgtgttgaaggctgtatcttctgctgcaattgctgaggttgggcgtgacaataaggaaattcaggatgctatagctatggagggagcgattcctcctctggtggctctttttaaagggaaacaaattagtgtccaaatgaaaggtgcaatggctgtggaatcactggcaagtcacaacgctcttatacagaaagcatttctggaaaaatcgttaactaaatatcttttaaaactcctaaaggtaggaattttatgattactggtcatttttcttagatgatgttttctattttgaattgttaagtgaatagaaaaactaaaccaattctagaataaacattttataaaatatgcattcctaaaatgttcaataaatgttcactgaattaatgaaatatttttaaaaataggcatttcaaatagatgttaaggaacaaggagctgttgcactttgggccttggcaggacaaacactaaaacaacaaaaatatatggcagaacaaattggatacagctttataataaatatgcttttgtcaccatcagctaaaatgcagtatgttggtaagttattttccttattttatttttattttttagagacaggatcttgctctgttgcccagcctggtgtgcagtggcacaattatagctcactgcagcctcaaacccctgggctca

SEQ ID NO: 24891 - DNA, 1065 bp, Homo sapiens
tggagaaaaatatcagcattaaacaataataaactatcccattttgagatgggtaatgggcagatgacatatctatgtaataaaaatttggaaagaaaaaaattactaataattctaatagcatacaaacattactagcatttttgtatattttcttccaacctttcatctaaatatttatttaatataatttcaatcatagtacactattttagaccctgaaatttttattattttgtgcattttactacataactctgaaaaaattattctttgatatccatgtaaaattccatctatgaattactaccatttaaacattttcccactttagtttataatttttaaatgaataaagtttaagatacagttaaacaggatgtttgtcaaggcttttaagcacaattaaagggattttggctggtacaatatagtggattatcagaactttatcaacattagtgtcacgaaagttggtataccacctcccactgctaaatttgactggcttattaaaaaaacaaacaaacaaagggatttcatcaaaggatgaaggaaatccacctatttttctaaaaatagtgatagcagttactgcatttactttctttattgtaagccctcttttaaatccaacaagaagatgcaaaattagacttatgtgccatagaagctatacagctgtcccataaagctaccaaactagtacaagaaatggctgttagtctttcctatcctgcataatttcatactgtcagggctagcataaggcataaagatctgttcatcctaaacacaaggtcaaggtcttgggaaaaaagtaacatattgcaaagtgtaactattactataaaatgagataaaacttaccagtactgcattattttgaggtaacaagtctctctgcttacaaaacagaatagcccgatgtgttcttttcacaagatgacatgccattgtgtgctgtactgtggcagcaatgtctgctgctgaagacaggatttgccccttctcaatacctgcagaaatgagcagctatttttaggcacaatccaggaatattta

SEQ ID NO: 24892 - DNA, 1502 bp, Homo sapiens
tgagcggttgcggccgcgttgccgacctccagcagcagtcggcttctctacgcagaacccgggagtaggagactcagaatcgaatctcttctccctccccttcttgttttcggctttgtgagaaaccttaccatcaaacacaatggccagcaacgttaccaacaagacagatcctcgttccatgaactcccgtgtattcattgggaatctcaacactcttgtggtcaagaaatctgatgtggaggcaatcttttcgaagtatggcaaaattgtgggctgctctgttcataagggctttgccttctttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggattgtgactttcaacgggactattatgataggatgtacagttacccagcacgtgtacctcctcctcctcctattgctcgggctgtagtgccctcgaaacgtcagcgtgtatcaggaaacacttcacaaaggggcataagtggcttcaattctaagagtggacagcggggatcttccaagtctggaaagttgaaaggagatgaccttcaggccattaagagggagctgacccagataaaacaaaaagtggattctttcctggaaaacctggaaaaaattgaaaaggaacagagcaaacaagcagtagagatgaacaatgttaagtcagaagaggagcagagcagcagctccgtgaagaaagatgagactaatgtgaagatggagtctgaggggggtgcagatgactctgctgaggagggggacctactggatgatgatgataatgaagatggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttttccccatccttgtccttcccatgttcattaattaattcatattgccccgcgcctagtcccattttcacttcctttgacgctcctagtagttttgttaagtcttaccctgtaatttttgcttttaattttgatacctctttatgacttaacaataaaaatgatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacacccccacattagtgtgctgtgtggggcagttcaac

SEQ ID NO: 24893 - DNA, 1024 bp, Homo sapiens
ttgttacctttcagttacatgcctttgatcctaaaattctctacttttgttgccttatcagttctttgcaatctgcctgtggttatcagcacttaaagcacaattttgaaggggaaaaaaatgataatcaccttagtcccaaagaaataatttgtcaaactgccttattagtattaaaaacagacacactgaatgaagtagcatgatacgcatatatcctactcagtatcattggccttttatcaaatggggaaactatacttttgtattacatagttttagaaatcgaaagttagagactctttataagtaatgtcaaggaacagtaatttaaaaacaaagttctaacaaatatattgtttgcttaatcacaatgccctcaacttgtatttgaataactaaataggacatgtcttccttggagctgtgggcattagttcagaagcactacctgcatcttaattttcaaaacttaagttttattagcaaatcctcttctctgtaagacttagctatgaagtggtatattttttccaaatatttttctgaaaacatttgttgttgtaactgcacaataaaagtccagttgcaattaactagtgtgagctcttatttaactgaagcaaatgctttctgacagtgtgtactttgaattttttaacaatataaaagacaacattttctgcattgttaacaaatatagagaacaaaaatccatttatacaaataatttcttggatcattcaggtccaatttaggacctttaagagtataaatgtaaatgtatccgatatcatggcatctttattccagatctgttactgaattatttgaaagaaaaatgcttcacataaaacagattaagaactgagaaaacataaagcaataccttctgggctgccatttcctcatctatgagaagggtgcaggacatgatctttaatgtctttttcagttccgttggctttttattcttacaaacctgaagttcacttagtttctaaagagtatgggatgaaggaga

SEQ ID NO: 24894 - DNA, 1028 bp, Homo sapiens
tccaggcttggaaaaaaatatttttggagaagaatccaatgagtttactaatgactggggtaagtataagaatcttaatgtgtctttgtaatttaattatcatatggtattctagtctctagtttataccatgaactaaatgtttggaagccacttactgtaaacaacataatatatttgaatgttaaggttcattcaatttctacctcagaatatcatgccatttaacttaagtagagagatgtggtatcttagaataatttagcaagtccatgtatcattttagatataaatctgtggcatttaagtaacttataactcaagctttgggaaaattgcatggccctttgggaatctaatgtaagttattaatgccccaaagatgcccatctacaaaattatgcagacaatttcagatcctaggtttaaacccatctgtgcgctcttgggggaagtccatggaccttggctaaaagtacagaggtggccatggttctgaaatactgtgtgatcttgagcaaattaactcatcatttctctaagtctcagaacctctgtgaagtacttggattaactaaaagattccttttagtactaagttttttggtttgtttgtttgtttttgagacagagttgctctgttgcccaggctggagtgcagtggcacaatctcggttcactgcaacctccacctcctggattcaagccattctcctgcctcatcctcctgagtggctgggattacaagcatgtgccaccacacctggctaatttttgtatttttagttagagatgggatttcaccatgttggccaggctggtctcaaactcctgacctcaggtaatctgatttctttcagagaaacaatttttttttttagtttgtttggatttaatagtagaagaataaaatagtgaacattaaatactgatcatgtgacaaatacttatatatctagaaacacaattacaaagaaaaaatgagtttctagattaactctgaaaattttttagtctccttcatgcac

SEQ ID NO: 24895 - DNA, 1045 bp, Homo sapiens
tgcatatgtcgaaccatccttgcattccttggatgaattccacttgatcatagtgaatgattttttttttttttgagacagcacctcactttatcacccatactggagtacagtggcacgatcatgggtcactgcagcctcaaccccccaggctcaaatgatcctcccgcctcagcctcctgagtagctgggactacagacgcatgccaccaagcccagataatatattttactttatgtttggtagagatagggtctcactatgttacacaggctccttgagttactcctgtgctcaagcaatcctcctgccttggcctcccaacttgctgggattacaggcatgagccagcatgcatacccagcatgcatgatctttaaatgttgttgaattcagtttgatagtattttgttgagcatttttgggtttgaggtttattagggatattggcctgtagttttcatttttgtgtgtgggtccttatctggttttggtgtcaaggtaatggtggcctcttagaatgagtttagatgtattccctcctcaatttttaaaaagagtttgagtagaattggtattagtttttctttcaatgtttggtagaattcagcagtgaatccattagatcctgggcctttctttgatgggagattttttattatggcttcactctcattattcatcattggtttggtgaggtttttaatttcttcaatcttggcatgttttatgtatccaggaatttttccatttcttctaggttttctgatttgttggtgaatactcattcacattagtctctaatgattccttgtatttctgtggtctcagttgttatgtctccttttcatttctgattttatttatttgggtcttctcttctgaattagtctggctaaaagtttgtcgattttatcttttcaaaaaaacaatttcattttatatatatgtgtatatatatatatatttggtctccattttatttagttctgctctgatatttactacttctgttcttctactaatttggggtttggtttgttc

SEQ ID NO: 24896 - DNA, 1050 bp, Homo sapiens
aaatcgtaagatctagattgcttaagcactctcagtctttgtagcagaccttttgcactcacaacttgtgggttgggcaagacctacccacgtgtttcccagtaaatagctgttgctgttttgggcttccctcattctcaagtctgtcaaagtctgtcaagtttcattgcttccccccttgcttcctcctgctcagatgctgatataattcaggtcttgtggctgtttggtggttcgtcttcattcatcagtgtggatgcctggtaactagtcattataaatattgtctctgagttttttattttgttaagtagttactctgtttttatgttgagatttggattttaaaatatactgctgccactgtcatcttcccagaacccactgaatagattaaaaatattctcttctttggctggtcaaggtggctcctgctgtaatcccagtgctttgggaggctaaggcaggaggccaggagttcaagacaagcctgggtaacataccaagaccccatctctaccagtgaaagaaaaatagccaggagtggtggcacacacctataatcccagctacttgggaggctgaggcagaaagattgcttgattccaggagttcgaggctacagtgagctatgatcccaccactgcactccagcttgggcaatagagtgagaacctatctcaaaaaaaaaaaaattctctttgctacgtagaatccccattttcacaagaatcagaaatggtaaattggtattaactttctaagctttgataatgtaattgtaacttcaacagtttagggaatgtgttctcaatgttataaaatcctctaagaattgtatagcagtgtatttttttcagtctactgctggtatggttaaagagagaaaatatctgtgtcctagaaccagttaaaaaaaattaagtgttccaagtattaatggaaaccaaatttacacaaaactttggtacaaagcagttcgtaagcagaatattataaaaataacaatttcttttttttttttgtgaggggttttcctggaaaagctgc

SEQ ID NO: 24897 - DNA, 1039 bp, Homo sapiens
tctgttgtttaagccgctcgctttgtggtgccttgttatggccaccctaggaaactaatgctgtgtaacaatgtggcaatggcaggcctacgttggtcttgactcaaagctcctggaagggtgctggtttgatggtgctaagaaatgtgtactgtccaaatccaaacatctggaatgaaacctatgtaagttgataatagacatatacatataaggaaataaaaatataatttccgagcaactccatgaaaataatgattgctgaaactacttgttatgatacttaacgcaaatgataaaaacctgtggtcactgttgggcttcttatatgccaaagaatctgtttctccaggtaccagggcaatcccaggagctaagcactccaggccatctccttctataactcagctcaaccaatgtttactaacctgaccaagtactaagaattctaagcaacggcagtagaaataaaaaaaatcagacacaatccctgccattaagtagcttgctgcatagtaaataataagaaaggtagaattttggaagaatctttcacttattagcctatagggaattccatccacttacaccgaggactgttgaagactcttagttacaggtgatggaaatacaactcaagctggctaaaatgaacacacagataaaaccctgactaatttgaggatgaaaatatgattttattaatgtattagtcagggttctctggagaaatagaaccagtaggagacagtgagggaaggagagactgagatagggagatgggagagaggcggagaaggaaggagaaatagacataaagaaagatatttattttaaggaatttgctcatatgatcgtgggggcaatttgtagggcaggctggcaggccggaaattcaggtaagagttaacgttacagtcatgactccaaattctgcagggcatcaggctggaaacgcaggcagcatttctgtattgcagactggaggagaattccttcttctttgggaaatatcagtctttgtacttaacgccttcaa

SEQ ID NO: 24898 - DNA, 1119 bp, Homo sapiens
gctgtcagtggccaaattaattgtctcagaacaaattaatataaattacagttataaatttggggaggaggatgttaaatatctatatcataccatgtaccataacacattctagatggtttaaatacttaggtgggaaaagtaaaacgattagactaaattatggaacatttatatattattagagtaggaagagattttctttgcctgtcacccaaggcatagaaactgtatggctaatgacaaacttaaaaaaaaatcccattacatatgatgaagagttaatgctgttaataaagaattcctgaagttctaagaacatgaaacattgtaatgagtcaaagatgtaagaaaaacctttagtttcatagtcaaagggatgcaaattacaaccaaatgctgttttagaaatataaaattggtaaagttttaaaaagataataactagtgttggtcaagattgtaggaaatggactcatcatgtaattattgacagcattatgatttagagaaacttttctgagggtagttaggtggaatgtataaatttcttaaaattttagtataccctgtgacctaactggtctatttgtaggaatttattgcaaagaaataattggatatgtgtgcaaaggtacacatttaagaatctcttatgcagcttttttttaaatagtctatggaaaactggaggtagtttgatgtccagagtgaaggtagtttaaataatatatggttgttttctacaatggaatattgtatgtgtgggtagtaaaagtgatattataaaggatttttcaattcattcgtcagtcaacagatatatattgaacttccagcccatgccagatgctaatgtaaacaagccacgtctctgccttaatacatcggtagaaatgaaaaatatagcatatgtaactgaaaaaagtagattacaaatttgtatgtacatatatacttaatgtttatatgtacactgaaatattggaataatgtatattagaatattgtcattctggatggaatgattgcatgctatttatttttgttttcaaaaattttaagtaagaaaaattattctaaataaagatgagatgcctgggtagggagaaagggtga

SEQ ID NO: 24899 - DNA, 1026 bp, Homo sapiens
aagaaataaccatgagaaaattaaattaacattttgtaaaaggcttagaacaatatttggcgtgtgttaaatgacacataactatttattaaataaatgagaaaacattgcttcttcattattgtaaagcctgttaaagagattggccttggaatttcaggcttgcacatgaaggtttttaatttttttagtttccacaaaaatgtttatcttgagaaattgctatacatctgtcttatatgaaactatgtgagttgcactgtttaccttttgctctgctgataaataagttcagagtaaatttaatgcttaaccacaccaatttcatcagttcacatggctgggatatctgcgtttcctcctttccttggtcctgagtttatattttatttactttatattctggaaggaggcgtgatataagcaagttactttacctttttttcacaaactctttgaactaatgtcactttagactatgctgtttccatcacgcaactttagtgtggtttaggatacgaacgtcttaatatcacatagaaaaatttaatgatctttgctcagttttgtctttagtgatcttatttaattttgttatggttcattctgttatcttgaaaaccaactttgcttgcctctcttcgttttcaaaattgttctctcttctttcctagttctttttgaatttcctcactgggtaaaaaccctgaggctgaggcctttgtccctttcccacttgtctgccttctcaacagcgtatcccttctttcagctttgactctcatctttgtgtaggtaatacttcacctcttaatccaaagctctgttcttaaatttgtcgccacatattcaatgacttcaaattttaagtctgtaccctgatattcattcttttctccaattcaacctattttgcgtactgttatgagagtaattttagagttttaatttgaaaatagcactctcttccagaaaaccagcaggatctggaatgagcattatattaaagtcacaaactatgttatg

SEQ ID NO: 24900 - DNA, 1187 bp, Homo sapiens
gggatttataaacatcatttgtttgaagaacttggtacatattaggttctataatacaccgggctaagagtattctttctttaaatctgttctaagcaaatttagccaccgatgtttccagtttacagtacttggagattgcattcagtttgagtagagcacatcctttgtcctgtcattgcttatattgatccccaattcatctgcatgacttgcacgctttctcagcatggtctctagttcttttccacaaggtgatttaggtgacatcataaaatgagagggcttcagacagacctgtgttcctcacatttacatacctgcattgtctgctcctctcctctcttcagacatattgatacataggcttttggctattttcattttcttcaaaacagtaaagaactaaaggcaactttggcgattaaagccttgatttggttgaatgagaatttttactttgatgttcctgtatttgcatatatttattatttatcttcattaatgtgtttctattagtttgattacttaaagatttaatggacatgtgtgtaatggatcccaaagaatcaaatagtattttaaactactactatttaagtagaaactagtataaaactgtaaatactactataagacattggctttttccagacatggatccaaaaaatttctgcatctactttgaaagtttgttatgtatggttgtatttacttttgttttatcttcttttgggggttgggtgatttgttctagatgtctcctggagtatgaagtcatctgaaggtataagtatttaactgtggttctctgaagtttcctggcatgctgtgaagcactgctgacagcttgggtttcttatcttttcacgaggaggttcttgtttctgttaacttagctgaccttaaagtgtagactttaggtccgtgttgcagttggtattaggaattttgacttccagaacctgctttttaagagacagaaaaacatcatttctaaatttatttgtgtctttgcggtaaggattatttttcgtgttcatgaactgtctgcacaatattctgattaaagtgctttctgtgggcattattttgttgtatctgtgaatgaagttgttagagtaatggttggtagatctgttgataatcagtaggggaactgctttggaattttaagtggaagcagt

SEQ ID NO: 24901 - DNA, 1854 bp, Homo sapiens
aattcttttaaaggtactgattaaaatagttaaatggtagtaggttaataatttaaatttgttcagcagctctcatttttgcatttataacttcttgaaaaatgaggaagtgcatttgatttgttgtagatataaatactggtttaagatcaggaattctatttttctttcctctgagaaaggtgttctttgatgtacatctcttgcaactctgatacttggaagttggattttagaagctatttgaaacattaaaaatattaaaataatggtaatacttttgagattaatattgaaactatctgaaaatgattgcttattgaagtaaatatttcttagctctggggtgtcaatactatataagttatggaaattaggactgtaatttttttaatgttgtaatagggggatccttatgactgaaacaatagtcatttctattaggattttatttttaaactgttaattttatattgaacaaatgagtatatattattctgaattcttattaatagttaaactgtgaaacctggcttttagctttaatttggtttcatctagaacaacttgaattaaaatattgacatttaaaaatttctcatttattacagactaaacaagaaatactgagagtatcttactcttaagatttattatcgttggtattatggcttaacaccgtgtttagcaagtcttcctttgttaattaaatattaattaaatattctattactgcattacagagacttaagaagctcagaatatacaattggctgtaatccatttgcaaaacgttttaaaggctacgttaatatactgattttctggcttaaattctttttagcaaaaagcagaatacagttcaaattattagatttcagaatatcatgctctcccatccacttggtttactatatttttaaaatacttttttaacagtgaaacatttttattctgcattatatttacatatcttacattaaatagcatattgtaatataacatttttggtgactcaaataatataaaattaattattacactacttcatatgaaattttatttcaaattagagattatttttacaagcatatcaacagacatttcatttaagacataaattaatctgactaaacaaagttgatataattaaggaaaatatgttataatgcaaaatgtttaatttttgaatgaaatgctagtaatagttatataagaactaagagatgtatttctgagattacttggtaaataaacaagatctcaaccttggcagtctgaattttgttaaccagatgtcgtcatgctgaatgttaccaactctgattgagtaagaagcttgtttcagatggtcttaatacttaaacctggtggaacgccttgtcttaatttgtgacacaattttaggcacatccagattaatctcttacacgttcaacagcttacaagcaactacttgaaagactgctagaaggaaagataatgtagaaagcataatttatagaatttagttgtataaaatgataaatttatctattatttaaatagtgtcctaattattactgttattaccaagttctgatatttgaaatgtacccagtttattaattatctttttacattctacagatgtgttcagagcaacattgttttgttgacacaagcatttagaagaaagtttgtgattcctgactttatgtcttttacctcacacattgatgagttatatgaaagtgctaaaaagcagtctggaggaaaggtaatgcttttgatgtacatattttcataaccgaatcacttaataaattcagcttaatttgaggtctagagagtaaattgtgtagttgtgttttg

SEQ ID NO: 24902 - DNA, 1046 bp, Homo sapiens
aaaaagatggatagttgtggctgtagtaaacatgtacagacattttttccttgtcattattccctaaataatacagtacacctatttatatggcatttacattgtatttggtattataagtaatctagagatgatttaaaacacatgggaagatgtgtgtaggttatatgcaaatgctatatcattgtatataagggacttgagtgtccatggagtttggtatcacagggattcctggaatccacctcccacagatatcaaaggatgactgtacttaaatttattctgtaattttgacataaacttgtggttgaattatgggaaaatttttgttggaattgttaacatgtaaaaagaataattccaactatgcagttacatttttttcccagttgatgttattttttaaaaatctccttttaaataggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatggtaagaattacataaacattggttgaaaaaagaaatgtctcattttcctatgtaaatctaagtcgttttaaacattttttgattaaaattaaaagtatttgtcatgtgatttctatataatccattgagagagtttcatcacctacttttaaaaatgattattttaggcatctcataccactgggaagtgggctagggagaacatgaacttctctcttcataaccacctttagggaaatatagcgaaatctcaaaatacatgagatttgctttaaaataatttagttaaggcagctgggagtgctgggtatgattattactatatgttggtaattattgcagctaaatgataggtgcatgggtgtttgtatattattctatctattatattgtatatagtagttgaaagttttattgtggccctggttgagatagtgaggattattatttttcag

SEQ ID NO: 24903 - DNA, 1061 bp, Homo sapiens
gccttgtaaatgcattactgtggataaggtaccctggttacatgaaggatatttgagtataaatgatacccttggcccagttcacaaaatttcatctaacttgtatactagaaagcctttcttaacttttaagagttttatatctgtgagaaaaagcttttaaaatagaaggctggtatcttaagaatctatatgtttacttgttacttcaaggcaaattctttgaaagtattggcccatttaattcttataactctaatgaagtagatgttatagccaagtgtttttaaaatgtaactaattgtaataggatatggagaaagctgtcagtttgagctgaaagaaacttgaaaatgcgattatttgcaaggcacagtcctagctttaggtagcttactttgtagtgtgggatatgcaaaagtaaatgggtccttataagaaaattcaataaatgctgtgatgagagaaaagcctcattaataattgcttagatttgaacaagtaacttaaagtagaaataaggaaacacatactataatgtatgtgttaatgcttgatgacaaaaacaccaaaagtgtttcttcccagaaaaatatccacataccataattttacataaactttcaggtgttcactactcttcgaggctgatccatgggtcctagtttaagaacttttaaactgaagagagattaacatacactacgcatagtctcaaaagggcttatgtaaataattaatagaagacttccttcactgcacacagttaaaaatctttcatttaatgattcatgggtttaacagactacaccgaaatgctgcatgtgggaattgcatgtctggttatcatatcacactatcatttcattagtttcacttgccatgtttagtcatgagtcataaactatacattgagctgcattttagtatgagtgattataaacaaagttaaaagatacatacaacataagtgtggttcagtgttcaacagtgcaaaaatttaattgagtcatcttgtacctacaaatttgatcagtgattttcataaaaatttaaattta

SEQ ID NO: 24904 - DNA, 1026 bp, Homo sapiens
aaaaataatacagtatctaataatgcttgtacagtgatcttcaaactgggataaatatatctttggattccatacttggaattctttccaaggaataaaggggcattgacagttttaagataagtcagtttcaaaatctgtttctagatgcgccttttaaaaaattaatctgcctttagtccaggtgtcctcctattttccaaaagaaagacatagtctcatgtctttcaaattttagtacagtgcactgcttcacattgtaaaaacctcagcccaccagcaaaagaggacattttgaaatattagagtcagtgttattaagggtgtgaaccattgtaataactggtaataagtcctgttatatactaggttgtttccagttctttggtttcagcaaaatcgaaagggaatcttaagttgtcagtcaataggagcattagcataatttttgaggctagagtactgtatgacttttggcatgtaatgagctggaggcatataaagaactgagtaacattgctataataaaacttttaaaatttcaatctacttgtctattataagcaattcacacctctgtaaaaattaaaaatcggaagagaattagtcctgagttcattctagcaatagaagatatccactgatatatgaactaaaaatcaattactgtttcaaatgggaaagaaaaatactcaaaaggaaaatcttacaaattagtatgggaaattattagcaaataaatatttttcctttaattttttattgtgaaaaaattcaaacatacaaaatacacgagtatgaccagctctcatttatgcatgcctagcttttatttttgttaacatctgtttctccacccagctcaccccactactccataatgataaagataatggattttttatcatttttagttttgattttgcattgggggtggtttactctcttttgtatatgtaggcatgtgcttttcctaagagctttgcaaataaactttttactgtaactttttcagaattaatatga

SEQ ID NO: 24905 - DNA, 1049 bp, Homo sapiens
tatgaactgtgtttcttaaatagtaagacttgaaagttgaagttactccttgatccatgggctgcagaatggatgttgtgttagcaggcatgaaaacaacattatgctccttgtacgtctctatcagaactcttgggtgactggtgtgttgttagtgaacagtagtattttgaaagaaatattttttttttttctggctggtcatggtggctcacacctgtaatctcagcactttgggaggttgaggtaagaggattgcttgagcccaggagttcaaaccagtctgctcaatatagtgagactcccatctctattaaaaaacaaaatctttttgagccgtaggtttcaacagtgggcttaaaatattcaataaacaaggttgtaaaccgatgtggtcttatctaggcttgttataagcccaggcagggtagatttagcataattcttaaggactctagggtttttggaatgatgaatgagcattggcttcaacttaaggttacaagctgccttagcccctaacaggtcaggctgtcctctgaaaccagacattaacttcttttggctatgaaagtcatagatgtcatctttcaataaaaggctgtttcatctacatttaaaacctgttgttagtgtagtcaccttcatcactgaagttaggtagatcttctgggtaacttgctgcaccttctgcatcagcccttgccattgtttcaccttgtacttttatgttatggagacggcttctttccttaaacctcatgaatcaacctctgctagctgcaaacccttttccgcagcttcctcaattccctcagcctttatagaattgaagagagttagggccttgttctgaattaggccttggcctaagggaaattgtagctagtttcattttttttttatctagaccacacaaattttctccatgttaccggttatgctgttttgttttccatcatttgcgtgttcattgaagttccatttttaatttccttcaagaacttcaagaaatgcaaaggaaacttcatttacaacttggctaactt

SEQ ID NO: 24906 - DNA, 1694 bp, Homo sapiens
cagaatgaagttcaacataacttgtttattttacattgattgtttaaccagtaattatccatatgacatcccaatgcaaatgctgacatccatttccaaaagagttgtttttttgtgctttttctaaggttacaaaggtttttgtggtttaaatgttgttacatattttacagcattaggatctatggaatattttgacaactgcaacagttcaatgaagttggtaatttcttcttttaattatttttcattgaacagctttggagttacatttctacattttgatttctggtatattataaggaaagaaaaaattatgtcaaaggatactttagagaaaatacatagatagtgattacaatatggctgtaattaaattatccttaatcttgttgaagttttgttagtgcctaattttgatgaaatagtatggtgttccttccagctactgattgtatatatgtgattgcacatctttcttaaaaaagtggatttgtaggttttcacatattgtcagccacactctaatcctcttgtaaagaatgaacctggctttattcaattaaataattctctggtacaggttttcctcccataatattttaaagtacaatgttttgggttttttgagggtaaagtaaaagaaaatatgttttaaaaactttagttgtcaaattattttattttaagcctattttagaaattagagatgtattgtttcttttgggtgcatatcaccaattaatacgtttgatttcagatctacaacttactgctttgtaaacttcgccgaggtaaaatgaaaccatttggctacttgaactgatctacattacatagatttttcctattgacatttgcagtagataacatgtcagaaatgaaagtgatgaaacaatacatcttccatattctgaattggcataatgctaaatacaacagaagctaattttttagagactgtgaaatataattttttttagttcaagtatattatagcaagtgagagctattaagaatagagctttctctgcagtagtaaaatgcaaccagaatgtttgcatatactggaattaaaagattagttttgcaacataattcatttttctaactctgatattagtttaaggatttaataaaatataagtagattgttcttaattgaaatattttatatatacttaattcttttcgaagggtgaaactttattttaagtttttttaaatataagattaaataaataacacattttagcaaattatgtgctgtcatgaaagataagggaattcatggtaacttgtatttaaaattctgtaactttgggttgggtaaagatatacttaaaataaagcattccctttgtaattctaatgcattctcaacatatgggtattaaataacatgaaaaaaagtttatataaatgttaaattactttagaactatttcctagatttaaaaatactaatgcagtatattataatagtagctttgaaattttgatattggcttgaaacttaactgtagtggtacctatattaacgtatttatgtctcttatttttttgcagcaaggagtaaataatgctgaaaaatttgactatgtaagtgcaacatgtcattcagttttcatgccacattctctatatatttgttttttgattactaatattccctacttttggtttctaggtca

SEQ ID NO: 24907 - DNA, 1050 bp, Homo sapiens
cagtgcctaggcctcaccctgaaatctattagtccattgagtcctgcaagatccattttgtgtttcccactctcagtgaaagttccatgattatgtcaagttccctgattatgtcaattaaaatggactcttattgtacttttgggtagccagaggattctgcagtttttcagtgtattttaatggtagaagatttgagaattttaaaattagcatttttgtttacaaaatatgaagactagaaaggacctgaattcgtttcagtcattttatagccaagaaaatgaagattgaaagaattaccacttaaatgacttgtccaaagtcacacaaatagcctattgacagaattgattggaactctgtagtcctgaatcttagttcagtgttctttatgctgtacattgctatgcaaatgaaattatgaacaatcacacttttaaagaaagtacatagagcaaatgtttttttttcttcttccaggtttcagtctgaaagagaaagtggagatcgaaattttgcaataggatattacttaaaagaaaagaaggtttttaaatttttgtttctatttcaaattattctttcatttaataaaatacatgaagatgtatgctaagaattcaacaatagcctttaagcaactacctattactatttaaggtgcagaagtttttgcagagtgctcgtgagtcagtgttatcaaattgttaatgttattgttaatttgatttgtatctggcagcatttaaatatttgactcatattatttattaatacaaattttgtttgaggtttagtctattttttcaaaagcatgatgcctgattactgttaactactcttgatttttttaagtggctggtctagtaacttgatttataaatcatgaatcattttatcattgtcagttaaactagtatctagaaacttacatgatgtgataaaattttgcttttttatttcatgtttatactcttttagaagttacatgctattttattaattaaaatgaaacacttgtgtacatttgaaatttttcatatattt

SEQ ID NO: 24908 - DNA, 1263 bp, Homo sapiens
ttaattgggttgggggaagttcttttattttataccccaacctccagctagtagtttattaatctgaataccataaaatgcacatgactttgagaaatttagaaaactactctaagaggatctgaggcaatatttatccaacatgaaacagcgggcaaaatgtgatgtttcgtagagttcttaactttttaaatagtaatagaaaaggtacttatttttaaaatagtatgttaagtagactgattataaatgcttatttaacaaagtgattctgttactatggtcttaaaatgttttctattttatgaacataggagaggaagagaatttaagttgactttgtttgccatttctattttgtagattgtagatctactttagtaatttttgtaagttgtagctaatagagattttttaaatatgccatgtatagaaaacctgttttcataaaaaactttataatggcttcctgatccattaacccttaaccaaaatgaataggatactaattagcacttggattgcattgcttttttggcggaatctgtgggtttttttttttttttttgtaaatttcattcaccagtaaattacagaatacttattattgaaaaccatcatgtattgctttaaaacaaaagttataatcttgccctcaaaaggcaagcgttagaaacaggtgagctggtgccaactgcttctgtcggttaatcttgtaacatttttactatacatttaactctaaatctcatttactaattatggaatttttttaaagaaaaattatataccacatctcaatggcaaagaataattcattgtatttatttttaagccatatttcaatatctgaggatatgatttttctgtacatagtatgattaaaaataatggtattttttcattaggtatttaccttgctgaaacactttcaggccttaaaaccacagataattaaaattatctatttggaaggcttagcttttgaaagaaaaaattcttacccaaagtagtttttaaatttctattttcatattatgtttctggtgatttatgtttatataatgaaaatctcctctgcacagcaattatatttggaatcctgagctataattaaatttatattctgtaaaacagccgaaggctttcttttgtttttaaaacatagtccaacctttctagaattttgatgtacttttatttaccataatcttatatattttttagaatcacagatttgaatttgaaagtaatcttaaatgt

SEQ ID NO: 24909 - DNA, 1079 bp, Homo sapiens
tggtctttttttctaccaagtaagaactaaaaaagattaccatccccctcagcatttcactagtttttgttcaaacagcacacaaacagaattatttcaagatatttagctaattaaatttgattgtgcaattcagatctatataaattaaccttagcattattcctgtgctttattattcactgataggttcttattcaactaatgtttatttcttgcctaatatgtgccagaaaccgtgaagtgtttaggatatgcagtgagtggttaatgagacaagtatgatccaacttgtgtttgcaattaagcagggatacaggtactgaataaatactgaaaataattaaaatggtaataagtgatttgttaatactgatgcatgtagatctaattcattttaaatgttacaaaataagttacaaaatggtatatgccatatgatgctatttttgtacatctataataaactttatgagacacaaatatgcaatgtagttactaataaaactataagaacatgaacaccaatctttagataaagcttactgccaggagggaatggaatggatgcagagagcatggttagctgtatctttaatgtttcatttctttaaaaaatatttcagcaaatataatgataatgatagaaaagtaaaaaaatgctaggagagggtacaataagaacttgttttgtctgggtggttaaatatggttggttttcactggaaggtaatacagtgtgtaagttttgaaggagtcagaggaaatatggaatagtgttaataggctagtctgacttgaaggccccagaacaggaaggagtttagcacatttgagaaggggaaagaagaaggcaaatgcgctgaagaagagtgaggtgaggtggatggagattggctgtggatgactcctaagagatggggccatattatgtagagtgggccttctcatatttcgatgtacatcagaattgttagagtgtcttaattttaaaatacagctagcttcctggggcccattcctacagttggattcaaaaatctaaatgtttaatgtgcaccccaggtgcttctgctgta

SEQ ID NO: 24910 - DNA, 1141 bp, Homo sapiens
atttttctttagccacagtataataggtagtatgcctcaatttgaccttaagaaaatataaaagcaggctgaaagcttattttcatttaaagactataatctgccaagttggagtgaagcctttaaaacaaaattggatctggagtcatgatggtttatttaacagttgaagaaaagtatctattccatgacaacagatactgtactgagctggaaatgagagcagcttatctcaaactagaggtggtagaaacagaaggatgttttttcagttacctgcttttttttttcattatagcagttccaaacaggctgaattcatgtttatatgaagacagaaactaaagatgaaaaacagaggaaattttggtttggcagttggtaatggagttagaaattaaatagttgaagtaaagtgtaaaaccagtgaaccaatttttcctccgtctctccctccctccatcttctccctttcttccttttctcccctcccgctttggtcccatctaggcttccttccaatattgagtaaagaacttttatggattagagctaaattgatatttaatccgttggtttccttctgtgctttggataacaatctgagatctattaaggactcacatcatcatggtctagttgtacagaattgggaatccagatacctgagttctactcaagctccatcactaattcatatgctgtgtgaccttgagccagggtccttaatctcagtggtagtaataaataaaatatatctatcaacatattttataaccagcctgtcagggatttttaaaaacaactataactgtttaaaatgttgaatgttttagggtcatccactatataaatacagagtaatgtgagtatataattctaataattgctacttactcataagtacagaattattagggcatttacagaagtcacacaactcaacctttaaacaagctcaaactgagtaggataatgataggattaaagacttaggaatgccatgttttagatgtgtaaaactgatacactccccacctgcttctagctgttttggaaaaaagtgagatttgctatgccaagcatgccagtgttaagtgaactcatgtgaactgtaacattttttgtcccactgttgtca

SEQ ID NO: 24911 - DNA, 1051 bp, Homo sapiens
atgattagaagtatgtggagaggttttggagggtggaagaaggaccagaagcagaggcatcagttaatgattgaataaatcttgtaatgatattcaaagatgtaaaagttaaggtagatgggctgggcacaggggctcacacctgtaatccctacactttgggaggctgaggcaggcagatcgcttgaggtcgggagtttgggaccagcctggccaacctagtgaaaccccgtctctaccaaaaactacaaaaattagattagtggtggcacatgcctgtaatcccagctactccagaggctgaggtgggagaatcacttgaacccgagaggcgaaggttgtatgagccgagatcttgccactgcactccagcctgggtgacagagcgagaccttgtctcaaaaaaaataaaatgcagggttgggggccgatagaggaattaattttgcaatttaatacccaaaattgaatatttgatgccttgagggagaatattcacttagtcaatagatatttaatgagcacctattatgtgtgatagacactgagtttacggtggggaacagaaagacaagtggtctctgcccacatggagcctatatttaatgagagagacaaaaaacaagtatatataaaaatatatatactttatatatagttatatataacaaatatagttaaaaaggatatagttaacaatacaatatatatatatatatgaaggggaaaagcaaggtaagggataaggagtgatgaaaagaggggagtgttttagagtcttgagagaacatttgaatggagacctacccaaagggagggggagagggagcctcctgacagcctggggaaagagcatctctagcagccagttgtaggccttgagtgcctgagaccagccagatgttctgaatggagtagagctggaaagggaagagtggtaggaatgatatgtgcagtgtaaccaggaatagagcctttagggtcctgaaagccatggtaaagagtttgattttcctttagatatgatggaaaggcacgggagttccttgat

SEQ ID NO: 24912 - DNA, 1030 bp, Homo sapiens
tctcttgagtatctgtaattacatgatctcttaaaaacctcttatccatgtactgaaattcatcttgaattgtttatttttatcctgcattcacacaattcacactttaaagatagaacttgattatattggtatttttatttcaaattttcaatttttggaatggcagaatgttgctattgaaaagtgtcttaaaggtcaccactgtaaccccttcattgtgcttgagacctgctcagctcctaaatttaacaggggacggatctgagaaactgactccaagttgtaacctcttgcttagttttctttctagggagatatccgtctctccaaacctgtcgaaatctaaatttattacctcttacctaatacttggtcccctgtggacttcacttcactgtttgtgctaatagccttttcatcaccatcttgactttggattctagagcatcacctacttccccattttctgtgacccttacattcctcctgtcagtcactatgtctgatttattgttctcccctatcttttgccctttgcaaatcctcaagccctcattctggttcagacctttaaaaggctgagttactggagtatagtgttacccaaagtgagttgttccataaaaaattagtaagttggaaaaaaaaacaaaaaacaaaaaaataccctacccataaagttggtaaatgttcctgtaaaaagggttccttggccaggtacatgttagaatagctggttaagtttctttgcagaaagacttctcctggccttcatttgtgactgtgtactgtgaattcccaagagaaagatacagtattcacttgtcccaacttatgtcaccattgtaccacgttttggggggatcatttcgtagataacactgctatagtcacttcactgtagctttttaggttctgtcactgcctggcttcctgtgggaatgtgcattccatgtgagccgtacttggttcactctcaactgtgtcttgtgcttttaccttgttgttctggatcgttccttccccc

SEQ ID NO: 24913 - DNA, 1034 bp, Homo sapiens
aaggttcacccgcatgatagctgttccctggatctctatgagctccatgctctgctgcccacagccacctgactgtggtgtctgtgtcctgctggcagatctttggaagctttgtttgggctggtgtatacccaccactcagttagctgtggtctggctgaaggtgctgtggcaggccttggcatctttgtgtgtgtgtaagtggggactgtgcaggggagagattggactaaggagaaaggctgtggaatcatgtgttctctgctaaggaatttcttttttaacttggtaaaatatacataacataaaatctaccattttaaccttttttaagtgtacagtttagtcacattaagtgcactcccactgctgtgccgccatcaccactatctctagagatttttcattatcccaaactaaaactgtagccgttaaatagcacctcctcattactctctcctcccagcccctggtaaccaccattctttttgtctctatgaatttgacttttctgtgtaccttatataagtgggatcgtatatttctactcttgggactggcttatttcacataacttagtgccctcaaggttcgttgatgtagcatgtatcaggatttccttcctttttaaggctgagtaatgttccattttgtgtatgtaccatattttgtttatccattcatccattgatggacacttgggttacttataccctttggctgttgtgaatgatgctgctatgaacatgggtgtaccaacatctgtttgagtgccttctttcacttcttttaggtatatacccagaggtggaatttctcggttacgtagggagtctgtgtttaatttgttggaggctctgctaaagaatcataatgctggctgaaaggcactggagagttattgaagggtttgaagcaggttatgcctaatcagattgtgatttgaaaaagtaacttgggtggtgtgggctggggaaaaggaaagggctggcaaggctgtggtggcgagacaaggcagagagaccccttagaaa

SEQ ID NO: 24914 - DNA, 1043 bp, Homo sapiens
accaccctatttctctggtagaactctagtagtaaaatggagttcattcttcttttttatagttttctcttgttatttttctgcttgacaatttgttctattggtttcagtgcccaaatcaccacttgaaatcctcttctccttgtcatcttccctggatttagtccttctggggatcctgttgccctttatcagaagctggaaaatggacagcgcttcccagggcttgtcaccctttcctctggtagtgccattgtgtttacagcacatagaattaggtgctgcttcagggaggaggctggaggagggtccaacagagacgctagagcattgcttctcaaatctgtggtgaagcaccagttccaaatctcatgttcatcattactagaaaaatgaaataatagacaaaatagagcatttaaaccttaattttttcttttagtttcaacaggcaaaacaagcaaccaaattagtacagaagcttttaaaagcctacttgcatgtgtagatcacttaatagtctgtggattgaccaacttggagtcgtgctggtccttggaccatacttcgagtaacactgcctagaagtcactcaaagcatttgtgttgtttttgagctactgtgcttcttggaccctgtgatgaactatcgtcttgggtgcttcagctgtctgttatcactaagacgcctggagccgggaggtggataccgctcctgagagtggttcattttgaatacccacttagctacatgcttggtagcacctagcccttgagtccttttcacttatggaacccaacagcttctcctacctctcagtccactgtagacatacagtggtttgctgacttactctattttctttcttttttaaagcagtggtacaaaaactgcttaatattttatgacggttttaattgtctttagtctatcaaattgagtaaagccaagaatattgtgtgttgtttaaagtctctgttttatggagattacttacaggaaaataaaatgatggaagataatatagaaatttcagtatata

SEQ ID NO: 24915 - DNA, 1097 bp, Homo sapiens
agtagcaaaacctcagtgtaaaaaaaacgacatacatacaaactgagctgctgtggttgaagtggaagtagggacccaaggctctgctcccagcctcctgtttcttctgtcttcctctttatgtgccctgcaacccccgccacagcaccagaggtacccccagggttcctcgaatcacagttggaaaccactgaagatatagctttgtcttttatgggtttttttccccagaaataaatctgtaatatgattcattaaaaaagaaaagaaaataactataagaaaaaaatagttgcttttttttttctctccccagaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatggtacatccgtggagaatcaactttgtttgtttaggaaacttgctttgaacttctccccactttttaatgtagaaagtaaaatttttgctttgcattggtttgagaaagctttctaatgaaactgagcagaaatagaactgtggctaagctttgttttttgatgtatacattttatactgatctgtttgattatgatttagaaagaacatcctaagccttcaaaattattattagcagcacgtgtacagtcactttttgtgtccatcccctgccttcccacagagttaaaagaaatttgtgaattgaccggcattgatcaatcagttctagaacgagcattcagtttccgaacagttgaggccaaacaggagaaagtttcaactacactgaatgtggctcaggtgggtgaaacataatgtacagacgaaagtttcttaaaagtctgtgctaattttcatataagtataaacaaagattttagtttacaggctgttacctgaatcgtactatgttctaggcattgggaacagagcagtaaactaaacagataaggatccctgccctcatggagcttaaaattctggtagagggaattagatgataatcagtagacataagaaacaagtgctgtag

SEQ ID NO: 24916 - DNA, 1027 bp, Homo sapiens
tttgaagctttaaagcttcaggcaagttatatgatgtatcattatttcagtcaaactgtttttatcctgaagaaccctcccctagcaaaccacagttcagacaccacaggaaggtattgtggtcctgtcttttgaattgactggatatgggtcttgatccaaagttttacactgatcaaaaatacagcctgaatggtaaaagccatcatttgtaaccatgaataactatcaatacatgctcacttttagaagtttattgctaattaagaactgactgcattttgtgtaatttgtccctttttgcaccagaatgcagtaagtatgacctgtttgcagtgctggtctgttgcatgctcttgtgttaatagcttctctagctgtgtgagttttgcagtaagtggttgttgaataaccatgtggatataaaatacagaatccatacaggaatttttaaaggttatgggcaaatttaatttagttgtaacttaatccttaaattgttttgtaattgtgaagctttgcctctggtttctaatctgcttgtgtgtatttcatggtcctgttttagaagtgtactttgagctgttcatagctacacaatgtgtctgaggacactagtgctttcctttccttctcattatttgctgtttgatgatttagcataatagggttgaaatagctccatgggcacagacttgccagataacacatttgttccatgagactgttgtctaaaaaaaaagtcaaagatctgctcttataagttattaatgttttacttttacttataggttttatttatagttgcatcatatagggacatactttagcaaagcaattgagactttctgatatatggaatgcctttatgctgagtataataataataaggcatctatactagaccaacttcagtttctaattgaaattgttagctctgcgaatttgagcacagggttttaaaaaatttgtgtgaaaatgaggactgaggagtgccctttgtatctgactatatttgtcaaaatta

SEQ ID NO: 24917 - DNA, 1029 bp, Homo sapiens
tacttttaaacagactagaattggtatgtgagaactaaaaaataaaagtaaaaccccagaatatgttcagactcctaaaaaatgcaaaatcctttgaaaatgttatgataacatttttggagtttattcttgcaaatcctgaatggtaatagaatttattttgatcttgtctgtgatttagacagatggaatttaaacttggaggcgaactcattatgagagtgtgactaacatgtcagggattttttgatggtgaaggaagtggctgcaatgtagatagtcttggagtatttttaatagttgtttgacattatagcatgcaatgtgcctgtcattgagttacatgtgctgcttataggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtatttttggcacatgaaactttcacagttcaaatgtgagagcaccccgaaggaatatcatttttccctttgcttcaatctgagtgtagcccaagcagagggtaactaaaatacttacagattaaataataccttatctgggattggcttaaaaaatgctccactatcctttcccctaaaataagaaagtaaaaaagtaaagtgtggtggagaagatagtagatatttaatgaaactcagtggttgagacctaggggttttcaactttctgtatgtttattattatttttttaatggcaagttaaaaaacaaaatgcaagtgttttttctggtcagtgttttgcagaaaactcttgttggcttcatttgggattcttgttctattagcttagagcacagcattgaagcaagtgctttagttaactgctctggcacttcttagga

SEQ ID NO: 24918 - DNA, 1050 bp, Homo sapiens
attcctttcctgtatgctgtgaggtttcagaggatttttgataagtccatctatcatttcttattagttattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcggtaagagtctcagtcattttaaatcagtaataacaatgctaatttgccaacatttattatgtacttaccatgtatgtgatttttacatacttaattctcccaacaacctcatgagataatggatgttcttaatggttcttttttttaaagatgagaaaactaagacacaaagctgttaagtaatttgcccacagccacatagctataagtggtagagctgggatttgaatccaagacagtattagagctcaagttcagtgtgccataccgcctttcactgatctagctgtatttggttggaaatacatttttaatttggtcatcagattggaagagacaatatcctttaagcttttgatttggttgggctagtttttcaaagtaattggctattctttggctattctttattgtagcagctttgaaagtggctttaattccagaaagctaatgccatgtttttgtagatttctggttttggttaaaggattgcattctctttagtccttaggtatctggctctattaactatagggaaagattcaataataaataatgtttacctagttaatatgaaatttctttttggcatttccttcctcatttgattgtagagattttgttgaaggcataccacaggtatgagagaagcctgaaggtttgcctcagggttaattgaaacttgggctgtgttctcacaaaatgaattaagtttgcactcacatctcctttcttatattcttcctctttttcagccataaagagactttgctatagggctgtatataatcaagacataatttacgctgacctattctcacataatacatttt

SEQ ID NO: 24919 - DNA, 1969 bp, Homo sapiens
gtaagtgtaatatataaaataaattgaaatcaatttttatgaagttgtcagctactccttagaatcaactgacctgtttcctttttttagtggtactttcatttgaaactatttctaatgtgcaggaatttttttcctttagtgttgggcaaccattccaaggggcttacctggaaatcaacaagaaccccaagtataagaaactcaaagatgccattgaagaaaagatcatcattgctgaagtcgtgaacaaaattaaccgtgctaatgggaaggtaaaaatgctaaccttgaagactgataagaagtacctattagttgggatagtcaccctgttttctgaatgtaaaaatttgcatttcatgttctcagtagagttaactatgaaggcggctatttccccttacctttaagcttaggtggaattttgcttgttctctgacatttttatgaaataaaacatattatttatgttctttactgcgttcttggtttacataggtatgtttgttgaaggatattggaatttttgcaaataatgccttaaactcatggaccatttttgagtatttgtgatcattggttttatactattttttattttgatttagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagaggtaaaggttcaacagaagatttctgtgcttaatctctcagccattgatttaaaaaatttccatatctgataatcctatcgcagtttatatatctgccttgctaatttgcaaattttggatattcacccctatgtaaaatctccgactcagtttttcagtaattgaataaagttaatcacttttattggccagtttactttactttttgagactaatacatagaaatatcaagatgttttaaattttgttttctcctgttttttcttctatgtatcaacttagtaaatgtcttaatgttcatctctaatctgggggtttacattaaaggatacaactaaaataaaataaccgccagttaattttaacctaaataatttttagtgttctgtgcctttagcttaaccaggactcctggcttggatgcagtggttacatgtaggttctggagttggtctcactcactttatgataattttggccaaggcatttaatttgtgtgtgcctacctactttttctcatctttaaaatggggatagtaagagtgcctacttcatagcattgttgtaaggattaaggattaaatgagacactggaggaacagggcctgtcacataacacatagtcactgaataaacaaaagttaacaaatattgatcatatgtagggacatgtgtctagctaataatgttactctctggccaaccctaaacttagaaaaatccccaaagcttcccttagcctgtttaccctactttggatcttaacttaaagggggcatatcaaatactaggacagtgattctcaacctcagtgacacatgtaaacagcttgggaactttaaaaattctgatgcccaggccatacccctatgaaatcaaattagaatttctcagagggggcacaagcatcatgtttttttttttgttttgttttgttttttttttgaataaacccagatgattcccttgcacagctaaggctgagagccactgccctaggatatttgttggaagtgttgtcattagggttttaaccaaatcactgaaaagttttttaatcaagtccttcagaagagttgcgggataggtccatgctcctcaaacctgaatgtgtaaacccatacctggaggttgcgttgtggtttcatattcactggggctgtggtagggcctgagattctgcttttctagcaagctccaagtga

SEQ ID NO: 24920 - DNA, 1043 bp, Homo sapiens
taggagagctatgacgtcactaagccataggaatttttccgcgcttatgggaccaccatcatatatgtggttcattgttcactgaaacgttgttaggtagcccatagactgtacttgcattatacttaatgtttcagtcttaatctgaaatgttccagcaagcatttcctttaagcatcatgtcagtgctttaaacatttcagagtttggaggtttcagattttcggattaggttagggatgcgcagcctgtactcgtcaagatcagtatccattaaaatacaaaagcaagtgttattgtaatcatgagctgttttgtgtatactttaatttgttttattcttttctcctaggttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaat

SEQ ID NO: 24921 - DNA, 1050 bp, Homo sapiens
gccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaaaataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgattttaaaagaaaaaaatttggaattttagaaaatttaaatgctgtcaggtatggaatgctgggcttccaatcctggcctcattgtctcctcacctgtgatgttggatgagttattacacttgaaatgtctttaagccttaggttccacaagtatgaaaacaagtaagtaacagtatcctttctagacttgtttaagatttccatgtaagtaattataatgacttctgacacataataatgtcgtcttataccccaacagtaggaaaaaaatgcagaattcagtatgaaagtattgttaccctttaacacagtggtccccaacctttttggcaccagagaccagtctcctggaagacagtttttccgtgggatcgggggatggttttgggatgaaactgttccacctcaggtcatcagtcattagttagattctcataaggagcgtgc

SEQ ID NO: 24922 - DNA, 1847 bp, Homo sapiens
ggttctagaaacaacaaactgaacatgatatgaaactaacaacatagaatgccccccaaacaaattcctctaacctcactgagtttacttgccctattactattttttttttttaagatcttctgtctcttgtttttgttttatcccttacctgatgaaagtgaacatttctagtggagaaagaagatcacagttctctaatatgggcattaagagaggggtacagctagaggggaggtgaaaacctgcctccactggggtgaaaaacagtgtgctgaggtttcagccagtgattacactgggtaatcaaccagtcccatgtttcacaaaggagttgtaatgattaacagttcaggtatgcttctgaggaaatctaattgagacctttggaaaatagcattgttatgaatggtgtggtgttacgccctgagggaaaagctagaaaaacattttacttttcaagtgtatttaaattacatccaaatgtttcagtgtgctttactggagactgcctgagtttggaattcaaatattgtaaccaaattactccaggtttctgaactaaaatgatctattgatgtttctcaaagtatagatcacagagtaagaaaagaggaaatcaagtctggtttatgacaaacttttttccatgttaacattggacccaaagatgttactaagagctttttactactgtgagagaaccagcgtgatgtgaagacaacgaacattttaagaagtttgactagtagacatttcgtttaagtcttttggagggtcttggttgacaacccacaattttattgtggctccccaggctttgagaacgtgtgggcttggatgatcattgttgacctataaaagagcacaggtctcttgagagtttattgacacactactgatcagacccccacaatatgtctcaacctctgttgaagggctagtgatgtttaaaaaaacctgttatttccaatcagaaattgaagttatgtctcttactccatcaaaatttatgcttttcagcattgggtaagtctagtttcttggtttgtatattaaatgcatattgagtaaaattcttagtgatttagaaaccatctacatgaggcttcccaggaacttgttaaaagtacaggttgcacctctgcattactagaataacatcagtgtacatttgggagatctgcatttgaaaccctgaggttgtctgcctcctgcccttgagatcttcccttgtattgaaattatatatatatatatatatatattttttttttttcccctcagtttcttttacctttgtgaggctaatatatgctgacgtgttggattgtaaaacaaaaaattgtgcttaaaagaatgtccctccagagggcagaattgttgggtaaagcatatagcgcagagcagaataagaggttcagtatggcctctggatgagggtattgcaaattttgaattaggctcaaataaaatgatttaaattatatatcaattcgaggatcagatattaattgggaggtcacatgactttccttgagcctatctagataaaagtaaaatgctttttttcctacgtttttgaaaatttagagtttattgttgctcatctcagcaaattaatgttaccagcatcttctgccttcctcctgtccctcaattccctactttactaaaagaaggctggccaaattgaaaagtagttgagttggagacttgataaatacttttgaaaatacttagagaaaccacccttcatcttccacgtaaagatctcagttctgtacagagaggcaactacaatgagtattttctgcaagtaacatggaaatcatgatttgattgcc

SEQ ID NO: 24923 - DNA, 1077 bp, Homo sapiens
ctgacttcagtcacatgagtgagaacaacagaaggacagcactgagctctgccaaaattgctgacctacagaatcttgagctaatgaatgattgtagctttatgccattaagttctgaggcagtgtgctatacatagcaaaagctaactgatacaaaactaaagatacaatggcacaaacatgaaaagacatgttcaccgaagcattgcctataatagttaaagactggaaacgactcagatgtccaccaactcaggagtggttgaacctactacagtgcattcaccccgtggaatactaagcagctccaacaggggtaggaaatttgtatactttcataaaatgatctttaggatatattgttaagtgaaaaaaacaaggtgtagaatagttaatagagtatgctacctcttatttaataaagggagaatataaatatgtattttgcttttatttagaaaatgaaagaataagaaaccactaaaatgattttttagaagaaagcaaggggacacagatggaagttagatttctctaaatttactttgttttgtagctagaactttagaaccatgtcaatgttttacacacgtcacacttataatcaagataaaaaatacttatacagtgatgtgtcacttaatgacagggatatattctgagaaatggtgccgttaggcacttttgtccctgtgccaacatcatagaatatacctactgcacacctaggctatatgatgtagtctattgctcctaagctacaaacctgtatagcatgttactgtactgaatactgtaggcaattgtaacagaatggtaaacatttgtgtatctaaacatagaaaaggtacagtaaaaacacagtataaaagtcaaaaaatggtacacttgcaagggcacttaccaggaatggagcttagaggttggaagttgctctgtatgagtcagtgagtgagtggtgagtgaatgtggaggcctaggaaattattctacactactgtagaatttatgaacatttgggctacactaaatttataaaaaacattttcttcttcaataatgagttagctcactgta

SEQ ID NO: 24924 - DNA, 1019 bp, Homo sapiens
aaaactgtttttgaattttctgctaagtaaatttttggcatactttctaataatatatgctcttcctaagacgttttgccaaaagtaagttaaaactccaaaggagttaattactggttgtaactggttaacaaatgcggttgcttccacagaggtcctttaaattattaaacagtttgaagcaaagccttttcaatgggaatgctgcaattttgttgcacttactctgtacttagtgttatagtgccaccaagaaacaaattctgaaactggcaagcaccaccaagtggcagaagaacatcactcattgagcagagaattgtattactgaatatgtaaataaaaatatatacattatttagacttgtcactaggtaccaaagaagtagacaagactgcattagcaattggattagtgctttaacttttccccagcaaggcaaaatcagtttacttattagaattaaatttaagtctatgaactgtactttgcattgcgtatcatatgattgctagtaatatgacacaatcataccatgtatttgcaaaattcttattttaaaatactataccatatttactttcaatcttcttgagctagaacactttatttgtggcatatacactctagaattgatgcagaggagcagagtccagttgttagatttttcagtagaaatagtgcagatatattttctccagaaaacttaagaacatttttttttctcatggaaagaacatcattataaagtgtgagattactcacagcttaagtagggggcttgggagttattctccaacaagaatagtttaagataaataaatgaacctgggaaaataagatacactgccaatcagaactcttatctccttcatgatttcatactttctgattgcttcaataaaggtaagatgtatcctttgcttcttaggtgtcaggcattgtgccatgtaggatagaacatgttatttttatttaatctttaaaacacccctatgagacaaagaatattatctca

SEQ ID NO: 24925 - DNA, 1034 bp, Homo sapiens
ttaaatatgacatctatattttagtaaagcattagtgaggactgtaaatgatctttaaagaatttggcttaaatttaatctaaaattgctatcaggtatttcacatcgctgtaatttttgcctgcattcgtaactgaagagataagtaaatgtcagaggttaagataaatctttttctttttttacctgtccatatttacaaacattctgcgttccgtacatagacgcctggataagaacccctgtgcaagaatgactttggtgctactttaaaaaaagtggttggggaagacctcataggaaatgacatcaataatagattgcatgataacctatactagttcttactgttaccaatttaaattctaactgcttaaaagctaacacggtccttccctttttttgagcacctgatttgaagtactttgagtaggcctcaagtgtcgtatgcaagtactaatctagggggtgtgcctttttcaaaagtgatttttggagaagataggatgtagtattatagcaaggaaaattcagcatctgggatgatcatttccttctgattagagaaatttaccttgttaatattctgttcacccaacccttctaccctcagtgttgaccaatactggaaaaaatttagggctttggagtgaaattttaaaagttcaaaaccttgatctattaattagtttgcttaccttgaggaagttgcttatcttaatcttctatttgaacttcaagtacaaaaaccctactcacggacttaactgtgaccattaaatgagataaccaaaaggctgaagatgatagtgagttgattttaccttttttctacatacagatgtttcagttctttcattagtggttgaaggtctgcgttctttttctccctccactccctccttgactacccccagaatgagctttgatggtctctactgggcctttgggggggatacattatcctgttgtttttgttctgttacttatatataatactcatggatttatttctacttctcttccattttcta

SEQ ID NO: 24926 - DNA, 1121 bp, Homo sapiens
attggaggaatgggagtttggaaccaggtgtggagaaaaaaaatcaagaaaaataggactgaactaacctttgtaacaataaagctaccagtaataagacttttttgttatctcatcatatgaatatatttccatttggggctatgttacatttcttaaactctgtattagaaagatttacaaagattgtaacacgttaaatagatacttggcttttttaatgttctcaggtgagttttataattatattctttaaataaacagctttattgttgtggctctgcctttagacttgggaaatttttatttatagtttagctattaagtgaatcacagccttcagtcattttaagtcactggttcttatctcgtgggccattgaaggtactatttataacttgatctgagtgtcttaattctttttaaaaatgtttaagttagttatatgtcatatttttgttttgtttttaaacaatgccttaaagctttcataatctgggtaaaatagtctaccttctacgattcatttatcttatatttttattctttttggtagtctgttggtttaaattgttatactaatgttgactcttaatttcttttctacagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccatgtaagaaatgtttttaatgtttttaaaaatttaaaataaaaatatttaagctgaaagggtccttcattagcaagctatagcacagtaatctagtatttgtattgttttatttgcttataggatgaagtatttttttctccattttcagagttttaatagcaatatttttttaaataaattgaatcattaggtcaactttgctttcaatagtctttaaaaaaaactcattggattaaaatttgcaatatcagtagcagtgagtggtcttttttatctgtgtagcatatcaggttagcctttaggagaaatgcataagatatgttgtaatgattatgcctgtag

SEQ ID NO: 24927 - DNA, 1023 bp, Homo sapiens
acctcaacctccgcctcccgggttcaagtaattctcctgcctcagcctcctgagtagctgcgattacaggcttgtgccaccacgcctggctaattttgtagttttagtagagacggggtttctccatgttggtcaggctggtctcgaactcctgacctcaggtgatctgcctgcctcggcctcccaaagtcctgggattacaggcatgagccactgcgcccggccataatttttgtatttttagtagagacagggtttcaccatgttggccaggctggttttgaactcctgacctcaagtgatctgcctgcctcggcctcccaaagtgccgagattacaggtgtgagccactgcacctggccttaactttttcttttttaccaaggtaatggatgtaaaccatttcttttttattttagttggtatttattggtttaccaatttagtttctctccacatgcaatactactttggttttcttcttttataaattaaaaaacagtagcttaagatgtaaatactcattcacatggaaaatatctgagggaaatggagatggcattaatttgaaagaaaaaatgctaatgccacctttcgaatatgcaagggatttcttcatgtgttttctaatttaatttttctgaaaactcacctggctatgaaatgtctgtcatttgactgtgcgtaattgtcttgatttgtagtatttgctcattttgaatagaacttatcatataaatttcttgaaaaatcaataacttcttacataaagcagtaaaaatatattagtgcatacttggtgctaattccttggggcttgattctgtatggtttcatttaccttgccaacttcagacacataatcttatctcttgttcatgcccattatcctttatccagaccaagtcatcaccgcctttgtggtgtttttgcttagacagttttcatagtctttatatctctggttttattctgttgtagtatatcattgccagatatatctgcttaaatgtgatgttctta

SEQ ID NO: 24928 - DNA, 1034 bp, Homo sapiens
aatgttaagtaggaaaaaatggatccatattgtcgtcaggtaggtgttggccatatcctgacagtcgcacaacatgccataccaaaaagatgagagtttatcttgtaaactttggagagccatgaaaaagtttaagcagtagaatgacatgatcacatttttgtttcagaaagactttggctctatggaggaagacttttattgatttaaagccattcaataagatatcaacagtaccagaagttttagtttgagatacctataggataaccaggtggaagtatctagttgtagaggactttgggtggtgctgtttatcaatcagtatcaaagcatttttatgtaatattttaaacaaatatggccataccggtaggtgttggttggctcttagctgtggttatgacaaacagtgtgggtgttgacattcaggttagaattaaatgtggcaaagccatagttcctattctagttggtatgtatacatatctagagggcatatttctgtaaaacatgctgcatattgtttatgcttaagtatttaaggaaagtcataatgaaaaatctttgtaacaataaaaacttggaaggaggagaaaggatagagtaaaatagtcttactagaaccatatgtaggaagctgtcagtttgaagggccagatagtagatggtttaggctttggggaccatatggtttctgtcacagtttttcaactctgctgtggtagtgtgtggttcctgggacagcgcctctgctgttgtagcacaaaagctgccatagacaatgtgtaaatgaataggcatggccagattcagcatggtttgccaacccttagaccattagttgatttgataaagtgattttgtgaatggtttggacaagaaaataatctttactagctattatataccattaccatagacttttaaacagaatttatgatagcatgctgtagttcttaaatatgacctttaagagattgctaaaatataccatagcactgtcagagcatggtggttagattaattgtacc

SEQ ID NO: 24929 - DNA, 1028 bp, Homo sapiens
ataattgattaataacctgctattacagcattagagtgatttgaatttgacagtacttttattagtgatttttatgctttctgatattttcttttattaattagtatcctttaccttcagcttgaagaactttctttagtttttcttgtaaagtagtggcaataaactctttcaccttttgtttgtctgagaaagtcttcattgcctctttgtttttgaaagatagcattgctgagatagtattcttggttgacagttttatttttcttttgggattttgactatatattctactttcttcttgcctactaggtttctgttgaaaacttcatcgatagtctagtatgggttctcttttatgtaacaagctacttttcccttgatgcttttaaaactctttgtctttaacttttgacaatttgatgataatgtgtctgtgttagtccattgtgcattgctataaaggaatacttgagactgggtaatttataaagaaaagagatatatttggttcatagttctgcaggctgtaaaaacatggtgccagcaactactcgacttctgttgaggcctcaggacgcttacaatcatggtggaaggcaaagggggagtaggtgagtcacatggtgagagagggagcaagagagaggaggaggtaccaggcccctttaaacaaccagtgtgaactaacagagtgagaactcactcattaccatggggagggcaccaagccgttcatgagggatctgcccctatgacctaacagctcccaccaggccttacctccaacaatggagatcacatttcaacatgaaatttggaggggacaaacatccaaactatatcattccacccttggaccccaaatcttgttcttctcgcactgcaaaatataattatcacttctcaatagtacactaaaggcttattccagcgttaattcagaagtcccaagtctcaattccaaagtctcatctgagactcaaggcaagttctttctacctgtgaacctgtaagacaaaaagaaa

SEQ ID NO: 24930 - DNA, 1034 bp, Homo sapiens
aaaattggaaaaaccctcatgtcaaagatcaaggatatgatttaaaaagttatgcatttccaaaatgagcaatcttgtaacagtcatatcccaacacattttttacctcttttaacctttaaaaaatgttttaaaaattataaaatatattatccatagagaaaaaaatgtgtacaatttagaaaacaggtatagtatactcttaatgtcatctacgctggggttttaaaataggatttctttcagtttcacatcacttcttaaaaggaatagcattctctgcaattcccatttcaattggaaaggatctctttacctaataataaaagagactcttattaatggaaaggatctctttacctaataataaaagagactcttaaccttctttatattttatgtgattctttttatagtcacttattgacagaaataaggtcagtgtgcctccaaaacagggaagaaaaaaaaaaagtgtgtttttctactctcacatacctcgcagcagaacacttctgacacctgaagacacaccaagaaattctgttcttcagtggacaccagttgagtgtcctgtaattcaattcagtcctgacactgacactatctacctgaagacaggtgaggactcagtctcacaagattgccccccactttagatgccaattgcaagccccaagttgtccttctgactgacttgcaaaaaatcgatgttcccatgatgcccctctgcaagttgaaataatttgctggaacagctcagagaattcagagaaacgcttcacttgcatttacccatttgttatagaggatattacaaaagatacagttgagcagccagatggaagcgatgcatagagcaaggcatgtgggaagggacgcaggccctttctggggctaaccaccttccaagcacctccatgtgttcagctgtccagaagcactctgaacccagttcttttgaatttttatggcggcctcattacataggcatgattgattaaatcattggccattgatgatcaacttacctt

SEQ ID NO: 24931 - DNA, 1044 bp, Homo sapiens
acctaacaaatgcttgctggattttgaagttagatgtaatcatttctgggatggtgattcccaaatttagctgatgttttatatatatgtgcatctgcaacaaaaagtcaccagatatgcagtcaaattggagttacttatcacagagccaaaagaagtgtttatcatttaaaataacttttctcttggtacaatttgattgtctcaatattaggatcatagtgttgctgggctctgtgtataataaaaataatgaagtataaaatgaatgtgtttttaaatataataacatcaactactattactctttctatactaatagtaggtaacatttttactgagccccttctacattccaggcacaattccaggcaccttatattagtaacaaattgtaatcctcacaatagccctatgaaatggaaacttattcacattttaaagataaggaagctgatgtacagagaagttcaggaacatagataataggtggcagagttggaatttgaactcaggtaacctggctccaaagaaaagtagctatttcttttcaaggagcaagggttctctgtttcgtccccaggtattctttgatgaatagcttgtacatctgcatctggtgtgactttaagcccctgaatttgtttctaactactgtactgcctgcccataccacttgtgatgtttgccagataatcttttatttatcttttcttttactccattttattttttgtgtgttttcttcctagtgctctttcaaagttgcttgttcttgaagaacttgtttaaaacataagatctttgccaaatctaccttgcaaaaataactgataattgagataaatgtttctctcaataatacaaatttcaaattatgaaaagagaattattaactacctacatatatgatatatctgtgtagctcaaacaatttttgttttattttgaaagattaatctcgtgatggtaaaatcatctatattttgcttttatgaatattgtcagctggtggtgaaggagcttaggtattttgtgttacca

SEQ ID NO: 24932 - DNA, 1050 bp, Homo sapiens
aaaataaagaatcaaaagacccaaattaagctccacttgtcagctaaggcgaataatgctcagaatatagaaaggatgaaggttgtatgggaaacctcttctcacttcctggataccctgtgaggatgtagtcagtcaatggtgtctagggaagacaggttttagaaccctagcagccccatgtattctctgggaattatagccagttgtctttggggagactttttcagtggagtcactgctgtgtaaatgtttgatttctcatttgctgccagtgtcacattccggctccctatctgtcccttccgtgttgattgtactggactttgctcttttgggatcagtgggctagatgggaaagaaagctcagcaggaactggtaactttgggtctcatattggattctttctgtcatcctataggcaaaaagagcaagccagtttttccactgatcatctttttatgttattttccaattacttttagcaaatagaaaaagaattgaagcaaatggagctaattaaggatcaatatcagaaaaagaactatgaacaggtagatgatttccatatactctgtgtttacctttcatgcaaaatctcaaacttggagggtgttcaccaaatgtctctgtctttgtatccttccagtctttgagtatccagagatttgtgtgtgaaatgactaacctgcagaaagagatgcagatgttggctaagagccaatatgatgcctcagtgcggaataaacagcaagagctgcacctagaagcagagcggaaaataaggcaggagctagagaatcggtgccaggtaaaaggtttcctaagattcatcttaaagatggtcagcaaatgacatgtgccaaagcccagtagttttgcacctagactttctagagtctacagaagacaacacacatttacaaattgtttatcttagctaagtccttagaataatagtatctaggaagaaggctgtagtttgaatatggcaaatgttctccattttcagtttaataaaagtaatgtcaatttttaaagaacagcta

SEQ ID NO: 24933 - DNA, 1416 bp, Homo sapiens
gtcttctctgatttctttgagcagtggtttgtagttctgcttgaagaggtccttcacttcccttgtcagcagtattcctaggtattttattccttttatagcaattgtgaatgggagtttatttgtgatttggctctctgcctgcctgttggggtataggaatgctagtgatttttgcacattaattttgtatcctgagactgctgatgttgcttatcaacttaaaaagcttttgggctgagacgatggggttttctagatatagaatcatgtcatcttcaaagataatttgacttcctctcttcgtatttcttcctcttgcctgattgccctggccacaacttccaacattgtgtggaatggggtggtgagagagggcattcctgtcttgtggcagttttcaaggggaattcttccagcttctgcccattcagtatgatgttggctgtgggtttgtcatagacggctcttattatttcaagatatgttccttcaataccttgtttattgagcatttttaacatgaagggatgttgaatttaattgaaggccttttctgcgtctattgagataatgtgatttttgtctttagttctgtttatgtggtgagtcacatttactgatttgcatgtgttgaaccaaccttgcatcccggggatgaagccaacttgatcgtggtagataagcttttcgatgtgctactggatttggtttgccagtgttttcttcaggatttttgcattgatgttcatcaaggatattggcttggagttttctttttttgttgtatctctgccaggttttggtttcagaataatgctggcctcatttgatgagttagggaggagtccctccttttcaattttcgggaatcatttcagtagaaatcgtagcagctcttctttgtacctttggtagaattcactgtgaatctatctggtcctgggctttttttggttggtaggctatttattactgcctcaatttcagaacttgttattggtctgttcaagaattcaatttcttcctggttcaatcttgggaaggtgtatatgtccaggaatttatctgtttcttctagattttctagtttatatgcatagaaatgtttatagtattctctgatggttgttggtatttctgtggggtcagtggtaatatcctccttaccatttctgattgtatttatttgattcttctctcttttcttctttagtctaaccagcagtctattttttcaaaaaaccagctcctggattaattgatttttttttgaagggtttttcatgtctcttttctcattcagttcagctctgatcttagttatttcttatcttctgctagcttttgggtttgtttgctcttggttctccagttcttttagttgtgatgttaggctattaacttgagatcttt

SEQ ID NO: 24934 - DNA, 1129 bp, Homo sapiens
gagatgccctgcccagagaggaggaatcttgtgcttggttttttggcatggtggtgcatgcctgtaatactagctacttaggaggctgaggtgggaggatgacctgagctagggaggactaggttgcattgagctgtgattgcaccactgcattccagcctgggcaacaaagcaaaaccccatctcttaaaaaaaaaaaaaaaaaaaaaaaaaaaaaaagaggcttggcatccttggaactagttataacagaattgaatactgcttgtcctcttttatgcagttgcaggtcactgggccagaggtttctgtttattggctttctctttctcctctacacttgtctgaactccctgaatagaaacacctgactgtctactaaaatgccaagtggtcctgctaactctcactcttcacattagcatacttaccctgaactgcaaacaggataaatttggggtatgatcttcagggttatgattagacttttcatgcttcatctggttgccctgatacctgctagacttgtttaggttaaggctgaaaaacgggcagcaagaaacacatactagggtccagctgcccttctttcaatgctgatgggagccgcacaaacagagcttatggatctgattgctcaaatgtggagggcgagactgagatttttttctattgaaatgttgaaagttagacaaaacatattaagacaattaaattttatgaaatacagtcctaaatttatagaaatgcactgccatctactgcatataaaaaatcattgcagggtatgttcctcccactggaattatttataatcaagcagtcacacacactgaaatgtacatgaatttataagatgtggcaactgccacaaagaactcatttagacttttataacctttaattttcttatctgaaatgttctcagttttccattttgtctctttaaattctattttcatattttcattgaattaattcttgcaattacattttaaatcttataatgttctcattctttgaattccttccttttaatagcatcctcttatttcatgtgtatggtattgtcttatctggggatatgaactgcgttttgtttttctacttcctgcaccaattctgttcc

SEQ ID NO: 24935 - DNA, 1074 bp, Homo sapiens
acggagtctcacactgtctcccaggctggagtgcagtggcacaatctctgctcactgcaagctccacctcctgggttcaggccattctcctgcctcagcctcccgagtagctgggactacaggcgcccgccatcacccccggctaatttttttgtatttttagtagagaacggggtttcactgtgttagccaggatggtctcaatctcctgacctcgtgatctgcccgcctcggcttcccaaagtgctgggattacaggcgtgagccaccgcgcctggcctcccaattttctttgtattattttctgtctgaagaacttcctttagtaatttttttttttttttagacagagtctcgctctgtcactcagactggagtgcagtggcgcgatctcggctcactgagtttaagcaattctcctgcctcagcctcatgagttcaagcagttctcctgcctcagcctctcgagtagctgggattacaggcatgcgccaccacccccagctaatttttgtgtttttagtacagacagggtttcaccatgttggtcaagctggtcttgaactcttgacttgcctgcctcagcctcacagagtactgggattacagacatgagccaccgcggccagctgatcttcatttctaaataatatttttgttagatatagaattctggcttgacaactctttcagcacatttttatttttattttatttatttatttatttttttgagatagagtctcgctctgtcacccagactggagtacggtggcgtgatcttggctcactgcaacctccacctcctgggttcaatcgattctcctgcctcagcctccccagtagctgggactacaggtgcatgccgccacagccgcctcatttttctatttttagtagagactgggttttgccatattgaccaggctggtcttgaactcctgacctcaagtgatccatccacctcagcctcccaaagttctgggattataggtgtgagccactgtgcccggccttatttttatttatttattttgagatggagttttgctctgtcgcccaggctggagtgca

SEQ ID NO: 24936 - DNA, 1074 bp, Homo sapiens; identical to SEQ ID NO: 24935

SEQ ID NO: 24937 - DNA, 1074 bp, Homo sapiens; identical to SEQ ID NO: 24935

SEQ ID NO: 24938 - DNA, 1074 bp, Homo sapiens; identical to SEQ ID NO: 24935

SEQ ID NO: 24939 - DNA, 1041 bp, Homo sapiens
gagcagttatgtattaacaaattatatgtacttaacataagatttaccaggtgatataatttaattaaccataagaacttctttgtttttagtatattcaacagaacataagagcagattgctccaatattgacaaaattcttgaaccacctgaaggccaagatgaaggtgtgtggaagtatgaacatttaaggtaggaccttacatcaaaatactaatagtacctctcacaaaactagctttcatattaatgataattatgaattgtaaaatttactatgtaactgcagactaagaagccaaattttaaagctttggcattttcagtgtcacaaggttctcagctttcttcactggttgtttccaggtcaaattatgctgcagagtcactcattttgaaaggtggtttatttcagagttgataatttggacctgcctctgcacctctcttcttttcttttcttttttttttttttttttgagatggggtctcactctcttgcccacgttggagtgcagtggtgtaatcactgcttactgtgcctctacctcttaggctcaagtgatcctcccacttcagcttccagagtagctgggactacaggtgtgtgccagcatgcctcactaattttttaattttttgtagagacaggatctgattgtgttgcccaggctagtctcaaactcctggattcaagcaattttcctaccttgtcctcccaaagtattgagccaccctttctacatttattcatttgggccttattatccccgccttttttttgaaacagggtcttgatctgttgcctaggctggaatgcagtggtgcaatcttggcgcattgcagcctctgtctcccatgctgaagcaatcctcccacctcagcctcctgagtagctgggactactagtgcatgcctctaagcctggctagttttttgtattttttgtagagacaaggtttcaccatgttgcctaggctggtctcaaactccggggcttaagcaatccacccaccttggcctcccacagtgctgggatt

SEQ ID NO: 24940 - DNA, 1072 bp, Homo sapiens
tcaagtgattcttctgcctcagcctcccgagtagctgggactacaggcgcagccatgcccagctaatttttgtatttttagtagagatggggtttcactatgttggccaggctggtctcgaactcctgacctcatgatctgcccgcctcagcctcccaaagtgctgggattacaggtgtgagccaccgtgcctgacttgtcttttttttttcctttgtttctgtagagatggggtctcactgtgttgcccaagctggtcctgaaatcctgggctcaagtgatcctcccatctcagcctgccaaagtgctgggattatacaggcatgagccactgcacttggccactttatgtttttgtagaggattacttccagttcctagtctaggcttggtatctgataagttacctgtaaattattgcaaacttccagtcttctctttggtaaatagagattaattgtaatcctgaagtaaggagttttggtgctttttataatgccctttgaatgaaaaaattgataactagtggataggtggagataacattaaaagtagatatattctgaagttactaggtgtttcttgaaattataaattttccagtgcaaatgggagctgggatgagttgacagattattaataaatatagagaatgcagtatgtgttcattggggcttattatttgtaagttgatttttagataaatagagtagaaatatgacttttcctgaataaattagaccatgtttcctgtgttgtgtgcctcaacttgtagacaaggcactttttaaaaatatttactttttgatgctgcatgcttctttagaaatggctaagacattatgtcgtgtcataacagttcagcaatttcaggatgctaagacttctttgtatcctttgccagtttttagacaaattacttgactattttctaactttttaatatatatgaatgcacaataattcaaagtacgagtctgtagatattttcccatttttacaacccaagacagagagcactttagtgtagtacatcctttgctttatttttatcagccttgaaaataactgc

SEQ ID NO: 24941 - DNA, 1072 bp, Homo sapiens; identical to SEQ ID NO: 24940

SEQ ID NO: 24942 - DNA, 1072 bp, Homo sapiens; identical to SEQ ID NO: 24940

SEQ ID NO: 24943 - DNA, 1072 bp, Homo sapiens; identical to SEQ ID NO: 24940

SEQ ID NO: 24944 - DNA, 1072 bp, Homo sapiens; identical to SEQ ID NO: 24940

SEQ ID NO: 24945 - DNA, 1023 bp, Homo sapiens
aaacagtttggaagttccttaaaatggtaagcatagagttgcatacgacccaggaattccactccttgatatgtagttcccccaaaatgaaaacatttatctgcacaaagacttgtacatgaatattcacagtcacattatttatgatagccaaaaaatggaaacaaccaaatatccatcaactgatgaatggataagcaaaatgtgttgcagccatctctcagtagcctcagaggattggtcccaggacccccatgaataccaaaaccacagataccaaagtctcttatataaaatggcatagtatttgcatatgacctatgcacatcctcctatatactttaaatcatctctagattacatataatactgaatacaatataaatgctatataaatagttgttatactgtatttcttaatttgtattattttttattgttatggggttttaaagtgtagttttgatctgcagttggttgaatctgcagatgcaaagtgctgactgtatgtgtacaatggaataatattcagccatgaaaaggaatgaagtcttaaagggagaaacatacagtacggcattttgtatatattaaaaacattaaaggctaaaaagttttgaattttaaaaaaaggaatgaagtactgattcatactacaccatggataagccttgaaaacataatagaagccagacacaaaatgccacttattatattatttcattttaatgaaatatccagaataggcaaatcctgtgaaacagaaattaggttggttgttgcttagggctgggggaaggagagaatgggaagtgactgctaattggttcaaggtttctttttgggatgctgaaatgttctgaaatttagtggtaatggttgcagaattttgtgaatatactagaaactactgaatttttaagagtaaattttagttgtatcaattatatcttaaaagtcaaaaagtagcccattaattttatatcaattacctgctgaaatggtattattttggatatagtg

SEQ ID NO: 24946 - DNA, 1023 bp, Homo sapiens; identical to SEQ ID NO: 24945

SEQ ID NO: 24947 - DNA, 1023 bp, Homo sapiens; identical to SEQ ID NO: 24945

SEQ ID NO: 24948 - DNA, 1023 bp, Homo sapiens; identical to SEQ ID NO: 24945

SEQ ID NO: 24949 - DNA, 1023 bp, Homo sapiens; identical to SEQ ID NO: 24945

SEQ ID NO: 24950 - DNA, 1042 bp, Homo sapiens
acacaataataatgggagactttaacaccccactgtcaatattagacagatcaacgagacagaaaattaacaaatatagtcaggacttaaactcagctctggagcaagaggacctaatagacatctacagaactctccaccccaaatcaacagaatatacattcttctcagcaccacatagcacttattgtaaaattgaccacataattggaagtaaaacactcctcagaaaatggtaaagaacagaaatcataacaaacagtctctcagaccacagtgcaatcaaattagaatgcaggattaagaaactcactcaaaaccacacaactacatggaaactgaacaatctgctcctgaatgactagtggataaattatgaaattaaggcggaaataaataggttctttgaaaccaatgagaacaaagacacaacataccagaatctctgggacacagttaacacactgtttagagagaaatttatagcactaaatgcccacagaagaaagagggaaagatctaaaatggacaccctaacattacaattaaaagaactagagaagcaagatcaaacaaattcaaaagctagcagaagacaagaaataactatattagagcagaactgagggagatagagacacgaaaaacccttcaaaaaaaatcaatgaatccaagagctggttttttgaaaagattaacaaaatagaccactagccagacggataaagaagaaaagagagaagaatcaaatagacacagtaaaaaatgataaaagggatatcaccactgatcccacagaaatacaaactaccatcagagaatactataaacacctctacacaaataaactagaaaatctagaagaaatggataaatttctggacatatacaccctcccaatactaatccaggaagaagttgaatccctgaataggccaataacaagttctgaaattaaggcagtaattaatagcctactaaacaaaaaaagtccaggagcagacagattcatagccgaattctaccagaggtacaaagagga

SEQ ID NO: 24951 - DNA, 1061 bp, Homo sapiens
atggtgtaattgacaatacctcaataaggcagtggaggttagaagaacaatgagaagtcttctactgtcccctgccaatttcagtatatcacatggaagttatttttctgttatccttgtccctccaggtggcatttaagatttgagcatcatggtaacagagggccagagaatgaaggaaacaaatctcatgtcaactctttcttttttttttttttgtttctctatgtttcatttattttttaaggggtgaactctctttgttaagtataatttctattctataatagtaatttaataaatacttaataatgtgaatgcatatttcaatagcattctttttttttttttttaacacaggatctcactttgtcacctgggcaggagtgcagtgacacaatcacagctcactgtaccctcgatctcctgggctcaagcaatcttcctacctcagcctcccaagtagctgggactacaggtgtgtgccaccatgcctggctaattgttttgtagagatggggtttcaccatgttgccccggctggccttgaactcatgggctcaagccttctgcctgccttggcctcccaaagtactgggattacaggcatgaacactgcacctggccaattttactcttttaaaaaaatcttatttcaaccggacacatttttatacagtataaaaacatgttaaaaatcagcagttacagaagcggttaagaacttccttgtgaaagcaatgttcactcagtctttattttccaaatgacttgaatgctcttaatactaatttcaccttgatctaagccactttatattaaacccttttatttaaagttagttgcttttgagcccactgcatagagaccctctaattctgtgtagtgacttgtactttagtgcccaattagagtgtgaatcaaggttaattagcaacaaatcatctttttataattgaagaatctaaggtacagcaagataagtgacctactgagggacagagttcaaaataaaataggtttcagtcactcaatgaagtgctttgctgggagatctcgcc

SEQ ID NO: 24952 - DNA, 1031 bp, Homo sapiens
tacaatacttccattttgtttcttattggctagaatttagcaatataacctcacgtagcaacagaaggaggctgggaaatgtagtcttttagctggaataaaaatggggattggttactaaggaagaagtggaaagtgattttggctgtcagccaggaatctcagacacgatgttctcaacaaaactcttcatggcccctctccttagcaaattctatcactatccaccagatagatagctcactctgaaaatttgaggttcattcaccaatccttttttcccttcattccccatatgcaaattagcagcaatcccacaattctaaaatacatcctgaaatcggaaccctctatcactactattaaatccacaatttaaatcaccatcatctcttatctggattctttcagttacctcctgattaattccctgcttcttgtgttgctttccacagatcactgcctgcatagcaaacagaatgatttcctaaaaaaaaaaaattgagactgtattgttcccttgcttaaagccctccaacagcttcccattgcaataaaaataaatgtcaccttcttatttggcctataaggcctgacgtggtttggctcctgcctctgtaaactcatcatctaccccttgtccccaggttctcatgctccagccacagtggctaccttcctgtcccgcgaatgtacccagtatatactacctcagacttttgctctggaacattcgttctcatttttgcatggctaaccctttctgaattagtcagggttctccatagaaagataatcaattggttttttatatttttaaggagattttattatggagaattagcatatgcaaatatggagaccacaatgtgccatctacaagctggagacccaagacagctggtggtgtaattcagtctgagtccgaaggctgagagccagaggaactgatggtgtgaatcccagtctgaaggcaagggaagatgaaatgagatttcccagctcaagtggtgagacaagaaacagagaag

SEQ ID NO: 24953 - DNA, 1056 bp, Homo sapiens
cctgtaatcccagcactttgggaggctgaggtgggcggatcacgaggtcaggagttcgagatcagcctgatcaacatggtgaaaccctgtctctactaaaaatacaaaaattagctgggtgtgtggtggcacgcgcctgtagtcccagctactcaggaggctgaggcaggagaatcgcttgaacccgggaggggaaggttggagtgagctgagatcgcgccactgcactccagcctgggcaagagaccatctcaaaacaaaacaaaaaacaacaaaaaaacctgaaaaacgcttttgagtaggaggaactttcacagaataagaggtttgaagttagttaactgtattgagttacaaagccaccattgcttatttcttggtatagttgttccttaatcaaatttcttaatcagatataaccaacagatgaattataaagcagaatttggaatatctgtaactttagagtacctcttttgtctgccttcactacatatatactgtctcttattagatttgaacctttttgcttcaaagtagattctgtgtgttggctagaaagcataaatatcctttagggaagaatacttaaaaaaccagtatcttgtgtagtgttcttgagtaaattcagtgccatagtatatttgttgtcagatttgggagtgagataggtggcaactaaatatatatacagggagcataatacattcaaggagtatacaacttttacattcctatagcacgttagggtttattcaaagtgaggtccttcatttgaccctcagaacagtcatgtgaaataggcagcacaggcatcattacaaatgtgactttacaaatgtgagaaggctgaggctcagagaagtgaaatgatttggctaaggtcaaaagcaagtcacagtgaatgcctggtctggagtccggtgtgttttcatctcagcatgcaaatttaaacccaaagaaagttaggtgcttaaatgctctagggtagctgggctttacgtggctacttaccatagtgtttatttgaatgttagagaaatagcttcaagcaac

SEQ ID NO: 24954 - DNA, 1029 bp, Homo sapiens
ttgtggtaaatcttagtaacaacaacaaacagtagcactaaaatgtatgtagatgcattaggctaagtattttatgtgtatcactctatttaatctttacaacaacccatgagcaatactattattattgatacagcactttatagaccagggaactgaagtacagagggctaaacttgtttaatgaagcgctcacagggtcgagaccggctccagttcactgttgagcactgtgcaggcctgcctgtcagcacagggagagcaacagttgaatttagcatccttcttatctgggggggtcatgagtaggaacgtattcattatattctgaggacttaagtggttgactgaaaacccagagcatttcaggtattacatctagagtttttaacgttacatttagatattacatttagggtttccataatatttgagaataatctagaactgatcatagaataaagtgaaaggaatgcaaatttctagctgattccctacccatttgttgaataaattcgggcaatcaaacaatctgaaatgtagcataatattatggctttggtttttaagatggaaaaagtgatttataaatgaacagattaagaatcagttttttacttttcctgatgggcttttgtggacactgttgtagttctcaataatcttgaatttatgaatgtgccggctaggaaattatcaacaccacatgctgtttcccacactgaaaacttttaagtattgagaaaaaaaatctgtatttatatgggtgataaagtgaaaaatataaaataaaattttcagagttgtgagggatttgtttatgtgctatagaagtatattggagaagttttaaaaactggttggttaaaaaaaatcagttagcttgaattttgagtggggtgtttcagttctagctagtggattgcttaatcatcaacattcagcttctgagaagaaatttcttcccaagtgaatacagtagactcttggctttcccagatttaacattttcagtttctattatttggg

SEQ ID NO: 24955 - DNA, 1052 bp, Homo sapiens
cccggccaaagaactttatttctaattcactcttgctccttataggcacaaccacacttcagacctgcttgacatttgaaactgccccttatctgaaatgatcttctcggatgatacccagttatagttctgcctctttgcaatcttctcttgggctgaatcttggctttattctcagtgtaacagcttcttgcctcatccattgccttgacatgccacactggcctcacctgcctctctactcatgtggaccgtttggtctgccatttgagctcagtttttgatagttccatggacttcaggctctgatcctattttacttgctctgcaaatctccaattctaggtatcaccatctgatttctctccgcctcctcttgtattactgagtacaaaaaaaggacatgaatcttgatttttgttaacaataaggaaaatctgctataacgttttagcatgtaactcacagtcagtcccatgattggttaatttagcgatccaataacatcatcaaagaccttggatcttcccatttccccccgccccctcacctaaccccctgttgtcctattaggacagcttcagtctctagctagccaccagctgctgcatttccaggggccgtgcagagaccagactcagcagaaaaattggtttgattggttttaccacaaatatcaacccacaattagaacctcttctggcttcattgcagtctcattacaaatttgctcctacttgtgtttctcactggaactattctgagctttttccaattccaatcttatcaagccccacctacttgtttctttttttgtttcaaaagtgtcttccatatctgttcctattgcccctaccctaacttgcacccaacaattgtttaccttgcccccatccattcattcccctgtccctttcctgccaggttactgttcctgaagctggcgctgagtgtggcacttttttgttcactctgcctctagtgggtccctgaagttcagatggcttattgtagcatttgggatccattaagacctggccctggactacatt

SEQ ID NO: 24956 - DNA, 1042 bp, Homo sapiens
atgtggtctcattgtttagttcccacttataagtgagaatatatagtatttggttttctgtttctgcattagtttgcttaggataaagccctccagctccatccatgttgctgcaaaggacatgatcttattcttttttatggctgtgtagtattctgtggtgtatatgtaccacattatctttatccagtccactattgacggacatgtaggttgattccatgctttgctattgtgaatagtgctgtgacaaacagacatgtccatgtgtctttatggtagaaggaattatattcctttgtgtatatacccactaatgggattgctggggtcaaatggtaattctgttttaagttctttgagaaattgtcacactgctttccacatggctgaatgaatttacattcccaccagcattgtataaacattcgcttttctccacaaccttgccagcatgtgttattttctgacttttagctattctgactgtgagatggtatctcactgtggttttgatttggatttctctaaggattagtgatgttgaacacctttttatatgcttgttggccgcgtatatgtcttcttttgaaaagtgtctgttcacgtcctttgcctgctttctaatggggtgtttatttttttgcttgttaagttccttataaattctgaatgttagacctttgttggatgcatagtttgcaaatatcttctcccattctgtaggttgtctgtttgctgtcttgatagtttcttttgctgtgcagaagttctttaattagatcccactgtcaatttttgtttttattgtaattgcttttggtgtctttgtcatgaaatctttattaggtcctatgtccagaatggtatttcctaggttaacttccagagattttatagttttaggttttacatttaagtctttaatccatgttgagtgatttttgtatatggtacaaggaagaggtccaatttcaatcttctgcacatgactagctagttattccagcaccacttattgaatagggagtcctttctctat

SEQ ID NO: 24957 - DNA, 1039 bp, Homo sapiens
acctgtatctgtagtttttttcattgttcttttttgttgagacagggtctagctctgtcaactaggctgaaatgcagtggcgtgaacatggctcactgcagcctcaacctcccaggctcaagcgatcctcctaccttagcctctcaagtagctgggacttacaggcatgcacaatcacacctggctaatttttaaaatttttcgtagaaacgagggtctcattaggttgcctaggctggtctcaaaccccgggggttaagtgatcctcctgccttggcctcccaaagagctgggattgcaggcgtgagccactgtgcccagccagtagtctgttccttttatttacagagtagtattctatgtatggatatatactttgtttatccattcagcagttcataaacatttgagttatttccagttttaactctttaaaagttttgctttcctaaaggttaggatctatagacgatcatgccctaagtggtgtctcctggtcatgtaccttggagcttcctgtgctttatcaggcagctctcttaggctggaccctgttctggtcattctagcctgcttacttcagatgtgcactttatgtttataataaacagaaatttatttagctcatgattctggaggttaggaggggcctacatctggtgagggccttcttgccctgtcatctcatggtggaaggcagaagggcaagagagcactagggagtggaggaggggaaggagaggccaaattcatccttttatcaagaaccattaatccattcatgagggcagagcccttgtgacctaatcacctcttaaagatcccacctctaatcatagttgctttagggattaagtttacaaaacatgaactttggcggacacattcaaaccgtagcagaagttcactctgctctaagggcagaacacttagtttgaatctatcatttgtctaccaactcttagagacacatgtcaagatttcctaaaaatccattgttcgttacttcaatagcagtttggagtgggtctctgagttt

SEQ ID NO: 24958 - DNA, 1051 bp, Homo sapiens
tttctcttttttttgaggcaaggtctaactctattgtcaaggctgcagtgcagtggcaaaatctcagctcacagcaacctccacctcctgggctcaagccatcttcccacttcagcctcccgagtagctgggactacaggggcacaccaccacaccctgccaatttttgttgttgttgttttttgtagagacaggatttcacatgttgctcacgctggtctcaaactcaagcggtttgcctgcctctgccgcccaaagtgctgagattataggcgtgaaccgccgcccccagcctcaggctttttttaaaaatacaaatggttgcatagtgtactggattttttagtccttattttacaacccataggagtactcatagagctgcctcattcttttgaagcagaaataaatatccttatacatatttatttatgcatatatgtaagtatatcaatgagataaatttctcgaagaattactaagtcaaaaggaaggtgtatttaaaactgatagatactgtatatcaccattagaaataaggaaaactcacaccatttatcttatttttctctcaccttctatatccaatccatttgcaaatcctgttgactctaactccaaaataaattcaggacttgaccacttctactctgattcaacccaccttctcttatcaggattatatttcagtagccttttaacggtctccttgcatcagctattgccccttcattattaggagccagagtaatattttcaaagcatatatcagcccttggctccagatcctttcagagcaaaagccgaagtctttgtggtgtcttaaaaagcctgatcagcacctctccttttccccaaaccatctctctgcccccctttgtgatcacatttgctactgttgactcctctggagccacactgacctcattgctgtgtctgggttatgtccggcaagctcccacctcagggcgttttgcagttacagttccttctgcctgaaatacccacgtggttcactctctgagttccttcaggtcctttcaaactatca

SEQ ID NO: 24959 - DNA, 1009 bp, Homo sapiens
tacattttatatagagactgtcttttcagactctcttgaatctgctctttcctccctgtatcataaccttcattactgccgtggttcgggccctcatcccttctcttgaggattattgcagtagcctcgcaactggtctctctggcttctgcctggcctgtctccaatttgttcctcatactgctgcctttctaaaaggcaaatctgattacaactctccactgcttaaaatccttcagaggagtttctgcatcttcaggttaaaatgtaagctccctggcatggcacgaaagcttctttgtgatctgggccttcccttcaggtgtgtgtcagtctcctctaatgatcctggtccccactgtctgcccctgcccgtagcatctccactaaaggaaagaaatgataggagggatgggaatagaggcgagatgatagacctgctgttcagtactgtagccactagctacatgtggctgttgggcactggaaatacagctagtccaagttgagatgtgcgtaagtgtaaaatacaccatgctttgagactatataaaaaaatgtaaaatttcttatttaacaaattgtaatattggttacatgttgaaacagcaatagttttgatatagtaggttaaacaaaatatattactaaaattaatttcacatatttctttttatttttaaaaatgtgattacttagtggacgttaccatgcgacataaagaaataataaaataaaatgtgattactagaaaattaaacatcacctgtgtgctcacattatagttctgttggacagcattgttagggaacatctcattcccaggagatgcatcctgtacgagccaagcccacgagctttttgaatgattaagtcagccctattggcatagagaagtagcagttgctcagttttttcagtccagaggtatgaaatgtttggataagattcagaattggagagacagcttctgaacgctatagccaggagttacatgtacaatgggcat

SEQ ID NO: 24960 - DNA, 1084 bp, Homo sapiens
tcgtatttccttagcagggctgcagtcaggcccctagcttcgggccgccaccctctcctctctggagtcaccccacctctcccatcaggtgacagtatgagttggaaaagggacgggtgtagccacaccaggacaacttgtggtcagaaggtcaggtttcaagggccggctccgttactggctggatgcatgttggtaacctcataatccttagattctcacctgtaaaatgaggacagtgggaaagctaccacatgagctatgagagcatctatttatattcttttatagcacttttatagcacttgctgtgtgccaggcactgttgtaatcactttacaaacatgaactcatttcatccttcttaccacgctatgccgtagttactattattatccctattttactgatgaggaaacacggcctagatcaaagtacttgcccaaatcccaaaactagtaagaggtagagctgggattcaatcttggtgaatcgtaattgcttgttttcggtcataagaacataaggaagaatctgtattgcagaaaataggcagtgtttactctgcgagattacttaagggcccaagatcctgtgcttggtgacagaggcacagggctggtggtagcagctttctaggccaactgcttgtgtgtggtcagctagatgggctctgatggtggggcctgatctgagagggaagtgagcctttctaagaacatgtagaatgtatgtgttagatttctaaaactcaaaccagtgaacaggtaacatatataggactaatgtgtgtgtagatggagcaggtctgacaggtaagaaaaccctctccactctgccccaaatgtactctatcacatgcttctcaccctggctttttgccgttaaactgaataaagatcaggcaagaacttcacttccttgtgtgagcacatgccccttaataaaatgtatacccctagacatggtttttacattttccatttaatgcaaaattagctaacagatgttttcaattaggtgtagaaccaggaactggtttcagggtgcagtgtaagaatgtgtactaattgattgatatgcc

SEQ ID NO: 24961 - DNA, 1102 bp, Homo sapiens
gttggttttcatttccatgtatttctagaattcattcattgctgtctcttcccctgccttcccaccaaaactaccatcctcacttgcctgcactgcagcaatagtccactcattaatctcctagcacttacccttgttcctttgtaaatcattctctatcctgtaatcttttcaaaacacaaatctgacctcttacgataaagacaagaagacttaccctgtcctgcaagcccagcatagtctggcccctgtgtcccactccaccctccttgcatggcacattcgttcttgccctctctactttagctatgctggtctctgtttgggccctcatactggccatgtgtatcagtcaagatcaagtcaggagataagaaccatactggttatttgaataggagaaatgtaatgtaaagcattgttaattaaaacagtaggaggttactaactactagaaggggtaaaagaggaccataaggtgtccacatttagcatgagagcagttactatatctgtactgaagaaaatgagacaataaaggaactaaggcctaggggaggcccccaagccaagactgagattctgacctgatcgaagaaggtgtgtggctaccagaggaacgtgcagccttgtggtggtgaagaaacttgtcaaagggcacagactgagctcttctgttaagaggctgccattgccagagggtgtagatggattggagctgctcaaagccactgacagtggcgggaggtggggaatggcacgaggatgtaggttggagctcctctgaatggctgctgggttcctgtgaataataataattaataataatagagatccagaaccccaaagagagatatactcctgttcttatggccttgcagggtcactttattgccatctgctgacatcaaaagttaacattctactagctggcaaaagagaattgcttacagggtccagctccagtatcacaaagtagggcaagaagagtagatctggagccaagagacactataacttgataactggcacacaatgctttctcccctacaaatgtagtcactgcttggagtacaatttcccactcttttcaactagttat

SEQ ID NO: 24962 - DNA, 1052 bp, Homo sapiens
gacaaattctttaaaaacacaacttaccaaaacagacaagaagaaatagaaaatctgaataacactatgcttaccaaggaaattcataattaaaatttccaggcccagatgacttccttagtgaattcccatgaacatttgaggaataaatgtaattgcaatcttaaacagtttcagaaaatagaaagaaggaatacttcctaactcattttatgaggccagcataactcgtatcaaaacctgacaaagtcattacaagaaaagaaaattacagaacaatattgttaatgaataaagaagcaaaaatcctcaacaaaacattaacaagtgaagtaaacaatatataaaaggataatactgcatgaccaagtgggtgtggttaataatttcaggaactcaacatcagtttaacatttaaaaaaatcaacataatattattaataaaataaaggagaacaataatatgatcatctcagtgtgtaaaataaaaaattcacttgacaaaaactgtcagcaaagaaggaatacaagagaatttttagagtctaataaatacatggaaactctacagctgtgtaatacttgataaaatactgaatgcagtttccctaagacccagaacaatgcagggatgctcattctgctttgtagctaggattaataagacaaggaacgattggaaaagaagaagttagacttcattaccactgtcatcattgtgtttgtagaaagaaaatcttaagaaatctacaaaaaaaaataaagctgccagaactaataaggacattagccaggtcgctagatataagttcaatatattaaaaagcatttgtattcctgacattttggaattgaaatttttaaaaatgctataaacaataacataaaaattctaaaacacctaggaataaatttgactgtagatgcacaagactctaagaactataaaatgatgctaaagcaaattagaattgaaataaatggcatagtatgtcatgtcgagggtcaaaagactcagtattgttaagataccgcatatccccaaattgctt

SEQ ID NO: 24963 - DNA, 1055 bp, Homo sapiens
atgaaaggggggagagaagtgaatgggatgaactaatttgcatagactaattagagcccacccctggagcctgggtgtggccatcttcccagagttcctgagctagatggagaaggggtacttctcagaaagggaaaatggatacccaatggcccaaacccaaaatagccccagttcccctaactttgactacagggcagtccagtttgggtgccgcttccgttgcactcacatgtcctacatatctgttgactactcacaagtgcaaatgcttattctcaactcaacattaacattttttctggcaacccaggttcactggttctcttccacagagcggccctgagcagctgagcctgcaagccacgcaagcatctgtttcttcttttgccaagtacaggaggatgtttgctctctctgtagagagctttctgaggtctctgggtgtacccagagatttaatagaaattcttaacgttaagtcacattccaggaaggaaggaagagttgttcgttcaaataagaaagataaatgttcggcactgtaggccctgtttaccccatctgaggccctgaattcatatattacaagacggaaggattttgcacagttttttatgtagcaagattttgctcaccactgaaaaatgtcagtgtaaatgtgaccgctttaaagatgagtcaagtaattcttggaacagggaaaaaaatgaatttgccaggtcaggagttcacctgcctttgtcagagttgaacccaaccactcttgacctcgactcactcccttagggttaagaaagcccaaacacattcctgagcacagagcaaacactcccatgtcactgaaaagaaacaaaagaatgctaaaaagtgctcagacctgatcacattttttccaatattttttcctttttttttttttttttgagacagggtcttgctctatcacctaggctggagtgcatgtttttgagacagggtcttgctctatcacctaggctggagtgcatgatcatggctcactatagccttgaactcctgggctcaagccatcc

SEQ ID NO: 24964 - DNA, 1034 bp, Homo sapiens
tgaagaatgcctggcatatgctccaaacagctagattttggtggccagtatggcctgaggggaatgcgatagagggagaggaggaggagttcaaattagagaagtgtagagctagtggagagaccgtactaaggactttggagagaagtgggaaccatgggagagttttagattgtatagattagttcactgtagggacagcagcagtggaaatagggagtcaaagcctgttgcagaaactcaagtgagacatggtagtgcctctgactaggttggcagcaatggacatactgagaattggtcagattctaaatatattgtgaaggtaagttgagatatgagagagatttttggcctgagcaactggaaggatgaaattaccatgaactgaaatagaaaatgctctgagtgaagcaggtttggacaagttaaatttgatgcatctactttagttattaaagtggaattgtggagtagacagctggatacatgaatccagtgttcaggaaagagatccaaactgaggacataaattatggagttcttggcatctggctggtattttaagtgatgagactgtatgaaatcaccaaagaagggagtgtagataaagagaggaagttcaaggaaagaccccgttagaggttggaagaacctgtaaaagagacagaggaggaacaggtaggtaggtaggtaggaaaaaaacataggcgtttgatgttctggaagccaaggaaatacaatttttgaggaaggagaaattaaccacattaaaatgctgctgatagatcaagttagatgaagactgagaattgactattagatttagcagcacagaagtcatcagagatcttggaaaaaagcagttttggtggaatagtctaagtgaaagcctgattgaagtaggtttatgagaaagttggaaactgagtatagacaatgttttcaaggagatttgctgtaaagatctgcagagaattggagtggtagtctgagtatgaagtgggaacaaaagagggttctttaaggtgagg

SEQ ID NO: 24965 - DNA, 1049 bp, Homo sapiens
ttatcttcctgtttccataataggccataaatctaatagacaaatttaagatttcctatttctccaacccccttccccaccttggattgggtatatctcttctgtacttcctttaaactctgtgtatatctctaaggttatacttcttacattgtatgaaaacactgtctgtacccgcattgtaccatgcattccatgagggcagagaccatatcctgtcatctttcccctgcacctggtacatagatgattaatgtaggcttaaatgaaaaaaataatcatttacctttttggattataccttaagccacttttgattacattcatactttcagattttatgtaaagtttagcaaatacttaatgcacaaagtatattaagtcatgattgttactttttaaaatgtatttatcagttatactttttcttttattaatcaatactatgatttttttttctttcacttcagtgatggagtgcccagtgatggaaactggctcactttttacctcaggaattaagagacatttgaaagacaaaagaatttcaaagactactaagttgaatgtttctcttgcttcaaaaataaaaacaaaaatactaagtaagtgccatcagttttaaaatacactcacgttttaacttttccccagaattgttatatatttgctaccttattttatcaagtacagaaaattactaaaatgaccattttgttaactgataactttttaaatttgatccttcctatctccttcaactcctgttagttgggtggttttgatgatttaccctaagtgtgacacagttgaattttcagcagtgaggctgcagtgacccaagacagctactttctacagcgcagaaaaaaactaccaacatgacttttctggaacagatgtagtaagagtagcaggttgttctggcatgttgtggcaactggatgatgggtagccttgaggaggtgggctcacactgggtgcttatatatacgtgtgtatatatataatgtatatgtgtgtgtgtgtgtgtgtgtgtgtgtgtatac

SEQ ID NO: 24966 - DNA, 1066 bp, Homo sapiens
tagcttgttaaactgtggtatgattagaatgttggtggttgtgtagtgcatttggggtgctacaacgttaatcaaatataattgagctgttctgtttccagtcagtgtaaccatttaaaaataccttggcaaaacaagctaggagctagttcatgctaatattcttaaggacaaaaatagtttacagcttttttttttttaatctgaaatcctgaaggctatgcttaaaagttagagataaacctgttggaaataagtgattcatttatagactgaagcctctatgacttcaaaaagatactcaacagtctctggcatttgaagaacaaaatattttctctgtaaatacacctcatttccattctagttaggagcaatggcgcccaggacggcacacagaatggagaaaactggatagctggtaactcatttagctcttggcactctaaaaaacctcaaatacagccatccaagccagtaattctattgctgcgttatttctgtgtttaactgtgaaacttgcttcttgtctgtacccttgaaatggaataaaatttcatgagactccttgttaatgtagagaaaagcaatgactgttcagttggttgtacactaaggcctcagtccttgacctttcccattttgctcagtgttttaaatatgatgtaagggcctgtgcttccagatatttttttctccagtctcatttttgcatttgtatggctcatgtacttcaaactgttggtacatgttccaaaaatgccagtgtttaattcaaaagagatgaatgtgatctactccagaatgcttcaagtcctgtccactttaactccaaagtaatctcaaatgccaccgcagttcaggccaccagcatcttacctagttactaagtgatttttgcatccacttttgtgtatctcatcttttaacagcaagagtggtctttggatgtagtttaccagtttaaaatctttgtctttgcctaggtggtctttcatgaactattcagcttcatctgccttttcctcttcgtcactatgtgctgtgtagttggcagagcttgtca

SEQ ID NO: 24967 - DNA, 1062 bp, Homo sapiens
tggggagaaccttaggtaaatatagctccttcatctatccagtatgcctactgttaacattggacaaagatcgaaactcttggttgtattaatatgtgatagagaatgtgttagcagctcataggagataattggtttacgttattgattagggtgggccaggttctgatgtggaatacatctcattgacttaatcaatgagatttatttctctgtcatgctatgtgttcatttcaagttggtcattgtaggaagtctgaccattgtagactggttgctgttgcagagggagggagttttgcagggtcttaaaccatcagtttaaaattccaggaaacatgttaatttctgctcaactcattttccagaattagtcatgttgcccaatacaagcaagggaggcataaagtgcagtcttaccatgtgtcaggaagagagctggaatcatgattgctacaattacaacataaactttgcacttataagactggtaatattttctagtgaggtgctactgagtgatctgatccattgtagtttctaagtcttgtagttttttcttctggcctttcctggtacttttgagaacaaaaagagtgaacagacatttgttcaacaccttcagtgagcctagcactgtactgattgtctgtcctaagtacgtgagctcctgctggcaaaagcagtggggtacagcggttataggtgtggattctgagcttagacaacctggcttcagatttgtctgtcctgtttgctgcatgtctttgacaagtttatgccctctgtgtcacagtagcctcatctgtaaaaactgcattaataaaacctaactcagaaggtggtagtataatccatgtgacatggcacagtgattggctcacattaagtataaagtgctagctgttgttagttttgtggttggtactatttctcccattttataggtgaacaattgtggttcagagagataagtaactttattagttcgttctcacgctgctatgaagaaatacctgagactaggtaatttataaagaaaagaggtttaattgactcaca

SEQ ID NO: 24968 - DNA, 1027 bp, Homo sapiens
cttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattctttggaaggagctcaagtgattctgtccttagtttaattgtagatgggatggatccatttgggtatctctgcccttggttagttaacattatgcttgaaaaacttgggcttgaacacttctaggtagtagcctttttgcagtgataagaagttctgtttgtccttgttcctagttctgcctacattccagtctctcacctaaatttcagaatcagaatgagatttatcaggatgttgttttgaaaatatgtatacacaatcattattcatattactgttactttattgctttttagatgacttacctgtaatttttttttcttccacagtcctttgttcccgatttctgctctgtcacttccctctcctggcaatgaacttggctgccgcaggcagggggcagggccagggaatgaaattccagagcagaaagaacaaagtcagatatctcaaaatatcatcctgccccatttaatctgggccttttatccatgtggatgcccctttctaaacagcacctgcgctgggctgcgaggcccctgcctgcctgctgctggttgggcagggcagatacacctttctccacctgaggactgcgttctcaggtaatctggctaaagcaatattccctccattttaggcattcttagattgcttttatgatttgtgctattttaccataccacatgtaatttttacttcatgcttttgtgtaaagcaactttttctctttttgtttattttttattgtggtaaaattcacataacataaaattcgccattttattttcctgccccccccttccaaaattcaccattttaaagtatacaattccgtagcttttagtacatttacagt

SEQ ID NO: 24969 - DNA, 1074 bp, Homo sapiens
aagtgagaacataatgacatttggttttctattcctgtgttacttcacttagaataatggtctccaaatgcaaactttttttttttcttttttctgagacggatgctctgtcgcccaggctggagtgcagtggcatgatctaggctcactgcaacccctgcctcctgagttcaagcgattctcctgcctcagcttcccgagtagctgggattacaggcgcacaccaccatgtccagctaatttttgtattttagtagagacggagtttcaccaagttggccaggctggtcgcgaactcctgacctcaaatgatccacccgcctcggcctcccaaagtgctgggattgtaggcatgagccaccacacctggccacaaacttttattagcatttattttattctgaatttattcccatgccacaagtttttgtttttgtttcttcagttacttttgagatatctttttcttcaattcaacttcctcttctggttaaagaataatttgttctggccgggtgcggcggctcatgcctgtaatcccaacactttggaaggccgaggcgggcggatcacttgaggccaggaattcgagaccagcctgggcaacatgctgaaagctggtctctactaaaaatacaaaaattagccgggcatggtggcactggcctgtaatcccagctactcggaaggctgaggaaggagaattgcttgaacctgggagtcagaggttgcaatgagccgagatggcgccattgcactccagcctgggtgacagagcaagactctgtctcaaaaaaaaaaaaaaaaaaaaagaatttgttcttttcagtaaggatcatctcgatgtggcaggcagaggtcacgtatgggttaatctgaccatgagctctgtaagtccagcagtgcatcttgggtgctttgttcacctggataggctcaatgatcagagaatctatatccaaaaccttaaattcagcattactctgcatttttaagcatgtgcagcaaaaattcagtactctttttgggccagcaaccctgtatctagccccactgtctggcctgggcacacct

SEQ ID NO: 24970 - DNA, 1067 bp, Homo sapiens
gttggccctaccctgctgaggaagtttatcagggtgggctcccttcctgcacttcctgcgcttggagacattggagagcccacattgaaaatctcttcagttaaccacatttaagtcccttcagtccaaagaggaaatggccactggagtctgctttagttcccacaagctttgggttgctccttcctcctgttcacatgttaatgtctttagaggttcagaggggcatggaagctactgagagactgacttcctggggaaaggaagataacttgtaaccttaagttggtgttttctttttttttttgagacaaagtctcgctctgcagcccaggctggagtgcagtggtgcgatcttggctcactgtaacctctgcttctgggttcaagtgattctcctgccttagcctcctgagtagctgggattacaggcacgcaccactatgtctggctaattattgtatttttactagaaacagggttttgccatgttggccaggctggtcttgaactcttagcctcaagtgatctgccctccttggcctcttaaagtgctgggattataggtgtgagccaccatgcccagccggtgttttttctctcgaccaccagccttttattatgttgataatgtgtatttggagatgataattattatcaagaactatactaaagagagctgaaagcagtgtgggctttggaaagtatatgagatttgaacttggaaagcctgtttttttggtttttgtttttttgtttgtttgtttgtttttgagacagggtcttgctctgtcatccaggctggagtgcagtggcatgatcatagctcattgtagctggaagacctgtttcaagcctcagatctaccaattatgggccaggcaggctgggccaatcactaaccttgttgggcctctgttttcctacttgtaaagcgaaaaataataatacctgactttacaaggttgttgtgagcatcagttgtaataatttactatgtgaagtactttttaaactgtgaagcactctacagatagaagggattattatcattgttattattatta

SEQ ID NO: 24971 - DNA, 1028 bp, Homo sapiens
atttaggattcagatccaggttttctgagctttctctgctattgtctgtctaatataaattatattgtcattcttagttaaaaaacctgccatatttttactattgtgtttctattttgtaaatgaagcatattcattgctatgtagcctgttgtgagcccatatgctttgcatattagtttctccttaaactttctatatttaatatgtgaccctaaggccgggtgcagtggctcacacctgtaatctcagcacgttgggaggccgaggcaggtggatcacctgaggtcgagagtttgagaccaacatggagaaaccctgtctctactaaaaatacaaaattttccaggtgtggtggtgcatgcctgtaatcccagctacttgcgaggctgaggcaggagaatcacttgaacctgagaggcggaggttgtcgtgagccgagattgtgccattgcactccagtttgggcaacaagagtggaactccgtctcaaaaaaagaaaaaaaaaagtgaccctgattattcattcattcatttagtaagcaggcactatggcatatgaatgcagtgactttcttaaaaggtttaggagccgaatacctagaagttaattcatatgaggctgcagaagtgcttcaaaaattactgtatgattaaatgccacaggataccacaagatattatagaattaaaaaattatggctgggcatggtggctcacacctgtaatcccagcactttgggaggccgaggcaggtggatcatgaggtcaggagttcaagaccagcctggccaagatggtgaaaccctgtctctactaaaactacaaaaattaaccaggcgcagtggcaggcgcctataatcccagctactctggaggccgaggcaggagaatcacttgaacccaggcggcagaggttgcaggcgccactgcaccccaccctgggtgacagagtgagactctgtctcaaaaaaaaaaaagaatttaaaaattatttggctacaatacaatgcttttaaaatccatct

SEQ ID NO: 24972 - DNA, 1073 bp, Homo sapiens
ttcctttttatctttagagtttagcagactctcttctacctatcttcccttctctcctcaaaaaaccagacttttatccaaaaagcatgcaagtcccccaagtatttaaagctttatttctttgtttgtccagtaaatgttcgttgagggcctactatgtgcaaagcaccatgcttggccctgtgtgaagcaaatattaaggcaatgaggtggagtctgatctcagagctgtgttgtgcatgaaataaggttattctttggtagttctttcttgagaagaattcttatggagttcagtaacctcttcttgaggcagaagtaaatgctcagggatttgggaactaattatctcagtttggtagaattgaaaaataagtctttggtgttgtgtcatctgtgtcagtgacagcaaagctggacctgtgctaggccctggtgggtcatctttaagcactggacttttatcttgttaggaatatagaagcaagcgtctcacatctctgacagatgggctttacggcttggcctaaagctctggttgtttttaaggcccttgaataaaaataaaagacgatgtttgcagattttaagaggaagttttttttttttttgagacagagtctcgctctgtcacccaggctactggagtgcaatggcgttatcttggctcactgcaacctctgtctcccgggttcaagcgattctccgcctcagcctcctgagtagctgggattacaggcacccgccatcatgcccggctaatttttgtatttttgtagagatggggtttcaccatgttggccaggctagtcttgaactcctgacctcaggtgatccgcccgcctcggcctcccaaagtgctgggatcacggggatgagccatcgcacctggccaagaggaagtattttttttttctatcctgctctttctgaaaagcttgaacatttttctgtactttccttttcttttttgagacagggtcttgctctatcacccagaatggagcacaggggtacaatcatggctcactgcagccttcacctcccgggctcaagcaatcctctcacctcac

SEQ ID NO: 24973 - DNA, 1050 bp, Homo sapiens
ttttgagaaatgtttatttctagatcttttgcccatttttaaatcagattgttagattttttaaattggattgtttgagctccttatatattctggttattaatcccttatcagatgggtaatttgcaaatattttctcccattctgtgggttgtctcttcactttgttttttcttttgctgtgcagaagctttttaacttgctgtgatctcatttgtccatttttgcttgattgcctctacttttggggtataactcaattaatctttgcccagaccaatttcctggacagcttcctccatcttttcttgtagtgatttcatagtttgaggtcttagatttaagtctttaatccatttcaattttattttttaatatagcaagagataggggtctactttcattcttctgcatacgaatatccagttttcccagcaccacttattgaagagactatcctttccccagtgtatgttcttggcttctttgtcaaaaatgagttcactgtagtatggatttatttctgagttctctgttctgttccattggtctgtgtgtctgtttgtatacaagtaccatgctgttttggttataatagctctgtagtataatttgaagtgaggtaatgtgattcctccagttttgttctttttgcttaggattatataatgaccttccatgtctctttttataagtttttccttgaaatttattttgcctgatatatgtgtatatcgattcctgttctttttcggtttccatttatatggaatatttttcttccactatttattttcagtctatgagtgtctttataggtgaagtgtggttcttgtaggcaacagataattgaatctttttttaatcgattcagctactctatgtctattcattggagagtttaatccattgacattcagtgttatgattgataaggacttaactgctggcttttgttatttgttttgtattctcttccttccttcctgtcttcttcttttttgtgaagtttattttctctggcagtatgttttagtttcttgtttttta

SEQ ID NO: 24974 - DNA, 1020 bp, Homo sapiens
attttttatttgtggtgtccccaggtgctcacgtagtacttagcacaaagtagtgttcaataattgtgttgaataaatagtgaatggattctagagctttgatttttaggacagcttttgtgaattgcttctggatttaagaaaaaaaaaaatatatatatatacacacagaatgtatttttattcaataatattgacaaatcattaattctcttccctaatctctaaagtgtcattacaaaaaattgtttaaagattcttgaaagaaaatcatgtttgtgtgggaaagtgttgtttgggttagactccaaaaagtaacaggtatgtttgtgtttatggttgaaaagaacattaaaatacagctggaagcaaaatcactttcaatgttcatctaaggattttaggggtttctttcaggttcagcaagtcaactcttgaggacctattttcctgaaggaatgagtgaaactttaataagaaacattctctttggagccgtgagagggttgaactatctgcaccaaaatggctgtattcacaggtatttacttatttgtatttattaaatgaaataattttaatggaagaactctttgaaggaggttttaggaaggagcagttgaatattagaaaaaagggataggaaacttgtaagtgaaaattgagggaggaagggaccattaggtgcagtggattgcttacattttatgtccattcgccaaacatgttcagaccacatcctctgtgccaagcagttattgggattggggtggagtgcctgccctcatggagctcacagtctcaatctaatgaggatgttcaggagatgagctgtaggaaatgggatcctagttagctgggtgtttttcgttttgtttttgtttaagcaaatgaagagcttcattatctgctttccatcttatgcataaattggaattaaacttttctttgatttcttattttgcagtaccttgagattatcatcctaaatatcacttctcttgttaccaaagtgtatat

SEQ ID NO: 24975 - DNA, 1032 bp, Homo sapiens
aatacatagggagctggggactctttttcttattttctttagcatccaatacttttgcttacagctatccatagggatctggcatcttgaaccaccaggattatggaagccctacagcaagctaaagactaactgtaaagtcctttcagctgctttgtgaatggttatatctattgctaaaaggccttaatatcatttgcaaatagtttatgatttctaactatttttctagagtttaacacgtgagaaaaatgctactctctggtcacaggacttagaatagtgcctatttccattggtctgagatagagaaaaaagaacaagtttcttgtggagccgtggtccagtctgcaaattgctcctatctccagttgccatggtttccaggagaacgtggctctcatcttttcctgccctgcctgtacttctccctgtccactctgttctctattttccctcagcttcctaactgagaatgccagcagaagtttagagtcacagatggattgtaggaaacaatttggatgatgccaatacaaagctactgtggtgggcatatgctgctcccccaaacttcagacatttgggtttcaggttggtccaggcaatcaacagtgatccttaatacaaaatgtcttggtgagagcaataatcaagaaacttggccaaagtgcttccctgccagattgtgtgcttaataagataactgggttccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaagataactggg

SEQ ID NO: 24976 - DNA, 1055 bp, Homo sapiens
gtgttttggtattctaatgtaacttatgtagattggtaatccttaaatgctttgggttcaggtgctagggaaagtcagtggatacttcgagattagaagccttgcttgtggagtgttctcagctgaaggcttccctctaccttctaggtaaaccaagcagaggtcaagcagctcccaaggtggcaatgactcagcagctccggcagcaatagactccatgcctgaccctgggatggcctctgaagccactgaagctattctttcctcttgagaagaggctaactttggaatcagattagacagggaagccttcactagccagaaactttgatatgaaagagtccctcgggaatggaaaaggcactttaatacatccaattctgagccttactagaattttttttctttccattcacctctcttctttaattccggtgcctatttcctggctttttctagtacagtggcttcattccctggcagccgtggggactcaggagcagactgggtgctgctgtttctcttgccccgcttggcctcaaagtttctgtagttctaaagtacaacagaaacagttctgtttttgttttaattaacaggctcacacacatggctcgtgtgtttttcaaacgcatgaaatgaaaaccagtgacagttctcgcaggagcaggaagccgcatgtatacagttcgtgcaaagcagcttttctttaagatcctcccgggttttgagcatcacaatgggtatgtgaggtcatcttaacctgtgaagattttggcatcaaggaagggaaaacagtgattgtaagtctctgaaggtttacccagtttttgttcataaaatgacaccttttaggttaaagcatgcctctcttaacaccacactaataccgcctgttaagaatgtttgcttttagagtaggtggaaggctcccaacggggttttttccttgcaaattaactgctgaaggcacttagacccttctacagggaaagcccagtggctgctcctctgagtgtgtccccttcgtttcatcagcactgccttgtctttca

SEQ ID NO: 24977 - DNA, 1017 bp, Homo sapiens
cacgtggccccgccgtttggggagacccgttctgcattagaggattttatttcctcccgttgaaggggtgggcaggaggcgtgttagaatttaacagattatagggaattcggactttattctagatgttttgaggaatgatcgaaagattttttttttttttgagatggagtttcgctcttgttgcccatgctggagtgcagtggcgcaatcttggctcactgcaacctccgtctcccgggttcaagcgattctcctgccttggcctcccgagtagctgggattacaggcctccatccaccaccacgcctggctagttgtttttgtttgtttgtttgcttttagtagagacggggtttcaccatgttggccaggctggtcttgaactcctgacctcaagcgatccacctgcctcggcctcccaaagtgctgggattacaggcgtgagccaccgtgctcggccaatcgaaaggatttaagcagaggaatgacctgctaatttgtcttaatacggttactctgctgtgtggagattagactcgaggagataagaacggcagcaagaatacttttgcattcatttggacaagatgaaattgcctggtatggagagaaacaaatatcgatagaaattgtgaaggtagaacaggaaggactggctaatagattgaatgtggggttttggtttaaataagatgttaagaaagtttcttggggaaggactaaagatttccggtttgggctgtgcgaagcttgcgttgtctattagacctgataatgcagttgtgtagatcgggcagttcagtatttcagatttgaagcttaggggaaaacatctgggctggtgatgtcagtttgaggtttggttgttttcgtggggaaagtttgacaagttcgtcagcactgaaatggttgaatggtaagacattcgtatcgcaagatgctgttgagatgttaggaagaatgagtgagattgagtgccttttcttgtgcggtgcaactcttctgaggtctgtg

SEQ ID NO: 24978 - DNA, 1219 bp, Homo sapiens
gtgcagtggtgcacacctgtaatcccagctactcaggaggccgaggcactagaatctcataaacccaggaggtgaaggttgcagtgagccaggattgctccactgcactccaggctgggctacagagcgagactccatctcaaaaaaataaaaagaaaggttccctgccctaccccctaggaccccatagctccagctacggcccaaggctggggcaggaatatctcttgaggccaggtagattctagactgaatagccactgtactacagctgactggactagatctgaattccatttagctgttaaatgggcaattcgaactagtaatttgaccaaaattacatgcagggtaagaaaactagttcattatcttagtgaaagaaatagcttctacaccttcattttacatgtaaaattgtatttgaagaatgcagctgtatatgcctcacctgtaccatttaaataaaactatttaaacattttattacaggttctaaatgagaagaaacttcaagaggttgatagtttatggaaagaatttgaaactccagagaaagcaaacaaaatgtaagtactcttgaaatcaataatttagcagttaacatttagggcttgttttattttttacatttttccctgatttatataatgttacattcgtagttttctgttttgaaatctgtttcaggaataattttggtatgaacctaattattacaaatgttttacttggaatataggccatctcaattaatttgaaggcagtagtctcccccttacccacagggattatgttccagaagaccctgtggatactttaaacctcggatagtaccaaatgtgattgctgtcagtaggaacacatttgtcttcgtgtcttccacacacaaatgtaataccttttttatcttaactaagcacttaccgcacacaggggttgtaacctgctttttgagttttgcaacatcaaaactagcatgaactactttttctttcatcacaatttcatggaagattcattcttagtgtagatgttaaatctttggtttttttgtttgttttttgagacagagtcttgttctgtcacctaggctggagtacaatggcgcaatctctgctcactgcaacctccgcctcctgggttcaagctattcttctgcctcagtcccccaagtagttgggattacaggtgcccaccaccatgcccagctaatttt

SEQ ID NO: 24979 - DNA, 1035 bp, Homo sapiens
ttcgtatttgtatgtatatttaagggaccacactagtatgttcccttaccagataagaaaaccttgcttaagatgacactgttgcctggtgtggtggctcatgtctgtaatcctagtactttgggataccaaggtgggtggatcatttgaggtcaggagctcgagaccagcctggccaacatggtgaaaccccctctctcctaaaaacacaaaattagccgggcgtggtggcacatgcctgtaatcccagctactgggaggaagctgaggcaggaaaatcccttgagcctgggaggcggaagttgcagtgagccgagattgcgccactgcactccagtctgggtgtcagagtgagaccctgtctccaaaaaaaaaaaaaaagatgacactgttttaggcaactagaagactagttttccttcttaaagggttatatgctttgttgggttaatctgattcgttgttgtcaatgatgtattcttcttggaactgaatctaagtgatctgactcaatattcgtcactaccactgagacaacgatgaatcaactatatgtttctttctggataaaatactaccctgaggctgggcgtgatggctcacacctgtaatcccagcattttgggaggccaaggcaggcggatcagttgagcccaggagttcaagaccagcctgggcaatataggaaaaccccatctctaccaaaaacaaaaattagctgggtgtggtggtgcacacctatagtcctagctgcttgggagactgaggctggaagatcctttgagctcgggaagtcagggctgcagtgagctgtgattgcaccactgcattccagcctgggtgacagagtgaagtgagaccctgtctcaaaaacataaagggggccgggcacggtggctcacgcttgtaatcccagcactttgggaggtcgaggtgggtggatcacaaggtcaggagtttgagaccagcctggccaatatggtgaaacctcttctctactaaaaaatacaaaaaaattagccagccatgggggct

SEQ ID NO: 24980 - DNA, 1050 bp, Homo sapiens
gtataataaagtcatctctgtacagctttatgcaacaggggtttgtattaaagcttcaacatctttactcttggccaaaatttcctccaaagcctacaactttcttttaataatccaagcattactagcctaacatttagaaaaactagtaattgtatgaagaatatctaacttcacaccctgatacacaatggtaggcatgttttattggtgtgtgctttggaaacagtcaagcacttctttccaagttatgtggcttttgaatcaacgcactgcccccaataacatgtttatctcttttttttttaattctagagtaaagctaaaacattttgagaaatttcaggatacagcagaagcattagcaggtaaagtaaaaaattagaagcttgcttttttgaaaaaattaagtcttagccgtttgtttttcttgtttaaaaggttgtttgcttcagttgcctgtgttaaccttattcaatgttgtcaatgatgcattcttattggaactgaatttaagtgatctgactcattcgtcactaccactgagacaacattgagttagcttttttcaccatagggctggttttccccatgtgtgaggagaggtgagaagtggttaagttgatctccctgtggaaaccagcaacataatgctgaagcacaattcagtaaaaggtgttctacaagggaccaaggtaatgtggtcaagtatacagctctctcctcattttaatccaagggtagagttgtaatcctgagaacagccaggattcacagttgaaaaataatttaaaaagctcttctgggggtatagatttttagttcaaaaaaacatatcaatattcagagttatacagaaactgacagaggtgttatttttaaaagattcagaagaatggatgactcatactcttcaactagatttcatcacgggacaacagagtgatcgggtttatttactgtaattgactgcagtaggtcttacagttttgtttttttaagtgttagggaaaacaggaagagcagatataaagcccaaatcattaaatt

SEQ ID NO: 24981 - DNA, 1066 bp, Homo sapiens
gatctcaagtagcctcttctgaattcctttttgcatacgatctttaatctgcttgggatatatctggccagtccttattaaactgtattaaatggacaagccaagcttttgctcaaacaagcaggtttttactattaatacctaatatattgagcacatactgattgtcagatttatgcttatgatttcataattgttatttaattcttgaatcctgtgaggcagataaccatcatctctatgttacagatgataaaacttgaaatttaagcagtatttccagattcatttacctagcttctttgtattatttaaaataatgtacaataaggctgggtgcggtggctcatgccaggaatcccagcactttgggaggccaagacaggcggatcacctgaggtcagttcaagatcagcctggccaacatggtgaaacctcgtctctactgaaattacaaaaattagccgggtgtggtggcacacaccttagtcccagctactcgggaggctgaggcaggagaaacacttgaacctggtaggcagagatagcactgagccaagattgcaccactgcactccagcctgggcaacagagcgagactccttctggaaaataacataaaattaagtagtgtacagtaaatggacaaaatgccatagtagttgagaatttaaagtcaattccccccagtctaagctccatgagggcagagactgttctgtactgtcaaattcctagacgctagcaaagtatacagctatagaaggtttataataaatattttggggaaaatgaatgaaaatagtgaattttatcaggaatgctgtcatagaaacatttacaatgccttttcctatctgttttcaccagaaagttaaatgaacatcagctaattaagaaagcagaatccttcccctgggaattcagttctcactgcctattataaggcagttttgacatgacagaaccacaactaaatggctgtaaatgtcacagtgtacattttaaacctcatagccttagagtttgatgagaccaggcacagtgactaacacctgtaatccca

SEQ ID NO: 24982 - DNA, 1080 bp, Homo sapiens
tttagtagagacagggtttcgccgtgttggccaggctggtggtacacaccaccatgcctgggtaacccaagcatacttttacctcagtcaaatgtcagataaatttcagaagaggtattagttcgtgtgggtccagaaaaagggaatataggtctaaggaagggtgagaaatataaagcagctgatttagaacttgccagaaataccagcggtctcaaaatagaataggcagcctttgctactaagttttacattgctggaggtgtacaagtggagatacaagcaaagctaaggccttcactcaaacatgtttatattatggcagaactttgaaaatgattacactcatttttactagttttgatgtgattttaggatatttcaggacagtctatttgaaatgacaaaggaaagtgagtctgttttgtcttcccaaaaagattgtttctaagatttcatgattctcccttgagttcatgagaagattcttgtgagaaggaaagaaaccctggacctgattttacccctggctctgtagcaaaaatgagggtgggaagatcaaatgaaattgtgaaacatgtaacttataaaacatatatcatttcatttcagaagtaacattaaattcaagccctttgaaaggcctattttatttttttaagtgtcaactagggcaaggtctcaaagttaaaaatttgagagttaatgcttttgtttttctttttcttgaaaagcattcacagctctgatggagggcaaaatcaataagcagctgaaaaaagttctgaagaaaatagtaaaagaagcccatgaaccgctggcagtagctgatgctaaactaggaggggtcataaaggtaaagtcacgatatttttggtcatgcctgctagtcagatctcacagcataccaactacaaagcctagcctttgcaataagttgcttatcataaattctcaatacatttttttcttttctctaagctacatgataatggatttcccctaacatcagctgaactgagcaaataagtaatacctatttgttctagaagatatagaagaacaaaaaatgataaaaat

SEQ ID NO: 24983 - DNA, 1028 bp, Homo sapiens
taatttttgtatttttagtagagacgggctttcaccatgttggcctggctgatcttgaactcctgacctcaaatgatccatccgccttggccttccaaagtgctgggattataggcatgagccaccacacccggcatttttttttttttttttttttttttgagtcagggtctcactctgttgctcaggctggggtgcagtggtgcgatcttggctcactgcaacctggacatcctggactcaaacaatgccacctcagcctcccaagtagctgggactgcaagtgtgcgccaccatccctggctgattttttaactttttgtagagacggggttttgccatgctgcccaggctggaactcccaggctcaagtgatccacttgccttagcctcccaaagtgccgcgactgcaggggtgagccaccatgcccagtcttctccctatttttaattgcatgttaaccctatcatatttcattagaagtcccttagaataggcattattgctatgttgtgatacatctgttcatgaaaagcttaatactttggaattgcactacagttaacagggttgtgaagaaaataatggtaggtagttgctcaaaacctgtgcaactttgtaatcagtactgtcaaatagtaatcctaataaaattattaccacagttcaaaagacattttaagctaatattaaaagaaacactacaggctgggcacggtggctcacgcctgtaatcccaacactttgggaggccaaggcaggcagatcacaaggtcaggagatcgagaccacggtgaaacctcgtctctactaaaaatacaaaaaattagccgggcacagtggcgggcgcctgtagtcccagctacttgggaggctgaggcaggagaatggcgtgaacccgggaggcagagcttgcagtgagtggagatcgctccactgcagtccagcctgggtgacagagtgagactccatctcaaaaaaaaaaaaaaaaaagggagaaagaaacactataggccaggcgcagtgg

SEQ ID NO: 24984 - DNA, 1116 bp, Homo sapiens
tctcctgcctcagcctccagagtagctgagattcaggcgtgccccaccatgcctggctaatttttatatttttagtagagacagggtttcgccatgttggccaggttggtctcgaactcctaacaggtgatctgcccacctcggcctcccaaagtgctaggattacaagcgtgagccaccacgcccagtccaatatgacttttgtattacacagcttatcctatttgtcattcatacataaactcattcatgttacagaaataaaggtcgtagcagcacatatagtttttttttttaatgtgtattttctgttctcgtatggtgcatttctacttagctgatttttcttcttagaaaaaccaattacagctctgactacaggctgatttgagtaaaaacaaaaacaaaaaaaaactttaaggtgttaatttaaatgcttttcctagatgctatcttgctaatttattttcccctttcttcccagcctgtctcgatatagattgaagtttagcgctgataaagtagacacaatgattgttcaggcaatttgtaagtatagtacatgcaaagtccgatttgttgctctgtccttcatgcgttttcatactgttgaaactatcttttatgattctgtctgttgagaaagagaaaggaggccaggtgtggtggctcaagcctttaatcccagcacttgggaggctgaggcaggcggatcacctgaggtcaggagttcaagaccagcttggccaacatgacaaaactctgtctttactaaaaatacaaaaaaaattaaatgtgcatggtggcgtgtacctataatcccagctactcaggaggctgaggcaggataattgcttgaacccaggaggcggaggttgactatttggagattatatgaatcacagaattaacattacgttaattaattcatttgtatttttccatgaaaatgttaaaaacataagtgcaatctttgtagttgtgtattctgctgtgtcattaaatggtttttagaaagctcaaaagctgccaggcacagtggctcatgcctgtaatcccagcactttgagaggctgaggcgggaggatcacctgaggtcgggaatttgagaccagc

SEQ ID NO: 24985 - DNA, 1026 bp, Homo sapiens
tcctctttttactctgattattttttggaagaaggtggtggggagacatttaatgtctaaacttaaacccttaaatgaggaaaactgttatactaggtcaaacttcttcattttttttgttttgtttaggcatccttttcattggctttctactttttcttttgactatttgctggattttatataatttgttgaagagtgattctccctcatcctctgcaaacattccataggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtaaattttactcctggagaatctagttgtggtgttaccagctctatagtactaatttttctgatggcaatgatgatttttacacttattgttgttcacctgataacataaatatgagggtgttcagtcactacctcatctgatgccatcatgatttgtatacttaaaagggggaaatacatattaaaaggaagtaatttacaatcatcgtctgaataatgaattaaccaaaaatcaattaagatggcagagaaggccaggcgcgttggctcacgcctgtaatccccgcactttggaaggccgagtcagggattgacctgaggtcaggagttcgagaccagcctgaccaatatgatgaaacccccatctctactaaaaatgcaaaaattagctgcgcgtggtggcgtacacctgtaatcccagctactcgggaggctgagacaggagaatcgcttgaaccagggagggggaggttgcagtgagccgagatggcaccattgcatccagcctgggcaacaagagcaaaactccatctcaaaaaaaaaaaaaaaaaaaaaaaggatggcagacaattatggattgagccttttaattctgagtcttatgtctatatcttgtgatttttttttctttcagatttgaaggta

SEQ ID NO: 24986 - DNA, 1051 bp, Homo sapiens
gctgagattgcgccactgcgctccagcctgggaaaaaaaaaaaagaaaactgatgttaggcataggtgatgtacccagtacccagggttgtgtagctgctctttcataattgagggctccagtgttttagacaggaatttttactgtttttactcatatgatatttgtgacttaactttattccttatactaggtgattgaaatctctgaatatcgaacccagctctatgaatatctacaaaatcgaatgatggccattgcacccaatgttacagtcatggttggggaattagttggagcacggcttattgctcatgcaggtgatggttttaatgtaatttgtaaatatgagtgtttgaagtattttctggttaggattttgtttacatctttaaactacagctgttaaagaaattttagctgataacacaaaagtagatgatatgtgggagatcactaagggccaagtgttcaatgatgatttctatttgtttgcctgatttccttttggataatgaaggcatctttagtcactacctcttctgagacacttgtggtccattgttagaagtttgttagggttaattagaacaatcggatgaatgcaggaggataaaacagttaacattttcataataaaaactcactagacctagatttgaatacagttttaagaaatcactgtagagaaagaaaaaaaaaagaaatcactgtagaggatttgtgcccttgattgattaccttagtttcactattgagtgtgaggatgtaatatatttgactttcaaaaatattttcaacaactgatttataataaaactttgtatatgtgtatggcagtattataaggatgatatgctataattaaaatgctatgtaattgaatacctacaaatacaatgaagtactgattcatcatttttatgttacttggagacattgttataattcatcaaaaaagattatatcatctgcatcagagtgtttaaaatggcataactcctttttttttgtttgagacagagtttcactctgttgcactggctggagt

SEQ ID NO: 24987 - DNA, 1030 bp, Homo sapiens
caaatgtgtttctgtgggcattcacattttcttttttgtgaattttccaagctttctacaatagccatacattctgcaatatttatagtctataacttattatctctagttgacaaacatggttctttgtttcttaaattataaatgtctttaacctaaaaaaattaaatagtcattcagcttacaggtctgcttaaaaaacagaacattttttagcttgttttgaaccaatttttttaatgttcctgtgcaattagtactttttactttaaacatatgcacttaaagcatccattcacattttaggcactcatttcagtattttctttctgcttacattagaacaaaagcaaatgttgggttctatggaatcttttccatgtgcatgtatttgtatcctttcttgttcttgtgatcttgtgatgaagacttctatactaagcttggtttagattttttgttctgcttttttttttttttttttcccccattgagcagtgttctgaaagttggatggttcagttttcactttctagttaggtgtgaagacgttttctcctttcatttcccccatgctgattgagtgttttcctgtaccatagtaactacattgattactaaatcagaattcatttagctcaccacatctcttgaatgtgattgacctacttgaaaaatattaatacctttaacttttggaaactattagtcttcataaactaccccaaagccactaaaatgaaacaacattgtgtgcttatgtaagtattatctaatggcattttctttatctcttgagaattatttcaattccagatacttgttagagattttctaaaactttttgggtctttcagtgaagtgaagacttacgatccttctggtgactccacacttccaacctgttctaaaaaacgcaaaatagaacaggtagataaagaggatgaaattactgaaaagaaagccaaaaaagccaagattaaagttaaaggttagtttgaattttttttttaacacaacttatactcac

SEQ ID NO: 24988 - DNA, 1086 bp, Homo sapiens
tattgttaaatttatcagactgcacagaggaaatgtgagaagtttagtcaaattaggtattttactaagagttccaaaacttcatttctcctacatgaactatttggagaattaagagaaaaaaggaacgtgttttctaaattggttgttgaaaattttttgttttatagttaagaatgaatacagaattgatggaacagtgattttcttcattgtttctcttacacggagcggactggaaggaatacatactggtagcctgccgtcatagttacaatatctaacaggtgctcaccagttaactaggctgtcttgtgaagttgataagcaggcgccccattattagttacacctgggtttattgaacacctactagcaagtctagcagaagagtaaagcattaacacaatgattgctttaacttggtttctaagtagcttagtggtcaaaagtatatgatctacaaatgtggatagtatacttgatagagaaaacaaacaatttatttaacttttatgcttctttttattgaaaagtaaggagatccctaaacccactagtagcatttgaggcaccaaactctgtcctttgtatcctcaattgtgtatccaataagcttttccaatttatttgtcaatttttcatcccacaatttcccccctctttttttacccccaagacagaatcttgctctgtcacccatgctggagtgcagtggcatgatcttggctcactgcaacctccacctcccaggttcaagcaattttcctgcctcagcctcttgagtagctgtgattacaggcacgcaccaccacgcccagctaatttttttatttttagtagagacagggtttcaccatgttggccagcctggtctcaaactcctgaccttgtgatccacccactccggcctcccaaactgctgggattacaggcatgagccaccacgcccagtcctctcccattttctatatgtgacaattccagttgctttggccatcaaccttgacttttttctcataactcaatctagtctgacagcaaatcctctcagttccacttgaaagtatgtagtagccacagtgg

SEQ ID NO: 24989 - DNA, 1029 bp, Homo sapiens
ctctcccaactggtttgtagaaaatgaaatgacataaactttcagagatgttactaggcttcaaatttaatttgcttgaagtaaatgttgataaaatacatgcagccatccctagataaaattacataataaagctggttatcttgttcccaggagaacactgtcattttcgcatcacccactggtaccgcagatacattcctaatttaggacaaaacagacttagtttatgaccgacttttgatgaaaaaggcctaaccacctacccagctgcatagtcaaaaggtttacatgcaaaacaaggtaggtttttgagaaacctaaataataaacttccagttatttgaatagtcttctgcaggcccagagaaagcatagttaaatcatacagcaaccacctctcataagggctgaaggtttaactatttaaaaaactaaccaaaaggtaggttcttgttctacttggtactattgaaacacttctaatgaagagccttgtgaacttagtttgaaatcggaaactcgggtgaattttatatgcctagtttttattagtaaatttgaagaatttctgtggctgcaccacaaaactctgctgaaaacctactgattctccatttcccttcaaaaatgtaaatttctatcttccagtttaaactgctgtatctgtccattgccttctggctcctcagcacaattacaaggcccttgagtgagctgtcctctctcctccaactttggcgctctgttccagggctcttttagaaaagatttatttgctgcccgtgaagggttctctgatccatctgttgcttctcaatggccattttcagacttggctcaggctcatcctttatcccagctgtatttgtaccctttaggataacatggagtagggccaaatgtctcaaaccctagctagtgtgcataggaattatctagagaccttgcttgataaaatgcaaatctgatgctctattagtgccaccagagcaaaaaaaaaatgcaggtctgggttggagcccaaga

SEQ ID NO: 24990 - DNA, 1442 bp, Homo sapiens
gggtggcgagggagggagcccgcagaggccgaggcctgtgcttgcccttcgccatgcgtccccccgatcgcggtgcagcggagctgcgacccggtgcctgcgcgcctgccccatgccttccagggaaatcgcctttaatattcttgtgtattttcctatccccacttccatattcccaccccacccccctttacggggtgaaaaagacatattgggtgtggtatcttgacatttttagctgtgaggtaatgcaacgattaaaaataatattttaatcaccagtgaacagtgcttattatgagatctctggaaacagacctgtagatttttaaaattattattataaagaagcggttttggcttatagtaaaaagaacatcaactagagaacacacacttgaaccttattttgaaatttagatcactctgggaatccatgttcctttcattattcagaaatgttaccgaatgaatagaataaatgttgaggaagccagaactgtgagattcttgatatattgtattatacggtttgataactttactgttagtcatctggcatctatctattggctttgctgtcgagacaactttgacctgacattagacttctaggagatttgactccgaaagttctttgacatttcactaaagtctaaagggtggtagtcatcctttcctttggatattttcatttcagttctcagaaaccttaggaaaaagaccttatcttctatttgcaactattttttcaagcagccttttggtgatttgcttttagaaattttcaggagtgaattctacatataactcgtacacttggtttatgatgggcaaatggattgtgcttttaaaacgagtaaaggaccaaatgaccctttcgaattactttttttcttttgataagtgtgtttcacattaaacaaatttctcattgctatgttagatacagaggttacttgcttattttcattttgaaagtctgatctaggaaaatgccgaagaaaatttgaagtttccttttatgcttttgctattgttgaataatgtctactgttgattaatgtctgttaaattgatgataaatctatatggttctgttaaaataatttgaacttctgagtttactttaaaactgatattttaatatttttaataattgtagttgctttcagagtaaaaatgatttttctctaaatttctttatattgtgttagctatttaaattctctagccataagccatgtggttcctgtaaaatatggagtaaaaggccttaaacgttccatgagcagaaatctcagaacataggcttttcaatgttatttgttattcttaacctttttagaatatagattctcatttatgatgacgtgctcataatattgtgatcagaactgataaaagtaagagaaaaagcatttatttaaaaataaacttaa

SEQ ID NO: 24991 - DNA, 1053 bp, Homo sapiens
caaactcctaggcacaagcgatcctcctgactcagcctcccaaagtgttggggctacagctgagagctactgtgcccagtctagacagtagttttaatgttagaaagccttgagggtactacttgaagcaaagaattatatttgaaaacagaattctaaacagtgaaataaatgacagtaccagaagaaagttaacagataggaatattaaaattactaagagaatatactctgtgggttgcatttatcacctgtaagttaggtgagctgattcttgaaatcttttcaagcccattttacttatttaggtcactaattatagagtttgttgtttagaagatggcatctaattaaggtaatgagagagcgagagagagagagagagagagagagagagagagagagagagagagagagagattcctgtgagattcagctgagtcatatcatcagtaattatcttgagaactgtgttggaggagcagtgaatttctgttgctaatgaatatttcattattgtttgaaggaaccggttgtataaaagattactcctggccgggcgtggtggctcatgcctgtaatcccagcactttgggaggatgaggcaggtggatcacctgagatcaggagttcaagaccagcctggccaacatggtgaaaccctttctctactgaaaatacaaaaaagttagatgggcatggcggcaggaacctgtaatcccagctacttggaggctgaggcaggagaattgcttgaacccggaaggcggaggttgcagtgagccaagatcgtgccattgcactccagcctaggcaacaagagtgaaacaacgtctcaaaaaaaaaaaagtaataataataataataatatttcccccaaaataactgacattcataaaatatacagagaaccatattagatgcttactagaagtaacagattaagtaaaatagctactgtttaacaaaagtaacttctccctttatgagtgcctgctatgtgtcaagtgaaatgcagtgtttttacatacattttccttagatcctcagagt

SEQ ID NO: 24992 - DNA, 1095 bp, Homo sapiens
gtcttacattagcaattaaatgctgtggccagaagtaacactttacttaggccctgagtgattaggatgatcagagcttgcctggtgacccataggaaatagaacacgagcaagaaataaacttctgttatttaaagccactgagattttgggattgttattgcatataatttagtttatggccgggtacggtggctcacgcctgtaatcccagcactttgggaggtcatagtgggctgatcacctgaggtcaggagtttgaaaccagcctggccaacatggtgaaaccccatttctactaaaaatacaaaaattaggcaggcgtggtggcgggtgcttgtaatcccaggtactcaggaggaatcgcttgaacctgggaggtggaggttgcagtgagccaagattgtatcactgcactccagcctgggcgacagagcaagtctccgtctcaaaaaaaaaaaaaaaaaaaaaagtaaattttggctgggtgtggtggctcatgtctgtaactccagcactttgggaggctgaggtaggaggatcactcgaggtcaggaatttgagacccacctgggcaacatagtaagatcccgtctcttcaaatatttaaaaactagctgggcgtgggtggcatgcacttgcagtcctagctactcaggagggtgaggcagaaggagtgactgagcgtgggagtttgaggcttcagtgagctatgacagtgccactgcacactagcctgggtaccaagttagaccctgtctctttaaaagtaaaataaaataaattgctctggttaccatgtagagattggattataagaggatgttgagaaaccactaaggaagtcattaaagttattcaggcgagatatgatgatactcaagactaggatggtgcattggataggacgtggtatatttagatggaatctagtgataatattgaaggcgggcttggcgaggtgtttcacacctataatgccaaaactttaggaggccgaggcgggaggatcacttgagccctagagttcgagacaaacctgccaacatagtgagacccccgtctctacagaaaatacaaaaattagccaggtgt

SEQ ID NO: 24993 - DNA, 1084 bp, Homo sapiens
aattcttatttatttgtttatgggtttatgacttatatttacaccattagaatataacaccttaagggtaggtgggcactgtcttattcccagcatttttcctggtttagaatactgccgggcacataacccacacctaataataagtatttgacttttttttttgagacagagtgttggccaggcgcggtggctcaagcctctaatcccagcactttgggaggccgaggcgggcggatcatgaggtcaggatatcaagaccatcctggctaacatggtgaaaccccgtctcttctacaaatacaaaaaaaattagccgggcatggtggctggcgtagtcccagctactcgggaggctgaggcaggagaatggcgtgaacccgggaggcggagcttgcagtgagccgagattgtgccactgcactccagcctgggcgacagaaggagactccgtctcaaaaaaaaaataaaaataaaaaataaaaaaaaaaaagtgttgctctgtcgcccaggctggagtgcaatgacttggtcttggctcactgcagcctcctcctcccgggttcaagcagttctcctgcatcagcttcccgagtagctggaactacaggcacgtgccaccatgcctggctaattttttgtatttttattagagacggggtttcgacatgttagccaggatggtctcgatctcctgaccccatgatccgcctgcctcggcctcccaaagtgctgagattacaggcatgagccaccgcgcccggcctctttaatgactgatttttgtgtagactccaggatatataagcctcttagaggtttaagcgtggcttatgtgcttttctgtggtttagctgttggctctgaattaggagagaacaatatatcttattgctgtttgggaaagcttggattattttgtcagtttagaattggtgtgtgtgtgtgtgtgtgtgtgtgtgtgtgtgtgtgtattttttgttttaatcagcttttgcttgtctttctctttaggtgtacagaaaagagttaaaatagcaggcctggggtgggggtggcagctcacacctgtaatcccagcact

SEQ ID NO: 24994 - DNA, 1021 bp, Homo sapiens
ttgtgggagctcaaaattaaaacaattgaactcatggagatacagagtagaaagatggttatcagaggctgagaagaatagtggcagagggggtaaggacagggcagaagtggggatggttaatgggtacaaaagtataattagatggaatgaataagatctaatatttgatagcacaaggtgactacagtcaacaataatttattgtacattaaaaataactaatagagtataattggattgtttgtaatacaaagaataaatgcttaaggggatgcatatgccatttaccctgatgtgattgttaactcattgcatgtctgtatcagaatatttcatttacctcatatatacctactatgtacccacaaaaataaaaaaattttttgtaagagatgctatcaagaaggtgagtaaaatattgcagtaagactaggaccactccccattttattattttatttctgaataagtaaaaaaatttatttttaatttttgtttttgagacagggtctcactgtcacccaagctggagtgcagtggcgtgaacttgggttactgcaatcaccacctcccgggctcaagtgatcctcccaccccagcctcccaagtagctgggactacaggcacacaccaccacacctggctaattttttgtatttttggtagagatagggttttgccacgttgcccaggctggtctcaaactcttgagctcaagcgatccgcccaccttggcctcccaaagtgctgagattactggggtgagccactgcacccagccctgaatatgtagaatttaaatatgcagatgctactggaatactaaagttttaaattcccatttatgtaagagaaggctacttgctggaagtaaatcggggataaagccaagaggcctggtatttgattttcggtaacagtctataaccaagtaacttacctactaacttatctagttacttgttacttgttatctagtaacttgttacgttattgagcactcatttatagtacttgc

SEQ ID NO: 24995 - DNA, 1056 bp, Homo sapiens
tgcttaattctcttatagtctatctttgttagtgtgctcagttagaatttggcctctgctgtattctgtcaaattgtcctctttatcctttctatagctctgagtttaacagatctttagaatagatgataaccagtggtgattgtttctttaatgtgcacatttttctttattcaaaaagatggctttctttttatttgacgtgtattttttgcattctctaacccaattttcttatacatttgggacttcaatttgtatctgcctataagcaaacttacttataattacaatttttatccctgccaaatcttccctgtgtataaattggttatcattaggttctaaaaagtttttatagagttagtttgaaaagctgttcttcataattgtgtacagtttctagagttttacatttatggacctaccttgcatgcaatatcttgaagacagaaaaagtgtaggctgttctcaaaacgttggagtgagaaagtaagatgtcctgctgccaaatataaagttgtttttatactgtctctctgctgaaaatcctttttatttttctcctttaagccttcctctttgattgagtgcactctcttcttttctaaggttttcgttttttggatacttgtttaacaaactttttgtcagctaccatttggcagctcactttcacaaccctcacactcctctttttacctacttttagttgtttggcaaacatctatatttttgtacaactttggcaaaaatgatttatcaatgtagctccatacctgttgaataaaaatagtagaaattatacatcacaagaaatagaaccttattaagaattttctttacatttaacttttaagttcaggggtacatgtgcaggtttgttatatatgtaaacttgtgtcatgggggtttgttgtacagattgtttcatcacccaggtattaagcttagtatttcattagttatttttcctgatcctctccctcctcccaccctccaccctttgctggccccagtgtgtggggttcccctctatgtgtccatgtgttttca

SEQ ID NO: 24996 - DNA, 1033 bp, Homo sapiens
ataactaatatagtactatattccagtcaagaatgcataacctgaatttaatcatgaggtaatatcacacaaaccccaaattaggaatgttctgttacaaaaagggggatcgcatttttcaaaaatgcgaatgtcatataaaacagactgtgggaaaggtctaggtcaaaggaagcaaaaaagactggacgactaggcagtgcctgtcttttactggatgagaagaatgtgataaaggacatgatgattagagaaaaatgttgtttcaatgttaaatgtgctgaagctgataatactgtggttttataagagaataaccatattcttaggaaataatctaagaagtgtttaagaataaaggaccatgattctactgtgtattggttcaaaaaaagattgtgtgtgtgtgtgtgtgtgtgtgtgtagaaagaggtaataaaagcaaacagtaaaatggtatcagtaggtgaataggtaaatctgggtaaaagtatatggtgtattctttgtactattcttgtgactgttgtgtaaggtttaaattatttccaaataaaaattttaaacaatttttaaagtttaaaaagttaaaatatagcacatctcaagaattttcttagtcaaccaattataacagaccatactctaggatcatcagttttggattatttcctttgatttgttgatgaagcactaaactgaaagcaataggaaattttctttatagctgtagtttctacctattgaaggccattagcttctattaggagattgtattgaattggatacatttatttttcacaaacaaaacaaagtctctaattttcacttgtacttctagctagatgaaagagagaaagtggccatgtgcggtggctcacacctgtaatcccagcactttgggaggccaaggtgggtggatcacctgaggtccggagttccatgccagcctggctaccaaggtgaaaccccatctctactaaaaatacaaaaattagccgggcatggtggcgcatgcctgtaatcccagcta

SEQ ID NO: 24997 - DNA, 1030 bp, Homo sapiens
aaaatccaaatgcaggcattatccagaaaaatttaacaggtttatttataattgttatggccaggcatggtggtttatgcttgtaattccagcactttgggaggccaggacaggcagattgcttgagcccgggagtttgagaccatcctgagcaacatggcaaaaccctgtctctacaaaaaataaaaattagccagacatggtggcatgagaccagatgcttgggaggctgaggtgataggatcgcttgagcctgggaggctgaggctgtagtgagccatggtcataccattgcactccagcctgagcgacaaagtgagaccctgtctcaaaaacaaaaacaaaaaaaaatcaaaagaacaaattaaataattgttatgaagttgaacttctaaaacttgttcactgaaatgttttgacccgcattaatgctttatgtcccacatttatattgaaaatccacatgcaaataaaaatggaaaaaccaccaatacctcatttctgttccttattttttcacttacaatcttatacttaggtgccttttgaccctatggggaaaaaataatgttcagaactactgagaggtgacagcgtgctggcagtccttaccgccctcgctcgctctcagcgcctcctctgcctgggctcccactttggcagcacttgaggagcccttcagcccaccactgcactgtgggagccactttctgggctggccgaggccggagcccactccttcagcttgcagggaggtgtggagggagaggcgcgagcaggaaccagggctgcgtgccacgcttgcgggccagctggagttccgggtgggcatgggcttggcgggccccgcactcggagcagccggccagccctgccggccccaggcaatgaggggcttagcacccgggccagcggctgcggggggtgcactgggtcccccagcagtgccagccaaccggcactgctcttgatttctcaccgggtcttagctgccttcccgcggggcagggctcgggcctgcagcccgcca

SEQ ID NO: 24998 - DNA, 1033 bp, Homo sapiens
aaccctgaagtctgggcattggaaggacaatttggaagggcaaaaaatgcccgcccagtccaaatcaggttaaaagatcccaccagttttccttatcaaaggcaatatcccttaaggcctgaagctcatacaggattacagaatattgttaaacatttgaaagctcaaggcttagtaaggaaatgcaggagtccctgaaacaccccaattctgggagtacaaaaaccaaacggtcagtggagtctagtgcaagatcttagactcattaatgaggcagtaattccactatatccagttgtacccaacccctataccctgctctctcaaataccagaggaagcagaatggttcacggttctggacctcaaggatgccttcttctgtattcccctgcactctgactcccagtttctctttgcttttgaggatcccacagaccacacgtcccaacttacatggatggtcttgccccaggggtttagggatagccttcatctgtttggtcaggcactggcccaagatctaagccacttctcaagtccaggcactctggttcttcaatatgtggatgatttacttttggctaccagttcggaagcctcgtgccagcaggctactctagatctcttgaactttctagctaatcaagggtacaaggtgtctaggtcgaaggcccagctttgcctacagcaggttaaatatctaggcctaatcttagccaaagggaccagggccctcagcaaggaacgaatacagcctatactggcttatcctcgccctaagacattaaaacatttgagggggttccttggaattaccggcttttgccgactatggatccctggatacagcgagatagccaggctcctctatactctaatcaaggaaacccagaaggcaaatactcatctagtcgaatgggaaccagaagcagaaacagcctttaaaaccttaaagcaggctctagtacaagctccagctttaaggcttcccacaggacagaacttctctttatatgtcacagagagagctg

SEQ ID NO: 24999 - DNA, 1049 bp, Homo sapiens
ggcttagcacccaggccagcagctgcggagggtgtactgggtcccccagcagtgccagcccaccggcgctgctctcagtttctcactgggtcttagctgccttcccacagggcagggctcgggacctgcagcccgccatgcctgagcctcccaccccctccatgggcccctgtgcggcccgagcctccctgatgagtgccgccccctgctccacggcgcccagtcccatcaaccacccaagggctgaggagtgtgagcgcacggtgtgggactggcaggcagctccacctgcagcccaggtgtgggatccactgggtgaagccagctgggctcctgagtctggtggggacatggagaacctttatgtctagctcagggattgtaaatacaccaataggcactctgtatctagctcaaggtttgtaaatacaccaatcagcaccctgtgtctagctcagggtttgtgaatgcaccagtagacactctgtatctagctactctggtggggccttatagaacctttgtgtcgacactctgtatctagctaatctggtggggacgtggagaacctttgtgtctagctcagggattgtaaacgcaccaatcagcgccctgtcaaaacagaccactcggctctaccaatcagcaggacgtgggtggggccagataagagaataaaagcgggctgcccgagctagcagtggtaacccgcttgggtccccttccacactgtggaagctttgttctttagctctttgcaataaatcttgctactgctcactctttgggtccatactgtttttatgagctgtaacactccccgcaaaggtctgcagcttcactcctgaagccagcgagaccaggagcccaccaggaggaatgaacaactccagacacgccgcctcaagagctgtaacactcaccgcgaaggtctgcagcttcactcctgagccagcgagaccacaaacccaccagaaggaagaaactctgaacacatccgaacatcagaaggaacaaactccagacgcaccacctgaagagctgtaaca

SEQ ID NO: 25000 - DNA, 1006 bp, Homo sapiens
gattgcttccaaaactacagtccctgctatgggaactgggacagatttttgagaggtccctgatagcaagtgagaggctgaatactttactaggattaattagaggtgccagcctcacaatagagtatccctaaaagaaaaatctgtgaaattttattctagtaaaatacaacttcatcttccttaaattgttttatttcaccagcgcaaatgggatctattattttgaaatatctctcggcaaccctattattatgagatatgcatcatatgcatatttacctgaaaactttttacttccagtatagagtaggttgccaagtaaggaattcataatacttggttcacttccagggaatccatttaaatctaatgtgctacagtcaataaactgcttctctgcagtgacaatccaatactagagttaggtagcaagtacatagtttataaaaagagagaaatgcagctatgtctaaagaagccatttttgctttcatagttgcattgagattaagaaacattcctttagtagtaaaactcagaatctttcaaatattaatgaatataaaaactagctttaattttataaattgccagggactcaagcatagtttagtcaataaaggggggaagaatagtttcctgataaaaatgaaagcatagaaaatagtctaaaggaaatacatgaaaatgttaaaccatagttatctctgaatattgagttcataaatgactttttcttcctatatgtttcagaatttacagtaaaaatgaactactttaacaatcacatacacatggttttgtttttgtttttgtttttgtttttttgagacagagtctcgctctgtcactcaggctggagtgcagtggcgcaatctcagctcactgtggcgtctgcctcctgggttcaagcgatttttctggctctgcctcccgagtagctgggactacagtcacgtgccaccatgcctgactagtttttgtgtttttcgtagagatgggg

SEQ ID NO: 25001 - DNA, 1051 bp, Homo sapiens
gcttggtttagatattgggggaaagttggctttataaaatgagttgagaagtgttcccttccttatctgtttttagaagaggttatgtagcattgatagtatctcttccttgactgccaaaatttccccagtgaaatcatcttggcctggagtgggtgcgggaagagagtgagagagagagagagagagagagagagagagagagagagagagagagagagagagtgtgtgtgtgtgtgtgtgtgtgttgaagactagtttagtgtggtaatgagaaggggagaaagagtagaacagggagtttgatctgtaagacagtgaacaatcaattgggagaactcactacctttggaatgtttttgttagaaaaattttaactataaattcagcttatttaatagatacaggactattaggttatctcttttttgaggaatgagctttggtagattgtgtctttcaaggaattggtttatttgtggacatgcagttgtggtatttcattattcatctgtggagtttgtagtggtggcatcctttcggtcattcctgatttgaatatttgtatattttctctttgtttggtcagaatggctagagaggtttattatttttataggtcttgtcaaagaaccagcttttagtttcatttactttctttgttattttttcatttcattcatctctgctctcgtctttattttcttcctcctacttgcttttggtttagtttgctcattttctggtttctcagatggaagcttacattactgatttgaaatcttctttttctaatagaaacatttaatgccatacatttttctctaagcagttgtttagctgcatgtcacaaagtttgatatgtattttcattttaattcagttccaggtattttctagttttccttgaggcttgttctttgacccacagattacttagaagggttttattcagtttttaaatattttgggatttttccagatagctttcttgtattgatttttaaatttgatttcatatcagagagcataccttattttatttcttttc

SEQ ID NO: 25002 - DNA, 1104 bp, Homo sapiens
atttagcatttgttttagaacaggtctgctgctgatgaattatctcagttttccttcacctaagaatatcttttttaaaaaaattgagacagaatctcactctgtcttccaggctggagtgcaggggcgtgatcttggctcactgcagcctctgcctcctgggttcaggtgatcctcttgcctcagcctcccaagtcctgggactacaggcatgagccaccacacctggctaattttatatttttaatagagacagggtttcaccttgttgaccaggctggtctcgaactcctgacctcaagtgatccacccgttttgacctcccaaggtgttgggattacaggtatgagccactgtgcccagcctaagaatatctttactgcaggaaattttcactagatgtagaatcctgggtttattgttttactcttttagctcttcaaaaatgtagtttgttgtcttctgtgctttctgatgagacatctataatcactggaatcattgtttctttgtatgtaatgtgttgtttttcactggctcctttaggagtttttttctttaatctttgatttttttagtagtttgattatttatgggcatacatttatcctgttcgtgttcacttaattatttatgtttctcatgaaatttggaaggttttgttttgtcaaatattttttttctgctccagtttttttcttttgttcttctgggacttcactgacataactttttgatattctcagatctctgaggctctttcctgtcttttttatttttatttttttgagatggaatatctctctgtctcccaggctggagtgcagtggcatgttctggctcactgcaacctctgcctcccgggttcaagcgattctcctacctcaacctcccaagtagctgggattacaggcacgcaccaccacacccagctaatttttgtattttaagtagagacggggtttcactatgttgcccaggctggtcttgaactcctgatctcaggtgatccacctgtctcggcctcccaaactgctgggattacaggcgtgagccaccacgcctggcctttttggttttttgtttcttttgagacagaatctc

SEQ ID NO: 25003 - DNA, 1028 bp, Homo sapiens
cttactgtttctttcttctgtcacattctgttattcagtccattcagtaatttttattttagtttttttaatctaaaattttcatttagttcttttttatagtttcaatttctgtatgaaaatgtttatcttttcattaatttcatgtgtatttgcccttacttcagaaagcatgattataatagctgcttaatttttgacaattccaaaatctgagccatcttagggttggtgtctcctgcttgtttgtacattttgaatattttacttgagactctgagtcctatttaaggcacctggaaatgttgagttttttcttttagcaggcaatcagactggttggattcatactccaagtgtcatcttaccttcagtgggctgtggttctaatgtcaatttacttttcacagtctttgcagtactatttgggtctgtcttttgtgtatgtacctcccaggagtcagtttgggacctgagtggtggtcggtatctatatcttaatttaggtctgaagatctgtgttatactattttgggtcagttcatacatgcacagcctttaggtgtgcctggaacttcatacatggatttaggagtgttcctttttcagctccctgttctccatgatttattttcacactctgtttcccaggagatcttgtcctcattctctgatgacaaagccaggatttttaacctctccacactatcatgaacttcctacaactggatatgcctctagaccaagatggtgacagagaggaagaaataacctggtttctctctgcactgttccagttacagagcctcagttcctctggtcagagggaaggattctctcagttttaggtgcctttgtggtcactgccgaagccataggagtgcagttttgtgaccagtacttgacttgggctagggccagaagagtaaaaaagagagaaaaagagctgggattccacccatagccttcatcctgcagggccctcctacctagtccattggccacaaagaaagtgtttctcctggact

SEQ ID NO: 25004 - DNA, 1079 bp, Homo sapiens
cctgaaatagtcaattaatggtaagataaaaggactctttggacattatttgatttatttatgagttaattgcctaaagcaaaatgataatgtattgtgtatatatagacattatacaatgtctacatgaaatgaatgacaatagtagcacaaagacaggaagcagcaatggaaatattaggcctaagagtcttatatgtaaaatgatgtatttttatttgaagatacagtgtgataagttaaagatgcatattataaaaccctagatagagcaactaaacaaaaagtaaaagaaatatagctaatgtgtcagtagattaccaaccaaaccaagattatgaaggaagagaaggggaaaaaagaacaaagaacaggtagagaaaatggaaaataagcaagatgataggttggtatgaccatataatattaaatactttaaccatttaaattaaaatacagagattatcagactggatttaacaaaaagtaagatctaattatatgacatctaccaagacattaaatatgaagaaacaggtttaaagtataaagatggaataagatgcactgtacaaaactgagcgtaggaaagctaatatagtgattactgtttaagggagacttcagagtaaggcatattaccaagaaaaaagagggacatttcaaaatgacaagggggttaatttatcaattgtaagagtgtttgcatcgaataggaaaaattcaaaattcataaagcagtgttcaacatttgtttcccagtaattaatagtataagtggagagaaaatcagaatttagaacacttaataacattgtcaacaaatataacctaagttgcattgtagaacactcagcgacagtgatagggacaggaggcagggaaattctgggcagaagagggtgagtccctggcgagggccccgccctcaaactgaaaaagcctggtactatatggcccagtgtgagaactgacatccctgtttgtccggtcagatgttgccttttccaaaaccactcatggcctgccccgcccctcattctgtgcccataaaaaccccaggccttgctggcagaggg

SEQ ID NO: 25005 - DNA, 1054 bp, Homo sapiens
gccaccttggccttcagcagccatcaccctgatcagtcagcagccgttaacatcaagtcaagaccctccactgtcaaaaagattgtgacttattgaaggctcagatgatcattagcatttttttttgagacggaatcttgctctgtcgcccaggctggagtgcagtggcacagtctcagctcaatgcaaactccgcctcccaggttcacgccattctcctgcctcagcctcctgggtagctgggactacaggcgcccgccaccacacccagctaattttttgtatttttagtagagacggggtttcactgtgttagccaggatggtctcgatctcctgacctcgtgatccatctgcctcggcctcccaaagtgctgggattacaggtgtgagccactgcgcccagccacattttttaaatcaatattttaaaattaagataggtatgtttgttaagacataatgttattgcacacttaatacactatagtatagtgcaaacataacttctatatgcactgggaaaccaaagaaattcatgtgacttgctttattgtgttactccctttattgcagtggtctggaactgaactcccaatatctcttgagttataactgtatataatttagtggcattaattacattcacaatgttgtgcaaccattgctaactatttccaaaactttttcatcactccaaaaagaaaccctgtaactccccatcctccttttttcctcactattaataccactggcagttaatacttaaccactatctcactttctgtttccatgaatttgcccatttcatgtaagtggaatcatacagtttgttttcctgcatctgactcatttcacttagcataatgtttttgaggttcattcatgttgtatcatgtattgaacttaattccatccttacttcctcctacctccttccctgtgttgcctaggctggagtatagtgggatgatcacaggtcattacagcctcgacctcctgggttcaagggatgcctcccctgcccagcctcctgattagctaggactatgggc

SEQ ID NO: 25006 - DNA, 1309 bp, Homo sapiens
taccattgagatgaacaatgaaaaatgtgtcatgtccaaattgtttttcagattaaaagacagcaaatttaaaattaagtatttaggttgggcatggtggctcacacctgtaatctcagcactttgggaggctgaggtgggtggatcacttgaggtcaggagtttgagaccatcctggctaacatggtgaaaccctgtctctactaaaaatataaaaaattagccaggcgtggtggcgggcgcctgtagtcccagctacttcggaggctgaggcaggagaatggcgtgcacccaggaggtggagcttgcagtgagccaagattgcatcactgcactccagcctggaggacagagcgagacttcatcccccaaaaaaaaaaaaaaaaaaaaaaaaaaaatccccaaattagccgagtgtggtggcaaacacctttaatcccagctactcgggagggtgaggcatgagaatcacttgaacctgtgagtcggaggttgcagtgaaccaagatcacactacagcacttcaggctgggcaacagaacgagactctgcctcaaaaaaaaaaaaaaaaaaaaagtatttaatttttatcatgactaacacttcagtaataaaagatctaatatggcactttttaatatatagttattgaattctagaatatagtggttgctttgcattattactgtatatagtgtatttgtgcttattttatagtttatggagcaaaatttagtatattaagccatttttgcatcttaaccagctgctgcctaattattacaggaaaatagtgtggaagttcagctattctaaatctaaaataattggttttggtacatattctctaacctttagatggtctgtagctattgagccatatatgacattcttttaccttgcagtgaatttcatagcttgttcatattggggaagttgtacatggaagtcatattgcttgaaggtagataatttaatggctatggaggtcatttgactgtacctgctttaaaatttctctagttacaaaaagaatcatatgaatatctacattgatacaaaaaaaaagcccttgggaaatgtccatgtatgtagaaatactcaagaacattaaaataaggaaaactttcttaatatgatcacacacatacacacacttctgtttaccttaagatcccatgctatttaatggggaaacatgagagatacttccactaggatgaggaacaaggcaaggattcttaccatccctacttctgtttacattgtactagtggtattaactaatacagttagaaaagagaagtca

SEQ ID NO: 25007 - DNA, 1053 bp, Homo sapiens
aatcaaagacaaagctacccaagcaacgcaacagataaatctataggaaaaaggctttccctatgaaagccaattcaaaaaattggaggaagtgactgttatactaaatgtacaagtattaatataaggatacaagaaaagtagaaaagcaaggaaccatggcatctccagaggagcccaataattcttcagtaacagatcccaaagaaaaggagattggtgaaattcctgaaaaacagttcaaaacagtgatatcaaagaaactcaatgacatacaaaagaacacaaacaatacaaagaatcaggaaaataatttatttgaatgagtaattgaataaaagagatagatagattaaaaagaaccaaacaaatcatggagctgaagaaatcaaagaatgaaataaaaattcagttgagagctttagcaatagactagatcaagcaaaagaaagaatttctcaacttgaagacaggtcttttgaaacaatccagtcaaaaaagaataaaaagggatgacaaagcctctgtgacatataggaagcaacaagcaaccaagtatttgagttttgagacttccagaagaagagatggtcaaaggcatcgaaaacctattgagtgaagtaatagctgaaaactccctcagtcttacaagagatatggatatacagatacaggaagttcaaagatccccaaatagatttaacccaaaaaggtcttctccaagtcatattatagtcaaactgtcaaaagtcaaagacagaattccaaaaacaagagagaagtgtcaagtcacatgtaagagaatccccgtctgtcttagttcgtttgtgtttctgtaaaagaatacccaaggctggtttatttataaaggtaagggttttatttggcttgtggttctgtagactgtccagaacctcagactgcatccactcatggcggaaggtgaaggggagccagtgtgtgcagagataacatatcaagtgaggaagcaagagagatagaggcatggtgccagactctttttaacctccagctattgcaggaactaacgga

SEQ ID NO: 25008 - DNA, 1057 bp, Homo sapiens
gatccttgacaaacctgacaaaaacaagcaatgaggaaaggatctcctattcagtaaatggtgctaggaaaactggctagccatatgcagaaaactgaaactggacctcttccttataccttatacaaaaattaagatggattaaagacttaaatgtaaaacccaaaagcataaaaaccctagaagaaaacctaggcaataccattcaggacacaggcatgggcaaagacttcatgacaaaaacaccaaaagcaattgcaacaaaagccaaaattgacaaatgggatctaattaagctaaagagcttctgctcagcaaaagaaactatcatcagagtgaacaggcaacctacagaatgggagaaaacttttgcaatctacccatctgacagaggtttaatatccagaatttacaaggaacttaaacaaatttacaagaaaaaagcaaccccatcaaaaaatggacaaaggatatgaacagactcttcttaaaagaagacatttacacggccaacaaacatgtaaaaaaaaaaaaacatgaaaaactcaacatcactgatcatcagagaaatgcaaatgaaaaccacaatgtgataccatctcacgccagtcagaatggcaattattaaaataagtcagaaaacaatagatgctggtgaggctgtggagaaataggaatgcttttacactgttggtgggagtgtaaattagttcaacgattatggaagacagtatggcaattcctcaaggatctagaaccagaaataccatttgacccagcaatcccattactgaatatatacccaaagggttataaatcattctactataaagacacatgcacatatgtgtttattgcagcactgtttacaatagcaaagacatggaaccaactgaaatgccatcaatgatagaccagataaagaaaatgtggtacatatacttcatggaatactatgcagccataaaaaggaatgagatcatgtcctttgcaaggacatggatgaagctggaagccatcatccttagcaaactaacacaagaacagaaaactgaac

SEQ ID NO: 25009 - DNA, 1029 bp, Homo sapiens
gtgagccaagatctcaccactgcactcctgcctgcgcgacacagtgagactccatctcaaaaaaaaaaaaaaaaaaaatcaacaaccattcctaataaaaattcttaagaaagtaagtatggatggatgcttccttaacatcatgaaattatctgtgtccaaagccagcatcttagttcagaaatattataggcatttccactgaagtcaggaaacgttcactactagttaacattgttctgaaggtagtagccaatgtaattaaacaagagaaatctatgagttggtaagaagaaaaaaacaagattatctctattttcagatgacataactcaaataataaaagaattcagctatataccaggatataaaactaacatgcgaaagtgaatagcattcatatatacaaaatgaccaatgaaaatatataatggaaaagaaaacctcatttacaatagcaaccagaaagataaaatacatagaaataaacaacgggaagtgttcaaaacctgtatgaaaaaaaaagtctgaaagatatacaagtaaactttaacaaatggaaggatggcccttgtttttcatgaggatgtctcaacatgatcaacctgtcagttttcacatttaatgtgattacaataaagtatcgagctttttaataaagccccacaattttatattcaaattgaaaaagtaaacatgcaaaaatagctaagaaaataataaaaaaaaaaggaggggggattctagccttaccagatactaaaactacaagaaagtttccttttctttttttttttttttttttttgattctcctgcctcagcctcccgagtagctgggactacaggcatgcgccaccatgcccagttaattttgtatatttagtagagacagggtttcaccatgttagccaggctgatctcgaactcccgacctcaggtgatctgcccaccttggcctcccaaagtgctgggattacaggcgtgagccaccgcgcccggccctaaaactacaagaaagtttctataa

SEQ ID NO: 25010 - DNA, 1050 bp, Homo sapiens
aagtagaattaaaataaattaccagtttcagtttttagcagatggagtcccaatatttgaaagaatttgagtataaaacttggcaatttatttgattttatttttaattgataataattttatctgataattttaattgataaataattttaattgataataattttaattgataataatttatggggtacaatgtaatgttttgatacattgtggaatcatcaaatcaggctaattaacatatctgtcacctcacatacttaccatttctttgtgatgtgcaatttggtttcttaccaaacttttcaggtctaacttcactttctccttctaggaataggctttaattaaattgttagaaacatgtgtcttcttcctaaaaggttactttgtaaaccttatgttgttattgtataatacaagcaggatgatttctaatcacccaacagtcctgctttctaaagattctttcaccagtgtataagactattaattcaagttgtatagtctgaacctaggcgcagtggcttatgtctgtaaggctcactggaaggctgaggtggatggatcatttgagatcaggagtttgaaaccagcttggccagcatggtgagaccccgtctctactaaaaatacaaaaattagccgggcatggtggcatgcacctgtaatcccagctactcaggaggctgaggcaggagaatcgcttgaacttaggaaacagaggttgcagtgagccgagattacgccattgccttccagcctgggtgacagagtgagactctgtctcaaaaaaaaaaaaaaaaagaaaaaccccaaattatatagtctgaactcttcttgccttcaaatggttgtccccacccagggtcaaggatttgattaacagcacatttcttatagctcttataagttaaacattaatttgaacaggtttaatcttgtatctggattttagttcagtagttaactacttcttgtctgagtgtatttttcttaagtatagaagtattttaatactagtacttaagtatacagttttttgtttgt

SEQ ID NO: 25011 - DNA, 1035 bp, Homo sapiens
gatgggacggctgggcagaggcgctccccacctcccagacaaagggcagccgggcagaggcgctcctcacttaccaggcggggcggccgggcagaggcactcctcacctcccagacggggcggccgggcagagacgcccctcacctcccagaaggggcggccgggcagaggcacccacttcccagacagggcagccgggcagaggcgctcctcacttcccaggcggggcggccaaaattttatccttttaaaattaatttttctaccacatgattgaattttttatttgaaactccagtgaattttgtactgttacaaagacatgaaaatctttgataatggtcttaattaaataggaagatctattaatgttctaacatgttttgtttgaaattaaaataaatacagctggtataatcactgttctgccttccacacactggaaataggcatagatttagaaagcagtgcagtagcaaatgaggtctaatatgatttctaatgaatttggatagtagatctggatcttagaactctctattttgctgtcactgagtccagctatgcttatcctatgtggtttgttctatgatcaattgacatttcttcttaggtttgaaataattataaggaaagtaatttcaatagctcaattatggtcattaagaagaaagcatcttagaccagcgctttatcagtacatcatatttagacgtacagaatttctatgtggctgtcctttaaatattttctatttttgttggctttatctagtaattttaaatgctttttttagggaatgaaaaaatatctgtgattttaaaaaattcaccatctactagttggaagtatcatcataacactactctttattctccaatctccacaccactatgcccatctaagagattcattttgtatcaaattgaaatgttcttgttaaaagcacatgcaatttgtattggctttaccaaagcctgtagaaaacataacatccatcagaattactggaattgtcattaaaagcaaaaataa

SEQ ID NO: 25012 - DNA, 1066 bp, Homo sapiens
aaaaaaaaaaaaaaaaaaaaaaaaaaagaatctgctttatagggtcatctctaggatacaatgtaattcctactaaaatttgttagcattggtttttcttcagtatatgaaactcagatataacaaatttctgatatgaatatctttttaaaaaatacaaagctgtttgtcatagctatcatgatggtgagctaatatttgttctttataggccaaagtttattaaaatttacatccggaatcatgacctttaaaagttaattctttgataccacctatcacattttgttttgaaacaaaaatgctggagaagaaatctctttgaagagggaaaactagctgggcatggtggtggctcatgcctgtaatcccagcattctgggaggccaaggcgggttgatcacttgaggtcaggagtttgagaccagcctggccaacgtggcgaaaccccgtctctactaaaaatacaaaaattagctgggcatggtggcacacctctgtaatcctagctactagagaggctgaagaatcgtttgaacttagagggtgaaggttgcagtgagccatcacaccactgcactccagcctgggtgacagagcaggactctgtctcaaaaaaacaaaaacaataaaaaaaacagggaaaaccaagctttgggacctgggccttccctgctggccgtaatagtcttccttatttctggaattttttttttgtcagaattactttagatttatcactattcattgaagccattaagtcttcacaacaaagaggaatctttgaaataagcttctaaacttcttcattatacaaataaggaaaaatgtcctaaggcattaaatgattagcccaaggtcaacactaataattgatggaggtaggatttctaacccaggttttctgaccctaagtccattgtaatatataattttctaattgtattactggaacttaaggtcacagtttagtcagtagggaaaaatgttttctgtatattaaatataggagaatcaaaggttttattgatataaaaacattttatggacatagttgatatgattc

SEQ ID NO: 25013 - DNA, 1052 bp, Homo sapiens
caatttattgttatgttaagccttacatatactcttccataacatataataccatacctctatgcagtttattttatattgcatatttcagcatgtaactcgaccttttgttttctcatttctgaaataatagaacttcctaagaaccttgttccttagcatgctcttaataaattcctttataaatctgtctctccctttgagtatcatttgaatttttttcaaattgtgggcaagttgaaggccttttgggatgctgacttttatatactgaaactaaaatacttgatttctttattttactcagaagagggtaatgcccatgtatgctagagataatctcaattttcctttacagaatacaaatgaatataaatgaagctcaattcttgatgactttggagaatacttttaaactaatgttttaacaaaatgtgtggtcagataaattttggaaatgctgcaccgtgacctcccttgtcaaagtatccattagcatatttgagactctgaggaagtacttctagaaagaaccatttttaaagttagtttgatagcacttcacaaacttccttaactatagaaccatactgggtgttacgtactacggtatctttggtttgtgtcagtaacagctttccttcttttttgtgtgtattagtccattttcatgctgctcataaagacataccggagactggacaatttacaaaagtttaatgaactcacggtttcttgtggctgaggaggcctcacaatcatggtggaaggtgaatgacacgtctcacatggcgtcagacaagagaagagagattgtgcagggaaacttccctttataaaaccatcagatctaatgagacttattcacttaccatgagaactcccaccgagtttctcccacaacacatgggaatttggggagctacaattcaagatgagatttgggtggggacacagagccaaaccatatcaactgtgagacattctctgctgattctttaagaatttaggaatattaactagtcctaattattgccattgtttcttatttt

SEQ ID NO: 25014 - DNA, 1038 bp, Homo sapiens
ctgtaagaagcttacaatctaaagcaaaataaattttttaaaaaataagttcaacataactttatgagcatttatttttctttttagctaccatttatggggtgttaacaatatgttaagcactatgctaagtatttcacgtgtattgtttcacttaatcttcacaaaagccctgagaggtatatggtattattggttatcttttctaagctttagttttctgaagctcagtaagataagtaacttgcttagactcataattccattgaatcctggagttagaacccagcctgtttaatttatatccttaactaatatacaatatttctttgttggaataatgtacggaataatgtacaaattaatagtgagggtacaaatgaggagtggtttgttgttccaggaagctagaaaatcataaagaagatggtatcatttgtgttttaaaagacaaggttgagcagggatgcatggtaaatatcacctaaaaaggcatagactgtaaaactgggttctacatgtgtttgggtataggacactgagcaagaggagatgagactagagagcaaggtcacattagagcaaacctcctatgtcagagtagataataggcaatggatagaatttttagcagaagagtaatattatcggattcgcattttagaaatggtcttaagctgcagtgtgaaagttggattggaggaatggattctagagagtgtcataccattaggagattattctgttaaaacaggtcatagatacacagtttttagttacagactaaagtagtaactagagaaagacgtgtctgtctcggagacggataacgtttaagtatttgtttgattaaagcaatttttctcaattgtttaagaggaaagcagtaactacatcatgtgcgctaaaatttgtaggtttactttcttttggaatggggattagattagattcaaggatgctgcattacctgaaaattcggattgaatatgaagttaacatgcctttacgaatggaggttagcaaataacactgttt

SEQ ID NO: 25015 - DNA, 1025 bp, Homo sapiens
tttgagagcaaagctaatgtcttactcatcttatgtctctagggcctagtaaagttccaggttcattaaggactttaaaaatatgttaaatgattacaatgagtatatgtaatggttcttatgatgtgctttgaacaactacaccctctagttatttaaaattactttatattttccatagagatgtgaggaggagcttcttcaattactgacacatattttgaattatgtaatgtgtaagggactagaaaagtctgatgatgatacttggattgaacgaggacaagtgttttcagcactaagtaaaccaggaatatccagtgaactacttcgaccatcagatgaaataaaactaacgtaagcatttagttagtgattttccatcctccttttggtgacagcaggagtctaaaataacgttagttattgaacatttattcagtattctgtggatataacaagggagaaaaagagaaactttgtgctcagttccttttcctatcttttgccgtattagtaggatctaaagaggaatcccaaactcattccagtatgaggaggtttaagtcttaagtaaatttgggtcataagtgattacagattttttgtttaaactgttttcttgcagtatttgaggacttgatacattgttttctacaggcttgtccaaatttgagtgtttccgtgctaagagaacggagttgggttttcatgataattatttctctgaaggatttagggttccttgtagatcaagtttgtccaacccacaggttgcaggccacacatgcagcccaggatggctttgaatgtggcccaacacaaattcataaactttcttaaaaaattatgagatttttttgtgatttttttaagctcatcagctattgttaaaacatatcgttaaaatatcattagtgtattttatgtgtggcccaagacagtccttcttccagtgtggctcaggtaagccaaaagattggacacccctgctgtagataataggactctgtaatggtagtaca

SEQ ID NO: 25016 - DNA, 1048 bp, Homo sapiens
tggcaatagtagctctttgcattatctctagttcccttgttaggggaatgctatgatggtaatgctctctagttttagttactcttgaaagtctcattttatagtttaagattcatatttagtacttctaattattatttacaaacaccactacaatgcagtcttagtcacagattcctgtattttgtgggtcaattcatgtctcccagaatataactaaaatgacatgaccaatattgccttatttttcagctgtcctctgctaattgttttacaggttcactgtgttttattataatgggtcatataaaatcaggatgtaaagcttatttttaatgaaactgaatcattgagtaataaaaatatttggatactgtttaagtaatttaatatgcagaatacttcttgagggtaattcagatattctttcctggacattaatttgacagataagtgatttatatttgaggccaggcacagtggctcatgcatattatcccagcagtttgggagaccgaggtgggtggatcccttgagctcaggagatcaaaaccagcctgggcaacatggcaaaaccccacctctataaaaaatataaaaattagctgggcatggtggcatgcacctgtattcccagctacttgggaggctgaggtgggaggattgcttgagcccaggaggcagaggttgcagtgattgagccgacattgtgccactgcactccagcctgggtgacagcaagaccttgtctcaaaaaaaagaaaaaaaagagattatatttaaatgtggcattcttttctatttaagaaaaataaatggttgaatttttctgtttattggcttcttgtttttacagtgatgagaaagaagaacaggatcaaaaagaaaaattggtattgatggaagactgtgaactcattacaataattgatgtaattcctggcagattagaaatcactactcaacacatttacttctatgatggcagcattgaaaaagaagatggtgaggagttctggaaaaaataatttttgctgttcaataatta

SEQ ID NO: 25017 - DNA, 1064 bp, Homo sapiens
ctttccaataagtaaaaatcctctgttttattaaggaaaaaatagctatgttttaggtaaataactctgaaataaactggtacaacaattgtaaaatagaacatatttaaatgtcaaggtgtcttttcttaagacttcaggaatttgtattgaacaaagtctcaagttaagtagcaataattatgatgcataaatgagactggcatctattcatttattttattcttttttggggtgatgggaggtttcaatccagtgcttcacccgtggtgccaccgtggctatctttttttttatcttacagttttttaggagatttcaagtcggcagaactaacatgattgatttttagtttttaaaatactgatttttttagaaactttttctaaatcaaaacctactaagttttattttgttatttatccagagattttgatgtaaaaatgccttcatttttaagattacttaatactggatttgaaaattattttggatgcttataagttttctaaaacttagataattagaaaaaatgcctaagtttatgatgttttactatgctgctttttagatggaagaaataagcagtttttactttatagtacaaataagttttgttcacaataaaatagatatcctacctggactaatactagatgtacaaggtagtggaattatttcttatattgctttttccaaaaagtaaaaaccaaaaatgtgggccgggtgtggtggctcatgcctgtaatcccagcactttgggaggctgaggcaggcgaatcacaaggtcaggagttcaagaccagcctggccaacacagtgaaaccctttctctactaaaaatacaaaaattagccgggcatggtggcacatgcctatagtcccagctacttgagaggctgagcagcgcaggagaatcacttaaacccgggaggtggaggttgcagtgacctgagatcacgctactgcactccagcttgggcaacagagtgagactttgtctcaaagaaaagaaaaaaaatatggaatttagagaaaaatctttgagaatactagcaacagtc

SEQ ID NO: 25018 - DNA, 1076 bp, Homo sapiens
gagcaaaaccctgcctttaaaaaaacaaaaaacaaaaaaggccgggctcggtggctcatgcctataatactttgggaggccgaggcaggtggatcaattgaggtcaggtgttcgagaccagccaggccaacttggtgaaaccccgtctctactaaaaatacaaaaaaaaaaaaaaaaaattagccagatgtggtggtgcacatttgtaatcccagctactcaggaggctgaggcaggataatcgcttgaacctgggaggcagaggttgcagtgagccaagatcgcaccactgcactccagcctgggtgtcgagtgaaactcattctcaaaaaaaaaaaaaaaaggaggtggggagagctatttcaagaatattttaagtaggctgggcacggtagctcatgcctgttatcctaacactttgggaagccgacatgggcagatcacgaggtcaagagatttgagaccatcctggccaacatggtgaaaccccatctctactaaaaatacaaaaaattatctggacatgctggcgtgcgcctgtagtctcagctacttgggaggctgaggcaggagaatcgcttgaacctgggaggcggaggttgcagtgagctgatgttgtgctagtgcactccagcctgggcgacagggctgagaccttgtctcaaaaaaaaaaggagtatcttaagtgtctttcaaaattacactttagcacttataaattttatatataatactttactgatagcattgtatattagtccaacttttttggctacactatttgtgaaggattcctttttttctttaagacagccactgtaggaaatatgccaagtacagatagtgaggaaagaaaggaagaaaaatgataattgtctgcaagtgggcttatttttaacactgctgaatttcatttgtaattttactttcaagaatatactctggtagactgaggcgggaggatcacttgagcccaggagttggaggcttcagtgagctgtgatcacaccactgccctcagccaaacctgagtgataaagtgagaccctatctcttaaaaaaaaaaatccctttgt

SEQ ID NO: 25019 - DNA, 1041 bp, Homo sapiens
tgtatttttagtagagacggggtttcaccgtattggccaggctggtctcgagatcctgaccttaggtgatccgcccgcctcggcctcccaaagtgctgggattacagcgtaagccaccgtgcctggcctagttgtagacttttgatagcttatggttgaatttttatgggattggttaatagattggattcatgaggtagcatgtagggcaacacattctattttggatttttcatttactttgtgtttccttccagatacgaagctcctagaagatggagtcatttcttaaaaatttctatattttcccattagccgtaggatgttctccatatactagccactcattaaatagttgctgaatgtaagaaatacagacttgaatatgcaagagcctatgcactgaattatttttattttattactttattttattttattttttgagacagggtctcactctgtcactcaggctggagtgtagtagcacgattatgggtcactgcagcttgcactcccaagctcaaacagtcttcacacttcagctcccaaagtagctgggactacaggcttgtgccaccatgcccagctaattttttttgttgttgttgttagaaatgggatctcactatgttgctccggctggtcttggaacacctgggctcaagcaattctcctgccttggcttcccaaagtgctgggattacacctgtcagccgccatgcctggccttgaattattttataagtaggatataattacatgtaaatttaccttgcaagttttttcctatttgattttttggtgacatttatgttctgtaaagttttgcagtacttttcatatttgcataattcatgcaaggaacatagttttgcttttttcttcttaagtaatatactttgtagaaaatttggatgaggtaacagctttgttttgaatcatttacaacatgaattttttctcatttgatttttaaagtcaggtttattgagttttaatacatatatggtacaagtcaccctttttaggtgtaaaggt

SEQ ID NO: 25020 - DNA, 1647 bp, Homo sapiens
tttcaaactcctgacctcaagtgatccactggcctcggcctcccagagtgctggggttacaggcgtgaggcactgtgcccagcaatattttcttttttaatcagatgagttttgcttttgacaaaaatttgcttctggccgggcacggtggctcacgcctgtaatcccagcactttaggaggccgaggcgggcaaatcacctgagatcaggagtttaagactagccaggacaacatggtgaaaccctgtctctactaaaaatacacacgcgcacacacacacacaaactgaggcaggagaatcgcttgaactggggaggtggtggttgcagtgaatggagatcatgccattcactccagtctgggtgacaagagtgaaactccatctcaaaaaaaaaaaaattgcttgtaattctatgttgattccaaataagatttcagaatagtaagctatttcccaactatttaaatctttgaggagtttattgttgcagatgtgcaaaccagatagatctaccggatgctactttggtatttggtatctttttcaggtttttgctaacaaccacaaaagactatgtttgtttgtttgtttgtatattagaggaaaatatttctgcagcttgggaatatatgggactaataggcatgtgtatcaccagtgtgtatgataccatattactgcctgaatgaacacatcagctgtaagaaggaaggtgagaatttgagaaatactggtctgtgttttgggtttatccattactggagttgcacgttttcccttgtcataattcctgtagcttttagctcttcctcattgtctgttgagttgaattaactctttctcccccaccacatttaactctagggagtgtaaacttgtgctgttctctttctcattccatgtttctgttgtcttttagttaacatcttgtctttgaggggaatgaattaacttctttaagggaagtgaattaactactttgagagaaataggagaaagagcagggacaaaataataacctgtggccaaaaggaggggatgtgatgtatgatgaaatgtcattcctttatcttatcttatattcttgcagtgctagctgttaaaatggatccagtagaccttaaacctaggcccttgtttgtgctgcccgacttcatgtgctatagtgcattttaaaatttattcagccattcatttcttatcttataaacttgaatttgttttaattttgtatagtttttcttatttaggaaggactttgtgttcttacatgagtttcatataatagagtttgaaactaagctattaaattatgatgattgccctaacatgtgcatcaggtacttttttgttttgtagttggttttattggagccattgcatgtcctaacagggtaaggagtgatcatatagaaagcaaggaagtgatgggtttggtctctggtcaaaccatagaagtgagttgagtaattcatttttgctctatttttccatctgaaaatgggaaggatgatatcctgactcccagtttatgcaagttttgttcatagataaaggtgcactggttttcactcatcttttgtgtgaaatttctggtggcataggaatttagaaagaaatcaataaacttgtgattcttgttct

SEQ ID NO: 25021 - DNA, 1056 bp, Homo sapiens
aaattcagactatagcaatgaatatttagaaattaagcagttttggccaggtatggtggttcatgcctgtaatcccagcagtttgggaggctgaggcgggtggatcatgaggtcaagagattgagaccatcctggccaacatggtaaaaccccgtgcctgctaaaagtacagaaattagctgggcgtggtggtgcatgcctgtagtcccagctactcaggaggctgaggcaggagaatcgcctgaacctgggaggtggaggttgcagggagctaagattgcaccactgcactctagtctgggtgacagaacgagactccatctcaaaaaaaaaaaaaaaaaaaaaaagaagcagttgtaccctaaaggccttttaagttagttaatgtggtctattttattttaggatttaaaaaaacactttaaaataatttaaaaacaatttgtgttgtcatgtgaggtcggttatcaatgataaaggttcttattggtaagaggatgaggaatgctttaaacaaaaggcgaagtgttgggtggagcagattatttggcttagatttttgagaagctggaaaggagaaatgggatatgatgaagggaaacaaatttggtggtttgggatagaacagttgaggcactgtaaacatgaggtaagaagaattaaagcagtgtaagtagtggaggacagagatggtaagaatagagagagatgaacaggctaaagaagcagtttagcaaaatggagaatttagataccaggaatgacctgattcaggctagtaagtgacgtttgcctagagatcagtctaactggggctcaagatatggcctagctgtgaaacaacagatgatgagtgagaagcccagcatgcagaaaagaagtttgcttggcaaaccagagattctaccaatatttagggacatggctttccaagatcaggaaacttctgagtttagaacattgactcaacacaaggttaaatgggactcttgtttagtctcctttgactcttatgctgttgctaatatcatttatgaaatcagcaaggaccaaaat

SEQ ID NO: 25022 - DNA, 1034 bp, Homo sapiens
tagaaatacacggaaagtttaattgaagaaaaaatacagaaacacacagattctttacccttaaagtttagactagcttgcccaagctactatctcatgcttgttttctctaagccccagtatgattccttcttgatgttcctgcgtcaggatctgtttccattgtgagagacaggccaaacagagtctcctagaaagatctaatgaagaatcacacttagataagatccctgagctttttggagacctgtggattctagcaagtgtcttagaagtctcctgatgagcaatagcattatggattccttatcctcattttaatcagggtagctgattaaatgttcaaaatttaaaacctatttaagacctagtcgtttttctttctacttctctttttctctttctcagcactttttgagctctgtctttgctgctcccattgctgtcatactttttatacttttcagacagtctccagagaaagtcatcatactttaggaccagacatgtgggatttgactcagaagagacctccttgtttaaaagtttaacttttactattttatacagcatgtttgatgcttaattgttcttgacatctgaaatttggattaactgtttttcttcagtcaagttacaaatttaagagttcataagatttttaaaaacactatggtaatagttttatagcaaaggacgtacaaggtcagtggatagaatgccatattggaggtgttttcatatatacctaaggccatataaaagtggaatgtaccttgaactggttcctgttccatactcttgtttttgtttttgttttttttttttttttttttttttttttttttttgagacagggtctcactctgtcacccaggctggagtgcactggtgtgatcatgactcactgcagctttgactgccctgactcaagtggttctcctgcctcagcttcctgagtagttggtactacatgtgtgcaccaccatgcctggctattttttaacaaattttttgtagagatggggtctcac

SEQ ID NO: 25023 - DNA, 1017 bp, Homo sapiens
gttttggttggtgtttagaaagtcaccatgtttgagtgctacaggatttgggaacagatagctattcactggcttggttctgtctttctaggaatattactgtctttcacatcctgttttgttttcttccctcctagttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaa

SEQ ID NO: 25024 - DNA, 1048 bp, Homo sapiens
cccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaa

SEQ ID NO: 25025 - DNA, 1053 bp, Homo sapiens
agagtacttacctttgctgtgaatgatgccctcagatttctaaattctattttgtttcactgaaaaagtagttggggtgtgctaaattgatttcactaatgggttagggcccatagtaaaaaaaccactggagcttcctgatgtttatggacacaggatggaccatcagatcaagtgactcagaaatcctcacagcgctaagatctgattgcttatagatttatccaaagtgtgaggctgaagttaagcttctaaaatgaacttaaactcctaaaatcaaatgacattgtaggtgttaataggtgaatttttctgtggattataatgccacgtaccttatatgtgtaatagagataatttttggatcttgagacttgtgtatggctagtgtgtgagctaagagtcatcctggcccagaagtcgctgtggctttataaaatcttcgagaaactgaaagagttttacttgtcatcttgtttttcttttgtcatgacatggtgatagtattggtaactttaaatattaggtctggattacttccttttgtagcaaagagatgaggaagtgtaagatggataaataatccttgcctctgtatttatagacacatttatagagattcagtgggcttgagttttgacagcagtgtttgatcagaaacattttcccagaaccttaaaaaaaaactgcagttcaaatatttctaataaaaaaaatttttttttttcgttgctgtaactagatttgcatttccgatttttctctctcttgtttcacttttgtctgtggctgaggaagggccacttgggaaatgcagctgtgggtcgtaaggagtccctcactctatcgctctgtgtttcctggggctgccatgacaatgtaccacaaactgggtggtttaaaacaagagaaatttattttctcacagttctaaagtctgtagattcaaatttaaggtgttggcagggccacgcttccttcaaaacctctagagaaggattctttcttgcttcttccagcttctggcagcccagggcatttctgagctatggc

SEQ ID NO: 25026 - DNA, 1050 bp, Homo sapiens
gtcagtggtacaaagttttcttagtgtctcagttactgtgtgtttttctccagctaatgcagtatgataccctataaggtctttcagtggctttttctcttctctcttgaaaaactacaacaacgtttgtcttataaagttctcatcatgtctgcattaaaaaaaatcaattccttttcctttaaatccttagtgattattttcaaaatgatgttgcaactgaactatttgaaaatattctgttgcgtaagacatagtataaattactaaatatctataaagacaaggtaaagacaactttgttaatgtttttgtttatttataattttcctcagggttgttttgattttttttcttaagtagttgcttcccttccatggatcagaggcctctaatgtgtcagtttcatcttttttagtatctttaggcataaaaagtatgtatacctgtgggtaggaaagcaggctttctaaacctctttttttttttttttgagacggagtctcgctctgtttcccaggctagagtgtagtggtgcgatcttggctcactgcaacctccgcctcccaggttcaagtgactctcctgcctcagcttcccaagcagctgggattacaggtgcccaccaccacgcccagctaatttttgtatgtttagtagagacggggtttcatcatgttggccatgctggtcttgaactcccagcctcaggtgatctgcaaccccttagcctcccaaagtgctgggattacaggcttgagccactgtgcccaggctctaatcctcctcttttatgttggatttttttttcgttaaaacgtacataacataaaatgttccattttaagtgtatagttcagtagcattaagtatattcatattgttgtgcaactgtcgccaccacccacctacaaaacttgttcatcttcccaaactgaaactccatacccattaaataataactccctattccccactcccccaggctctgacaaccaccatttactttctgtctatgaatttgactactctagatacctcagaagtgga

SEQ ID NO: 25027 - DNA, 1030 bp, Homo sapiens
tttttagagtgttttgcatgatgcctttttctctaagaggaatcaatactttagtgtacagttctgcaagatatttttttaggctgaagagtaacaaggaagcagggtagagctgatactaaacttacatagggagcgtcttggctttgagactcttcatccatgactggattagttattttaaaaactctgcttgcgtggactcacaggatcacaaattccaaacttaaggacctttcatcttctggaatatagctgggcttgaggtattatatggagtgtgtgtctatgggcatcggtgtggtgaatacttctttgtatatatatattttttgtgtgtgttgtacaagagtgacttcataaaaggtggctcttgccagaattcagaacacagcaggtaatgtacttactgaagaggtaagagcatgagtaattcttgtctcatgagaaagatgtaaactagtttattataatgatgtaatatttgggtgcctgatttatcatccccatctccaatgatgcaaaaccttaagaactacacaggtgataaaaattcaaatggtgtctttgaagtccggcctattcccctgagcagttaaaagtgtcacctttgtcctgatacgttgctgtttgtggatgtttccggagatcacggttaaaatcttgaactatgcactctactatgggaagttttgggatgtttattccgtgagagaggtcataatctgggaagatgagagtcattcagctaatagggcaggaaaatatcacagtcaagctgtagacttgggatgatgggagtatggaagagatgattcctcctgtgtactgaggggaaccaggagagggagagttgtcaggaagcgtgtggtctttgaactggatctcgttttaggagaaacttgagttgtcccggttgagaaccagcttaggcaaaagtgtggccactttagggcaggctgggggcggggatatgaaaggaaatcatcatcatcatcatcatcatcatcatcatcacaacaacagtaat

SEQ ID NO: 25028 - DNA, 1351 bp, Homo sapiens
tatttcccatctactttaattactttcagcgggattttattcattgtaggcaatgaattgtccacggataaatggaattgttggtagtcactttcactttggagctcttctataatcgaaatatgaagatatttgcattgctttatgaggacatttaaatacaagaagtaggtttttatatttcagattgaaagcaaagaaagctacctcactgattctaaattcactttgtaaaatctcgaattactgaaattaagttcattcagctcaaataagccaattgttttccctttgctccaagggagaagagcaggctctgtaccatcttgattggttttttatttgctcatcccctgatatgatttggctgtgtccccacccaaatctcatcctgaactatagttcccataatccccacatgtcatgggagggacccagtgggaggtaattgaatcatggcggtagttacctctatgctgtttttgtgatagtgaatgggttcttatgagatctgatggtttaataaggggttttcctcccactttgctctggacttcttgttgccaccatgtgaagaaggcctccccagccgtgctgaactgtgagtcaattaaacctctttcatttataaatgacccagtcttgggtgtgtctttattagcagcatgagaatgggctaatacatcccccttttgtaataccgtgagggagggcgtgcattagaattgtggtattccagtaggaaaatgaatacaccataacaagtcatggtatctgactttagaacacaaaccatttgtttctgatgttgatgtgcagactggcttccgtgacttggacttgcattctcttggtcatgtcagatttaagattcttttatgcagaacaagctaaacaatatcatggagttataggaacctatttattgtacatgtaatgagataaaggtggcctgtaataaaacagtgctttttaatattgaagatgctgaaactcctggagaagcaggtaacctgcgtatttaattcaaggactgaatcataagagctcatctttgggaaggagcttaccatcatttaatgctggatttttaccttgcttcctacagaaactattccccccactttgatatgcaaatatttccattgggcttttggtttcttttacagttttccaaggcactacatcattgtatttggtaatttcactttctttgtgtaattgttcctaatctttattctaaaatcttatcctacaatagttcaatgaaaggtgcttttctttttcttttaatgtttggaatactgcacttaatggagattcccatgtttactttaaaaatattcaaatt

SEQ ID NO: 25029 - DNA, 1045 bp, Homo sapiens
ttttttcttcccagttcccatccctcattctctcttcctatgcatcctgcttcattaattaaaaatgttggtgagatcagtattcagtttttgtattagtatgatgataaaatattgttgaaagctgagtcacacaggatacttgtacatgtattttttttctctttccctggttttataatggtttcattttgtttgtttagtgatatttctttaaatatatttcagacatgtctggtcaatttctgggaaaggattctcaggagatatattttttttgacatttatgtctgaaaatgtctattctttactcatgctttattacaaaggtttgaaattctaggttgaagtcattctctttcagaattttgaaggcagtatgctattattttcagttttcagtattattgttgagaaggccaccttttacctgccttgtacctccaagcctctgcattttccgcctccagttctttgaaatttcatgatgtctgtgggtttttaaaccatttattgtcctgtgcactttgagcatttattagagcctttcaatctgtagattttcagttttgggaaacattatttctttatccttcgcctattctcaagacacacagtttttcagttgttctctttctggttctgttattgcgttttggaccttctggagcactcttctaattttcttttttttggccacctattttccctttctttgtctttttgttgtattctctgtaacattttctaaggtttatcttaactttctattgactttaaattttgccatcaaaagttttatttttaagagctctttgttgctttatgaactttgttttattccttttaagcatagctattgtatgggtgcaatatttgttcatttctctgagggtataaaagtctttttgaagttttcttctgctgtttgccttattgatctttccttagggttatttattttttctttttatttatgttagtctcctctggcttttatggtacaggattcccacaaatgctgggtgaaccttacattgttcat

SEQ ID NO: 25030 - DNA, 1007 bp, Homo sapiens
aggtattgacaaagcctaaaatggatagacctacatgtaccatgcacaactgtaaaactcttaggacataggagaaaacctagatgaccttgagtatggcaatgactttttaggtacaacaccaaaggcacagtacattaaagaaataattgattacctggattttcataaaactaagaatttctgttttgtgaaacacacggtggagagaatgagatgataagccaaagactggaagaacatatttgcaaaaggcacctgataaaaacgtgttatctaaaatatgcaaagaatatttttaactttccaataagaaaatgaaaaacccaattaagaaatgggccaaagacctgaacagacacctcaacaaagaggtacagatggtaaataagcacatgaaaagatgatccacatcatatgtcatcagggaaatgcaaattaaaacaacagtgagttactactgcacatctattagagtggccaagacccaggacactgacaacaccaaatgctattgagaacgtggagcaacaggaactcgttcattactggtgggaacgcaaaatgaaacagccactttggaagacagtttggcagtttttaaagaagctaaacataccctgactgtatgatccagcaattgtgctccctgatatttactcaaaggagttgaaaacttatgttcacacaaaaatctgcacatgtatatttatagcagctttactcataatggccaaaacttggaagcaaccaaggtgttcctcagtaggtgagagactgaataaatgatggtacatccagacaatggaatattattcagtgaatgggaagtcctgcgtgtagtggtgtgtgtctctttggactgagttgtgagggctgaactgaaagtggcaggaacatgccattttagcataatgctaacattacattagatttggccaatatgtcagtgtgcagtatgtgttaagttctttcgtcccttaaacttcattatctctgtccaaact

SEQ ID NO: 25031 - DNA, 1048 bp, Homo sapiens
tgtgttgcaggggtttggtgtacagacaattttgtcacccaagtaaccagtgtaacactcaagaggtaactcccactctccaccctcaaggaggccctgatgtctgctgttcccttctttgtgtccatgtgtactcaatgttcagcttccacttataagtgacagtatgcagtatttggttttctgttcctgtgttaagttgcttaggataatggcctccagctccattcacgttgttgcaaaggacatgatctcattctttttctggctgcacagtattctgtgatgtatatgtaccacatttcctttagccagtccactgttgataggcatctaggttgattccatgtctttgtgattgtgaatagtgctatgatgaacatacacgtgcatgagtctttatggcagagcaatttctatttccaacatttttaaccatgtaattgtgctttctccaaagttatttcttccaatgcccatggacagtggagagaacgttttcttgtttattgtctctttttgcaaaaacatttcttatctgaactgctgctcttcttactgggccatgtttatgtcctagaattttcacccgggatcacaaactagcatatagagggaacagtgtgccctgaatagtgctgtggcatggagtgtgtgcagtggaaagggcacagacccttggatcacaaagacctggattggaaacccatatctgccatgtaccactggagggacctctgactagtaatttcagtctcagcttctacatgtataaaattatattttattgggttatagtgatgatttaggtcaatgagttaatatggataaagtgctattcagagtggttggaacactgtgatcacactcttagtggacatgtccacaactgcaacagtgacagtgtcacctgaaagtttgggttgggaactcttaactcctagaaacatttctttgcattatgaagtcatttataagcaacttcttttacaataataatgcttaggagtaaaatattaagcttctaatttcctaatgtgacttattt

SEQ ID NO: 25032 - DNA, 1024 bp, Homo sapiens
aatatccttgaattaattttgactgtgcttaacatagcttgggaatggagaagttgagtaaaatattctaatatatcagtctgacttttctccattttaaatctataatattgatttgttttggaaatttcttataaataaagcggtatatttaactttgtagctttattctgaacttgacaaaacatttctagaaaccttttatctagtttttcctaaatagctttctgtggtctctgcccattatcttaaacaaagtctgtctttgagtcagggagaaaagagaaaattattcaacagtctatctaaattagccattatttaatttatctgggtctatacaacttgtaaacagtgataaggaagatcttgtggtgttaaggtgtgtctcatattcacctggtggctatcaattactttcctgtttgaaagtatcagtttgtacaatcattgttctaatctcacttagttcatctcttgctactttatcagggagaactggttatttcaactctgacataggtctagtatttctttcaagggggtgaggggcagagggtaaagagtacactatggcttcacatgtacagtgacagtttgtaagagaaatggaaatagtgacagcccagactcggactctgagcaggaacccttcagtttaggttctacctttctaattagatagacaggacaacttgagcatgcctctcattgtgctgtctttccaggatgatgtgcgtgatactcactaactcaaaacacgcaaccagcatttctgttggtggaaatcctgtacctccttggagggagactcaagacctgcttcttccacaaagcccaacatcattctgttgtgcaaaagtgagccctcttctcccaactcccacgataccctcattgtccgtgtatggcatttgctgttgaggatatatagctcattcagtatacaattacatacaactcatttcctcgatgaatcagaaactctttgagattaaaaagagctcacgtgtttgagcctttg

SEQ ID NO: 25033 - DNA, 1620 bp, Homo sapiens
tcctagtacagcttccacggggaccaagtctccactgtgttacactacttctagcctatatgtgtcaaaatattattggaacagctttggaatattgcatcttatgataactatttgtataaaatgttgtgctgaaacttaataattatctggttgtgacagttattctcaagattcttcagtttgtctatcagtctgatgattcgagttctttgggataaatatctaagaattgtaattttacactcatgtctcctctctggttgctaaaggctaccaacttagttcacccaatagtaacaacctaatcattgatgactagcaatggcccagaatgtctttggcccttatttattctacgttattttaaagcaatcctgaagacaagagctagtgttatccctatttttaatttccagaataatcacagaaattgtaagtaacttgcccaagatcacacaggtagtaaatggcacaatcagactctggaacctagaatttaaatttctgtaatcttatttcttttcttctctgatgtgtcaagcagtttggcgcttgtatctataatttctattacgaaaattcatcagtcataaattaacatgaattttgcttttacgtagtcaccaccattgctaagaaaaggttggtaatagaccaaactgttgagtataacaaaacagttgagtatacaatttatttataaattaattcagaattaatatgccatacatatttaatatatttcaaccctgtttgcctatagcctgcatctagtttattgtaaaggcttgtcagctctacctctgttgctttcttttgcatcctcttttctctaggacccagattatttgatttagatacagtttaatttcagttggacgctttagactgcacttgaagtctaaccaccatatgcaattacaaagaaaaacaagtttgtattacagtaactacttttttgcaccaactatagactgtgctgttttcagtaggcagagtaatggcgcctcaaaaatgtctactccctaatctctacaacctgtgaatatgaatgttacatgacacagcgtctttgcagatgtgcttaaggatcttaaaatggagagattattctggattatttggatggacccaatgtagtcacaagcatccttataaatgaaagaagaaggcaggagagtattagagagataaatgtgagaaagacacacccagccaatgccagctgtgaagatggagaaggtgccaccagcgaagaatgtagctggcctctgacattggaatcagtaagggaatggattctcccctaaagcctccagagagaacacagtcctgctgataccttgattttagcccagtgagacttgtttcagatttcttaactgtcagataataaatttgtgatgttttaagccattgcatttgtggtgacttgctacagcagcaataggacactaatacatacactgcctcttttcccattttaacttttaaagtgatgttagtcttctcaaatttcatattgactgggcattgagatcctgcaggatgagataaatgctttgtacttcagatgggttccttgttctttgccttcctcccaaagtccatcacaaa

SEQ ID NO: 25034 - DNA, 1024 bp, Homo sapiens
aattcatattttatggtagtaaattagatgccacaatgtagggcacatttctataatttttttttaaagttttcttggcaccttaaaaattcaaggaagttaatgagtgccaaatatcaaaaaggttaattagaacctgttacatagtgttgaagtatacatttaggaaatgatttgtcaaatttttccagatatggcataaatgtttcagaataaaatataagaaaatgagtgctcaggtatgaaggaaaatttgtattgtgctaaagtacacctaaaatgtaccatcttcatcatttctaagtatgcagttctgtggcattaagtgcattcacattgttgtataaccagcaccactattcatctccagaacttttcatcataacagtattttttattttgaataaaatcatgcagatattattgagaatatgtttggattcatacagatgcttggaatctttaaaggttttaatgtatcagtatatgtaaagatgaacgttgaaactgtagctcttgttacttcaggtaagacacatgacatccattgatgcaactgaaatctttaccagcttttgaaatactgtcagagtcatgcatattttcttcaggatgaaaggatattgagaggaaaactatattcaaatataaacaatcttcataaagaaccatctgaggtgattaaagataccatgatcatcaaacagttaaaggtggaaaataaaatatggtatttatgagaattttgactggcatgaagattttaatgcatattatcttgctttgctaatcaaggtgattgagatgcacttgcctgttaaatagaacttgctcgtggcttttagttatcagagattttacatttatcttttcttcatttgaatgctacataaaccctcccctttgaatctgagggggccactaatttttttcctagagtgctactcttatatattgagaatattttttcccctaatgcttggagaatgataacaaaaaagaattttttattggttcatttcat

SEQ ID NO: 25035 - DNA, 1312 bp, Homo sapiens
aaacttttagatgctgttgagtatgtttttaacaaagtataagtagattggttttaagttgacttagccattgttaatgattcagttgattttttaaaattaagaatgcattaaaaatgaaattgatacatttatggagaattcataaacgattcaaatcaattactttatagacataatacatatattttgtatgtttttgtaatttttgggaaaaaattagcttaattatgtttctgagtaagctaaagacattcaactgtattctttcaaatttgccaaagaacaaaaagtaagattttgtcatttggtttattggatttttcattattcactatgataacagtccaaaaacaagaatcaatttcttaatgctttattatatgttttgaagggagttcctttgttctgtgtttaccttacagaacctcagagtttaaagccacattctgtttttaagggaaagcaagtcttgtcagtttttataattgcaaataggataggaaatcatgaatggatgaaaagtgtagtgtgataagtcattcactagaaggggagttgaggcagtgaggggcaggatgatggagtgataaagttcatagtaattataggagaaagtgagtataatggcaataaattgaaaattgaccaagtaagatatttgaggaaagccagcatattgtgatcaacatgctggtgtaacctaattacttatataacctgaaagtaaattccaaatttcttctggcaagaaatagtgattttttttcctatgcaagtaataaatttgctgatttgagttcttatacaccttctgggcataacacaagaacatgaaaaatgttattcttcaaattactgaccttatggctaatgcctttccttaatgctagtctcattatattctattcttggtcagaaattccatatgcacagctttcattggaatccttagcattacttttgatattccaaagcacttttcttaatattctcttgccattcaccttaaaaaagcagtagatatagttggttttgttaagaaaagtttcattggcaatcatttatatttctcaagtattgttgctaatcaaaatcctaatatttagcctctctttagcattttagtttgcctttttcttagaagatactagcaaataatatagtgtttcaaagtcacaatgtcttcaaatcttacggttgattcagactgaaatcttttatggattttatgccccacctggagcagtactcagtaatgtattcacagcaaggatgtactctaaaattaattatttgtgtcattcatcta

SEQ ID NO: 25036 - DNA, 1033 bp, Homo sapiens
atgtcatcgaatagtggggggcgggggtgggtagggggaagacaggatggctgtgggttagcatgagaggagaagaagtgatagagaactagaactgatccagtctatttgcagttgttagaatttgactgggccgctaggcagggcaagaagtggaaaatagggaagcggcttaatgtcatgaataaaaacagagtaagagactcactggtgtgatagaaatttctactttgaattatagtggagaacaagtttaaaaatagtagaggagattgaatttgaggaaagacaaatctagattttttttccaggagattttcctcttttgtttgaattatggttatttgaataatccatttcaaaataccacttaatcagacagtagagggaactatttatatgacgtaaaaggtagtttggcagacatgattaaggagaatgttagagaataagatatcaacatggaaagagatgtgatcttttttaatctggaaaaagcaagacaaattgctttgaacatgtaggtgaaaacgtaccttaatgtttccaatttaaccagaaaatatgattaatgtaaaaactatagcaaacacagtaattttactttgtaattctgctataatttgtttcatttgccatattttatttttcttgttgtcatttgaatttatacctgggaatgccataaaacttaataccttagaactataatcaagtcagaagagcttcttttccataatggtgtcatatggtttgacatccactcgtcatcttcaggatgttaaagtctaagatatctactttacatattttatgtattcaaacaataaggttttatgcatgagtgagtttgaggctttggaatatgtgcacccactatttagtaaactgttgccttccattgttagggtatccttgtgagacttaaaaaacaaacaaacaaaaaacaaccagaaaaccaaagcaatgcccctgaggccaactctgtaaacttatgggaggtaacagtaaatgtttcaaggacaattctgat

SEQ ID NO: 25037 - DNA, 1047 bp, Homo sapiens
gtttccagtacatctgtcttataacttgaaatctctgaataaaacttgctgagtaggtattttttaattggtagatgatgagttgaccaaaattcagcacttggccaaaattgctgaaaattgagagaaactgtcatggatgtagttgacaattcattggctttcttcatgttttaaggtagtattaagataacacaccagcaagcaaagtatcttaatcacattatccctgaagaaatgtaatcactgacttaaaatttaatatttcatattatagaggctcaacaggagaactctgtgttggaacattatttccataatacatcttgttcataagatctgtgatgtcaagggctatgtattcatcctgctgatcccaatgtcaaatatgtcttactagatatttgcttcacaagaaagagaagtgctgtgtttaaaaatgtaggctttggaacttaaaatatctgataagcataatcattacacaccagggttacttccttatatcatcctaaaacatttaggaaatgtgctcattttatatattgagaaagtaagattatctttaaaagtgtggattttggagctaggcccagtgcctttgactgtattgcttactttctgctatggggcaatctttatgtctttatgattccattttctcatttataaattgaggtatcttaaggttatgatgatgattaaatggtataataaatgtgggctacttggtaaagtgccacataagtaagccctctgaagtgtttacctattgctgcagctgtttagccattgattcagcatcatacaagcacacatctaatgaattcgtacttttagtgaatgaataaaaaatggtatctttataaactcgaatgttgccccttgttaattttctaacaaattagaactgtgaaacccaacttattttcatttttgccttagagatcagtaagcttagaacgaaattcattattccaatggtgtaacttgttcagttcaattctaggaacaactactactttattttcttcagttgatccctat

SEQ ID NO: 25038 - DNA, 1047 bp, Homo sapiens
aggccaaataagcttcaaaggaagatgtaaaatgtgcaatttaatctatggggctatgtgattagttcaaaatataatggctttattattgaggattaaagagagaatattgggaaacagcatctttccacaaatataattacattttgaaaaccgagttcctcagttttctcagttaagggacagcttctttgccaaactgttcatattatttgcatatctaaatatttaatttcagttattagtgttgtgttatttaattgccttgcacgcaaaaaatggactgatttctcaaaaatgattacatggcaaaaatagaattaaaatattaacatcagaactccagttcaggcactaaatttaaattgacataagttggtagaaaggactctgctagtgccataatttaggggaagctcctaactacggaaatgtgtgaataggaagtatggcagtgaacactagtgttcagatttgattggactgatgatctactgaccccctagtcacctgttaggaaactgtaaaaataagctacccaaatatgaaattgatgattcttttttcccgaaaggcagaagttaaaacccttcagatgtcatttagaatttcaatcctttgtgtgacacaagtcacattattactgagaagcttgtcaaccaacccaaactcttacgataaatgggtgtagaggggaagcagattaattattggcaaaacctctttgttaaatgacattttttgttcaatgacacatcacacattagtagccatcaatgtgtaagtacagtcactattttatgtactaatatttttctcccagtaaagcacaagaactggggtacagagactgaatcacagttcagaatatattaattacatgcattcattcatttatttgttcattcaacatacattttttcagggccaagagttattccaggcaatggaaatatggcagttaacaaaagaaataagctcttaccatcatagaacatataattctaatgacagagaaatgcttgatgacttttaccactatttatc

SEQ ID NO: 25039 - DNA, 1040 bp, Homo sapiens
ctgcttggtgcagagctgagtttcttgtattttcaaaataatgtggcaacgttctttgagagagtataccaggttaaattgctaagatgatcagtcaacaaatatttttggcagatctgcgatgcatgatgcgatattttgagaggtttgtgcaagatttttatttccctcctcctttgtaggaaaagatccactactcatacctactgacatcccctggcacttctagaaccagcttacaccccatcctctgctcacccttctcccaccttccacctgtattaacacctgacaggcacttatttccctatcaggagtctctgtagttgttttgccattgaccaagatatgtttagaacatttttaatctcttgtgcaattttggcaaacagcagcctgagctctgcttttcctaacaaataacttgcagattgtcatgtttctcttgggagaaggagaaaggttcaatcagagcagaattgaaatgatataaattaggcttattgtttagcaaatcgctggtgttaggtaagaattgtagataagaatagcctagaccctcttaaagatcagagcaggcatgtgtgcatgcatgaggaaaccaggcctttgttagtatcctttctgaaatggctattaaagtaattacagtaatttatagatttttttttcttcttccatttcaaaatgggttccattttttgccttttgtcttgagttcctcagttggagtgtgtatgtgtgtaagcatgtcttgggtagcactgccatagatagtatctatgaattatctgcacccaagctgatgaggtgtggtgaccacaggcactcacagatggatttgccagctttgctttcagggagccttggtcctttgagaataagagaattgtactgagaacactatgttttaatggttagttatagtttgtcatagcaccatttaaaattgctgtgttttatggacataaagatggcaacaatagacactaaggagtactagggcagggaaggaggggggcaagggttgaaaaactacc

SEQ ID NO: 25040 - DNA, 1049 bp, Homo sapiens
gataattttctttttaaaaagggcttattgagtattttgctttacttttaaatatatcagtgctggcttctatataaaatgcaccattttcctctctaccattcaatgaaatacagtttagagtctcttacggagtaaactggattagtcatctgcatactagaccttactttgcttagaattttacagtttacaaaacatttttgcaaaaacaatgcaaatatattgtttttgcaatatatatttgcaaatatttgcatatatatatattttttttcttagagatagctgtaacacatgttgttttatataaatcatacaaaatacaatcattttccatttgttgcatttcaatgggaatagtcataaatttaccattcacatcttttacaaaactcaacgttactgtaattttatggaggaactgaagtttctgtaacgtacatttaatttttctattatttatcctaaatcctatctgttactgcttccttgaaaatgtgcttgtcaactgttcccttacaaaaatgcaaaatataaattgcaatatatattcttataatctctactattgccttggacagtaattgaagccaacattatcgttttggaccagtgcagtagcctcctaacctctctgatctcctttcaccctgacttcctcttctcttccacgtaccccgctctcatcccagttagaatgaccctttagaatgtataaatcagattatgctacattttgctcagaaccatttaatgattttcgatctcacttagagtagaattcagagtgcttgtcatgggtgtcgaccctgcctgttcctggcctcatttttcattccttttctctaccttccttgactctggccatattagcttcagtgctgtgctttcaacttgtagtttccctaataggagtttttgtccctgtcttcctctgcatgccaatctctcactgatattccaagtctgcctggactcctcttgatttctgcttggatgccatgttgtcagagaagccttccctcaatgaccctgtctcaaatagc

SEQ ID NO: 25041 - DNA, 1050 bp, Homo sapiens
ttattttagacccttctgattgctcatgtattgtatgacactttttaaaatctgtatttatggataacattagggacaaacacctacctgtctctagtgtcttctctcccacttgtgctactagcctactttttgattgctcttctcatcagatatgattggaatcatcttttaggaaaatacactttgatttataactcagaacatagtaagaatacctttgcataagccctactatgaaaatgttatgattttattgtggtctgtatttctaagaagttacccatagccggaatttgctcagtatgctttctgtcttcttgggtgtatttcagtattactcttcagttattcacacttgggagtaagggcaaaaaagtgtgccgaatccttccagtaagaaattgtggcatttctcagtgctttcacagatcagcaactctttccgcttatgacagtattttgggaagaaatatttcactgaatgttctctatatgtctaaaaatgccaatgtacatcctcagaatgggtaatttcctttctaacacaaatagctattacccaaatgtctggatttccacaagcctgaggttctcaaatcttcctgattttgtttatggaggatgattttgttgggtaacttaaaaatccaggggttaaagtaactttgttcgtaaatacggataaaaaaagtgtcgtataatacgtgagcaatcaggaaattaagtgtactgcataaaagtatgttttagttatcagaaatttaatcactaatcttggacagttttataaaatttcctcttttcaatgaagtctgttatattaaatattgatcatggatctagctaataataatgatagtggtaataattgaatggtcaggtgacagaaaccatcctaagacttaacaaaatgttatctcttttaatccccaaaacattttataaagtgaatcctcttaatcctattttgagttgaggaaaatgagatttaagcttctttatgtaaatggagctggaggagccaggattggaatccaggaactccta

SEQ ID NO: 25042 - DNA, 1050 bp, Homo sapiens
tgtcaaaataaatttctgagactgcagtttttactatcactgaatagtctcatagagaggcatgtttgcaagtagtattacaaatcataactttttttctggcactttattatagggccttggagattaccttggatttgtgtaatctcaatatggatgtgttcaaagctaaaggaatttatttgatgcgaggggagattgaaataggctttactacagttacaggtagttagtagacttggataaaagaaatgagggtactttggggtttcataaatgttggtaatgttcaaagcaacattgctttacttttctgaaggtcagaacattcctatacaaaatttaagtcagttttgatagagatttagagagacttaaatctctataaatttcatgtaatgaaaatacgttgttacctcaaggaaaaatgaattatattattacaagattgtttttaagtttgatatttataatacattaatgaaagtaacgtgaacccttgatgtcatgatgcactagcgtatggtgctccattgttttgactgtgtctgcatgagtgggctggtagtggtttatcaaatggctttcagggccaggatgaggtggagtggaactggcttgtagtatttgctgattaccgtggtggaaacactttgacgtggacaattccagcctaccaatgtggtgcaccccagggcactattatatggtcttcccagtgtataattgtagatataaatgaccttgagcacagataacagtaacatgtagtcaaataatcaggtagtgatgagttctgagtctttattacatttgttttttaacaatttaattgtaatataaaatgtttaataatgaatatggtttaatgactggctcacaaaatacatgaaagtttaagtttcctctcctgagttggtacaagccagcttcagcacaccgctgaaaatatattgcgacactgagttctattatacatgtggtttctttccttgattatggcccttgcctttgaaaatgctgctgtttcctctctctagataatttatt

SEQ ID NO: 25043 - DNA, 1034 bp, Homo sapiens
gtttagaacgtatgtattataggtgtggattgaactattaaatggaagatcaaacacttttttcagatgttgccattttcatgggagagtatgttgaagtgcgttttggaacatgttaagtaagctagagtgagaaggtatagacaagcatatggggagactaagatgatccatgtggtggtggattagagctagagacatcagcatgaactcatgtttagcttaatatagatacagttggagatacacacacatacacatatatacatacatatctataagtatttacgtatacatacagaaattcttcattttattgtgccttgcattactgcacattgtagatattgtgtttttttgcaaattgaaggtttgcggcaaccctgtctcaagcaagcctgtcagtgccatttgtccaacagcatgtgcttgcttcacatgtcactctgtgtaacattttggttattcttgccatgtttcaaaccttttcattatcatatttgttacggtgatctgtgatcagttatctttggtgttactactgtaattcttttaggcattacaaacagtgcctttataaggcagcaaacttaataagtgcatgtgttctgactactccaccagtcaactgttctcctgtcttctctctccttaggcctctctcttccttgagacacaatgataatatacttaggccaattgatgactctacaagaatgtctatgtgttcaaatgaaaggaagagtcatacatctctcactttaaatcaaaagctaaaaatgattaagcttagtgaggaagacaggttgaaagctaagataggcccaaaagctaaacctgttgcaccaaacagccaagatatgcatagataaagttctcgaaggaaattaaaaagactcttacagtaaacacatgaatgaaaggcaagcaaaacagcctcattggtgatatggagaaggttgagtagtctagatagaaaataaaaccagtcacaacatactcttaagtcaaatccagagcaaggccctgactct

SEQ ID NO: 25044 - DNA, 1035 bp, Homo sapiens
ataatagggaaagaagctagtgacagaggtgaggatttgttcatgtattacatgaaaatattaatttaattggtttcctttaaaacttttgtataaatggcagtgatagttacagaactaggaaagatagttcatgcttaaagagatctggccttctcttttgttaatgaatgactttaaagttgaaatttgcattaagaatattaatgtgataattttcaaagtacccattagtctaacacttttaggataacaaaactaaattctaatgaagttgacatgtggaagaacagtggtaggtattaggaaaaagtaatctggtcacaataaaaatatgcttttgctcgaaaatctgtcaagataaattccaagcacttcaaaaaatgcatgttaaatgtgctttactacagttttgaaatagattaaaattatatgcaaattaatgcaaatcatgtggcttcaagattaagttttgaagtgctatcttcgttccctggagtaaatggctgctgaatgaatagatgcataaatatctgactggatgactggctgaatgaatgaatcagtttttcacttggaaagctgtttcattctcttctctgccagaagcccagttttatgatcttattcaaaatagaatctgggaggtgggcggttgtaactcaaagattagcctaatcaatccagttcaacccaggggacaccatctgccccggtccagtgtagagcgtaaaatgtagtgcatctgaactacaaaggaagaatgtcatttcctcagcactcatttgttgaataggtatctactgagcacgtattgggagccatgccttatttctgatgcatcacagttaacctctaagcagcaattgctattgtttttgatgttcattctttcttgaaatttcctcttctcttgaattctgccatatttcattttcttccctttccttctacttctgtaaaatttgcttcctttcaatctccttttctgaccttgttctgggagttccctgaggctcagtttttgccctgtgt

SEQ ID NO: 25045 - DNA, 1025 bp, Homo sapiens
aatctcttttgcatagtatgaccaaattaatactagcctcatcaaagagttagctactcttttgccccaaatccttttggctctccattgtctgcagggtcaaattgaaaatccttatcatggaatatgaaacttaaaattctagacccacagatcagcttccttacagaacatctctttgagacttttgtaaaatataagggcctgtgcattccagccttctgcatgaagtctttcctgacttcaaggtccatggtcacctgttccctccaagtcttatggatagtgctgtaaactgtgttatatcatgtaactgtttcattgaagtttggtaaccacctgtaagacaaaatcctgactgatcttgttctgaaacataactgtgaatatgtacttatattgagaagtgagctatatgttatagcagcaatgtaaggaatactaaaagtgcacatagcctattgtaaattctataagttcatagttaaccaacatttactgaatgactattatgtgctaggaacttgcttattcttactgtcttattttgtcttcatgtaaagtggcattatcccaattttaaatgagaagactgagtcctagcaactttaatcagctttcttcaatagaaagttatgactgggatcccagtttgatcttcagagttcaaatcttgtactttgtctccctaattcagtaagctcttaggagagagggcattttcttttcatcaaactcaatgacataggaggtagccattaatatgttagtaaataaagtgagagaaggatcctaggatgatacggtttggcttggtgtccccacccaaatctcatgttgaattgtaatccccagtgttggcagagggacctggtaggaggtgattagatcagaggggtggatttctcccttgctgttctagtgatagtgagtgagttctcgcaagatgtggttgtttaaaaatgtgtagcactggccgggcgcggtggctcacgcctgtaatcccagcactttgggaggccgag

SEQ ID NO: 25046 - DNA, 1025 bp, Homo sapiens
ctatattaagataccttcaggaattcatttgatgtgatcttacaattgtaggagaggagaattgaggaaaattagcataatgtttatatagtgaagaagattaatgtatggacacctggcatgtatattttctaagaaactattttaatgaactggaatttgaaccctgccattgttacttaaagattcagactaagaaatgctataagaccaagcagaccaagtttgtttccttcaaagggaaagaagattagggaactctctattctctcctatcactgtctctgacgtgggaatgagaccagttcctatgataacagctgtccagcttggaggaactttctgttccaatctttagggaatagaagaccatgggtactctgtagttagagagaagggaatttagcccaagggaggagaacacttattcagaagatcattgtcccattaggtctctgatatatgtgtaaagtacattttctgatttagatttggtaagcaaatgtgctttagaataaagaatttaatcccaactatcattgctggcatgtacctattatactataaaatgatatctccttttattatctaaataactgagtaaattgaatgcttatatttttattaattgaataaataataggcttcacctataaaagtaactaaattctgttgtctgaactcttctttattgctaaaatttagcttaatagctttgttttcttagatactatgttatttaaattttttgcttgaacttttctatgaatagaaaaattaggagtaggaagcagaacttcaaagggaaatgtaattttactcttttagctgcattgctgagatcaaaagcatttgagaagtgacctaggtggccattacacgtaattggaaaagaagtacaatttcttattactgcatctaaaaatgaggacaacattctttaaatatcacgcttatataaaaacttgcagaaactcaatccacatgtcttaattagaagccaccataaagaaagacatttcatt

SEQ ID NO: 25047 - DNA, 1033 bp, Homo sapiens
atttagcatgttgctagaagctgaggagtcatcagtgaatgcaataaatatgatccttgcccatataggcctcattctagcaggtgaagcacattttaataaataatacacattttaataagtaattgcacaaataagtgtataattacaagttgtggtaaatgctaggtagaaaaagtaaaggagttagagaggatagaggagttttatataaatagagttagggatcaagctaacatgtctgtgggaggaatgttatgctgagacataaaagaagagataaaaatagcaatggaagagcaaggagtagggcatttttggtagagagaggagcatttgcgaagatcctgagaaagaacagagcttggagagttcaaaacactgaaagaaacatcatgagaatgaaataaagcagatgagggaacaagtgatgtaagatgaagcttggaggggtaggtggaaaggaactcaggagagtcaagaaacagaagagtaaattggaataaagatgtgaggagccaactctttcaaggtctatatggaagtagtgctgttcagtaagaactcaggatttttccttcttggatgcagcaaggaagatggataggtgaggtagaagtgatgagggcattccatgctaaaagtataggttagaataaagacaaggattttcctgagaaaaatgaaggaatctagtttggaataagagggggtaagagaagcaaggcagtatggataatctgttgaaaggtaatgataacgaagcagaaagtatgaatcttttcaaagataatgataatgaagcagaaagtggtgaaatgttctagaggactcagtaatggggcatcgttttcacccaagggtgaattgatgaatattccatactgaacacaccatgctgagcacatagcagatactcaatagctttcagaatcgttgacctcctcgggacatgaggcaaaatgtctcctgaacagaggatagcccatagttctagtcaaaaagaacaaatattagcaaaatatgaatatta

SEQ ID NO: 25048 - DNA, 1024 bp, Homo sapiens
tgtaggctgtttgaggttgatgtattttttccttttaaaggtttttgttgctatcaattatctactttatacagatcagatgtgatttgtgaaagcaaggaggtattatatgtatgatttttatggggctttgtagccctattagggatgggtctttttggtcttcttggttcatttcacagtttctcaaacttatgtgtggaatccacttgaagaacatgttaaaagattcacatttagaaattctggagtggggcccaggactgttctttcgctcctccttgcctagcagcccaggggattttgatacgagtgattcataatcaaactttgacaagcatagagttacaagtaggattgtgcttctgatctttctaagatgcctctgatgatctttcatgtaaaaaagaaatatttagcttattagaccactgacaatttctgggttttgccaaatctaaaattagagcctgaagattgtatttgtttatctttaccgagattatatttaggaatacctaggaacctaaggaaacaaaatatttcaatgacttctttgatgcagtatgaggttttccttttaatgtagacagtttatttttgttggctgtgattctttttatgcagtcttgttacattgggctgagacatggaggtaatgaatatttttcttatctaggatcaaagaatactgaaaacaggaaaaaaaaatgtgggtattcagtctcatctctacccttaactttttgatattcctgccttgctctcctcaagtgttttggaattgttttaaagatatgtgtctggtgtttttaatgttttgtttataattaaatgtcagaatatccttgttttcacaatggctgcaggtgagtgatatccagtcaattaccagttttctgttacctcagccactggtcagcatagtgttttctgatagggctgtacctactgtgagaacaggttgcagaggacactgattcctcctttctaccctcttccagacctgcctatgcatactagt

SEQ ID NO: 25049 - DNA, 1021 bp, Homo sapiens
aaattttattggggatggcttcagtggccttcttcatagggttattaggatggaaggtctaacaaacacaagcacaaattataggtcataaaacccagtacaaatattgggaaaaatatccctgggcaagacattcaaggtcctttgctttctgtctctaacctttcagtttagccttaattcctgtatttcttttcctgttaacctccagagacctacactcaaaacacatcctgctagttggttggctttttgcaaatagtgaatttgcaatttcgtgctcccatgcgtttgtgtgtgttgtttcttctgccttgaaggacttctcaatcccattgtccagtgaaatcacactaattaggaccagcttaaatgtcatcttcccctctataccttgcttaacagcttccctgcaaatatagaatgcatctttcctcttgcttttctggcctggtattttgctccttcgactatttcatcacatgttacaatatttatattgacttgcatattcatctgcccttcctgttcctgaattgataggttcttgaaatgaggagttgtatgctcagttcttaacacagtgcttggcctgttacaagtactgaagacgtgtctcttggctgtaggaattgaagtacttcatctagtttctcatccagcattactaaacacattttaatccttcctcatttattgaggcacagtcaaggctgggatacatagttctatatctgcttttaattttgctctgtttccttttagctctgctttttctgttttaaatatatgaagtcttccctttctttccattttttctgttaaatcaactctagcctgcagattccatcattgaccatcttacaacctctatgtaattgtagggaacaccgaggagatttattttgcttctaggtcttggactttgttctaatgcttggatgttgccagttgcttgacctctgcgtaaagaggatgtactgtcagggttctccagagaaactgaaccactaggcttgtg

SEQ ID NO: 25050 - DNA, 1030 bp, Homo sapiens
aagaattagagaagacacggggaggggaacatcacacaccagggcctgtcatggggtgggatctaggagagggatagcattaggggaaatacctaatgtagatgatgggttggtgggtgcagcaaaccaccatggcatgtgtatacctatgtaacaaacatgcacattctgcacatgtatcccagaacttaaagtatatatatatatatatatatatatatatatatatatatatatatatgtgtgtgtgtgtgtgtatatatgtgtgtgtatatatgtatatatgtgtatatatatgtatatatgtgtatatatatgtgtgtgtatatatatgtgtatattatatatgtatatatatgtgtatataatatatgtatatatatgtgtatatatatatgtgtgtgtatatatatgtgtgtatatatatataaagaattagagaagaaatgaaaaactttttttttaggttaaggaagtttcttttaatttctaatcactaaaagtttttgatataaaggaatgttaaattctactaaacatttttccatatccactgaggtggttaaatgtttttcgcttttcatctattaatatgatatattgtattgattgagtaattatagtttcgcagtgttgccaggctagagtgcaatggcgcgatctcggctcactgcaacttctgacaccctggttcaagtgattctcctgcctcagcctcccgagtagctggggttacaggcatgcgccaacacgcccagctgatttttgtattttcagtagagacaaggtttcagtgtgctggacaggatggtcttgatctcctgacttcgtgatccaaagtgctgggattacaggcgtgaggcaccatgcctggctgattttttaaaatttaaattaaactggcacttctagagtaatctcaaactggcaataaagtgtaatcttttttatgcatcgctgggttcagtttgctaatgctttcttactttttttttttttgccaatattttcttcaggatgtctgtatctg

SEQ ID NO: 25051 - DNA, 1436 bp, Homo sapiens
tcagatcaggtctttcccctgcttcatatcatctagtggctccccctttcattcagaggaaaagccacatttcttacaatgggcggattatttttctgttgatgccataagaaattaccacaaactcagtgacttcgtatgaatttattgtcttacatttctggagtctcgccggggtaatgcactcctcccatgtgctgggtgggagaaaactccttgtagggcaaacaccacaaggctgcacaacacccagcacttgcactggtcgaaggttgttccaggctgatgtggagcttaacaaggacttaacaagactgagttccttgctagaagctctggcagagaatctggctttttccagtgtgtagagaccacctgcattccttggctcctggtccccttccatcttcaaagccggcaatggccgtccggtctttattgtgctgtgccatttcgacattgactgcctttcctccctcttcacttttataggggaccttgtgattacattggactgagccatttagataatccaggacagtcttcctctgctaaggtcagctgctaagcaaccttatttcttctacttgcgatcttaatttctccataataggttcacaggttccagcaattaggagatggacttttttggggggcattgggggtggttattctgcctagcagggtacaaggccttcatgatctagcctgttacttctctgacctcatgccctactactttttcttacaaagtagggcttccccctgatggtgtcaccacctcagagacccatggagctaattatctcgtgacctttaagcctttgctcaaaagtcgccttctcagtaagctctgttctgaccactttactgaattgtagcccacagtctgctttgtgtttttccatagcacgtatccacatctaacataggaaacagtttatttttatgtttgttgtctgtaacataagctcttgcagagctcagatttctgtctgtttttcctctgttgtatcaccagcaccttgaatagtgtctggcacatagtaggcaaacaataaatatttgtggaataatggacagattcttgagagaatggcaaactgttttttaataaacataatttttttgtgtgcatcagatcttccgcatgcctccaagaggggcatgatatggtttgttttggggtcttccaaggtatttagtttgggaattggtttgttgtagacactcagaatacaccaaaaagaattacaaagtggggtctggggcagggaggcatgaagactttttcattttatcagtttagactggattccagaaacaaagttaaggagagtttgaggcagtttcataatcagtgtaattcaggatccaggctaggttgacaaggcaatggaagagtgcctgtattcttattcagagttggggtatca

SEQ ID NO: 25052 - DNA, 1049 bp, Homo sapiens
ttattcagatttttaaaatcaatgtggtttttgtgaattaaaaacatgaaatctaattcgtttcagtacagatgcataatatgcctcagtttcatagggaagacagctaaacaggagagagaaggagaaggactggatgaaggctgataaagactgtgagaagagatgttcaaaccaaaattctaagctggtagagtcactgaggctgtgtgacattgggaaaagaacaggaagggggcaaggagaagatgttggtgcctaaatgataattagaagagcaagaagaattgttacccctctaattctgtgaggctgtggatttcagcatcctttatcactgttcattaatgcaaattaactggttagtctcggcctataactcctcgacagcattaatctttaaattctgcgagtcttggtcccaaatgagacagctaccacagcccaccagttcagggcaaagaggataatgaggtattgttttctgagccttcttgtattggtctggatgaaatcaaactggagggaatctatcccttccacggagcagagagggcagaagtggtttgttgccagggaccaaactaataaaatcagtcagttttacattttaccaaaattacctctgacacatgggttttacagttgggcttattctgtcaataaatttttcatggaaagttagattatttagatcagtgaggttcacatagcatactccagctgtaatatgccagctaaattgcaacccagtggcccgaaagaattaattcatctcccaaaatgtgaaattaaatcctagggagtaacattacatgactgatgatgtactgaattaaattaaaggaagacttgaatgcttgttaaaaaaatatcacttacataaacacgtttataaccacatgtgagcctcctaatgaatcaagttattgtgaatccaccctaacaaaaatccaaaatgtgaactcttaggatgctgtttaatttagggaaaaaacccataagttttatctattattttaatgtgtcaaatagtttcatttttaata

SEQ ID NO: 25053 - DNA, 1048 bp, Homo sapiens
agaaagaatttggaccaatacaagcaatcatgatatttttaaatgactaaactctaaatttttggagagaaaatgcacatctctagaatatccagaaacatggcgcttgatcctgaatctccatgtctcattgtcatgtgagacatttaacagcatccaaactacttaactccagtaggagctcccagcgtgactaatttccacccccatctctgccggtatctataaatcatgtgatagatctataattaatgaattcaaaggaagataaaagggacagctttttaaggaaaactaatgttaaatgatttcttcaactggccatttttcttaaaatttataatgttttctactggtgggagaaccttgaggatccttactggtagtcagtgacttctaagctgttacctctggcaaaaggaccagataatgtgagaatgtcaaaatgctattgaaactcctcaaatgtaagaagccaaacactaacattttatttctaaccacaaagatgtgatacattttaaggactttaaaagcaggaactttgcctggaaatatacataaattcataatcactatatatccaataagaatttgaccttaaaaaaggaagttattaatttaagcctaggaaaaatacattttagctaattttccgttttaaaaaaatctgaaaatgttagcatatgttaattcacatagtcaggcttatttatgaattttctaccataggaactattaaaatgtaatataacattacttttaaaatctcaaagtagctggcacagtaatgggcacctgtattttcaactaagcaggaggatcacttgagctcaggagttccagactgtaatgcagtataatcgtgcctgtgaatagtcactgtgctctaggcctgggcaacacagcgagaccccatctctttttttaaaaaatcccataattccagcatctatcattgttttttcttgctgatctttatcacttttgcatttttatttcatgaatggaaatgcaaacaggaaataaatttacatgtacactatac

SEQ ID NO: 25054 - DNA, 1030 bp, Homo sapiens
ggcatgtgaggtcatgtgcagagttttattcatattttgagaattgatatattattggaagcagaagtctagagtctaataattgtttgttaaatgaatgaatgaatgaatgaatattctttgtaaaagactgaattcaaataaaccattgggtttaatgcagatttaactctcctacatttcactttgactcccacatcctccaagataccaccattgtgtctttgcagaatgagtgaatgaatgaatgaatgattattctttataaaggactgaagtcaaataaaccattgtgtttaatgcagattagagcacacatgaagccagacatggttttatttcactggatctcttttgacaagacaatccaatataaaatgccccttagaaatatatggaaagccatgtgacataagaacaaagtgggaaatgatggtcataatatgctgagaaagtctgaaatggaaaattcctttcaataagaaaccacataataaaaagttctcgttatatttgtagttacaagctatggtttattactctgtctagagattcttgtaatgattcattgttattggaagaaataaaatagggttcacaaaggagcttttatcagattataatgtgccctatcataaagtggggaaaaagaggcttatctggctatttgtagtccttgcccatgtggccatggatcagatactaattagaattctttttgaacccctggaatgctctgcagagtgaattccatgtcatgaccacacttgaagagtagtgcatgagaaggctgtttgataagtcctttaggtactaaaacaaatcaaaaccagtcctatttattctaacaaaagcctctctcctcatatgttctctgctttgcaccaaatgatttttggcttttcatctttctaaagtctagatatcctgatactttcatggaatttttgtgtaacttaccagtcatgtaagactgttaccatagagtaagtggtgagtttggcaaagagaatggattgagaatttggat

SEQ ID NO: 25055 - DNA, 1899 bp, Homo sapiens
ggaatatatggaagcagcaaggaacataagaggaggtccaagcaaaagcagtggataacagtgcaaacaggaactatttactgaaagtccttactaaggagtttccctttatcatttaaatagcaaacagaatgaacattttaaagtaaaattctgtcatttcacttcttataaaccttcaatatggaacaattatatgaccacatgcaaaaagaaaagaaaaaataacctccgtctataccttacaccatataagaagctaatctgacatggttcacagatcttaaatgtgagcactaaaactataaaacttctagaaaacaaatgggagaaattttagttacagtgggttaagcagaactttttagagcactaaaaccaggaagtacaaaaaaatcaacaaattagatcttctgaaaattaaaaatgtttactcttcaaaagatactcttgagaaaatgaaaagacaagtcacagactaaaaatatttgaaaaacacatatccaacaaaggatctgtatacagaatatataaaagttccgaacccaaggaattgccaaaatttaaggataagcaaaggcacaagtagactatttactaggttattttagacaaagagtaatgagaagtggaagaagattgtcagagagaataggacacaaatgataaatgtattataaaatgtggcagagacaggtggataggacttgacacttttttatatttgtaaacaagagacaggaaggacccaaagctgacctgagactttgaggctagaagatcagaagaaaggtagtgcctttaatagaaagaatcatgaagaagggtcaagttatgagaatgaaagtatgagtctggagctccagagagatcaatcaaggttagcgatacagatttagaagtcatctgcattagaggtggtagttgaatattgaatttgtccacaagattgcacagattaaattaagtaataattctttgatgggggtaacagccattagttttttggttaactaaaagcctaagatgaaggcaaaggcagttactagagttaatgatcagtctcatttttgctattatcatgttcagtggtttgaaacaactagaatttttctctgaaaattagcagctgcatggaaatgcaaagtttctagcagttacaaattggatactaagttaaattgacttatatatttatatttacagaggatcttaaacagaaaaatgagatctttgttcaagtttttaaatattagtgagacatgagaacatagaagtcatacaatgaaatttgcactgattttgtgaacataatcttatgatttcttttaaaatgcaattatatgctttctttaaatcatattagttgtctgttttgatcaactgacaaaagtcagcttatccacatttttccatttagtaaaaataaattttgaataaatgatgatatggtcttcctaaagtgattagtaatacaaatatagggttttctctttttgttgttttcatcttcagagattagtagaaaatttttcttgttatttgaaaatacttttttttacacacatacatataaattacaggtttgcaaaaagtgacttcattttatctattgtaaactggtgattcctgtttatgtgatcataaatcttagtttgcctacttcttgcttgtgtttgttggcattaatgctgaagttttgacaaaaattactttaacttttgcttccctcggaacaaccagggaaaaatatcaacagcgaaaccggatagatgtggcaccaatagcttacttcaaataaattaatacttcattttttaggcaagaatggtaatcggttctgttctattagcctcagtggtgtgaacatagagtttcatcacattattgtgtgtaaga

SEQ ID NO: 25056 - DNA, 1075 bp, Homo sapiens
taattaagtgggtgaacttgcttagatgaatgaaaccagattatttgagcagggccaatgatgccagagaaaaagaaaaataccaatggagagtaaaataagtacacaaaatgaaagattctgaagttttggaacgaaagttttagctcaggaaatggaagaatacttgagagtttcatgagaaaaaaaataagtgatagtgatagattgtaattatgcagacttctctgaagtcaaacagagaagggagagtatgagatctgtagtggttattagaagaatgattaagagaaagactatggcttaatgtttctcttttgccaaagatgttagaaagtactcaataacattaaagcagaagaaacagcaataaaataagaaggcatagatacagtgatgtcattgaaaaagcacacagtcattgaatctttggctttggagggatctccataaccatttgtcaacatccccacgcctggctgaaccacagaatcacctggtgaactgttgaaagagattctgacattcctcacctcatatggtgaatctttcaaagatgagaaggacgtaaatttcacataagctgttcttagccctttttggtcccttaaaattaccccattcttaatttttgtctcctgagtttccataaattatctatgtattcatccagcaacttgaaattcactattttgctgttttcagaactgtatacgtgctttcttgtccaatcaccgctactcttttaaaaattgagaccttagcctggatcttctgcatctcttatgtcttctaggattactcaaagatccccacagaagttctgcagtcacatctgtgagttccttcagtgaactctgataagattcatttgggcctagagacacaaactcataaagcggctagatgctcccttttagttttatcacctctctcaggcttcggttgcttcttaatctgttgttttgtggcttagtgtgaagatcattctcattgatagggaagatggcagcaaacagaatgcttgagtttttgttctctcttactgtcatctgctaatactataatatctgcc

SEQ ID NO: 25057 - DNA, 1035 bp, Homo sapiens
atcactgtgccatttctagtaccatttctgctgtctggaatgctcttctgtctgagttggtccgaatgaatggaaattcaatgaaacctcgctttctccattataccttctcaaactacctaagttggaagagaattcttccattacctatcctgggtcaagttgcttgattgtggtaattttcagtttctttacctacaaaatgggtatataacatcataggaatgttgtgagaattaaataagactctgaagtgaagcattcagaatagtgccaggcacagagacagccaataaatggtgaacttactatttttcttcgtctttctttgaaagagaatgaacatgagtatcaaactgttgggtttgaagcctagctgttccctgtactagctgtgtgatggtgcatgttctgagaaaactttctgatcttgatcatttgaagaagaaaaaaaggataaaaatatctagccttcagagttcctataaaatttacataacatgaaatacttaaagtacctagaactgtgcttggcacataatagatacacattgtcattattattgttgttatttttctgcatggaatcgtagatgtttgtatttacaaacatgccttctctcccttactacctcaccatttccttggggtgaggatgatattgtaatcatttttctgtttctctcaggatctaatacattatgtttcacagaataggcactcaataagtagttgctgaataatggatgaatgaatgaacaactataaaaccgtactgattttaattttatttttcaagtgaataattgctgcaatggaactaagagcagaataggctaaatcaatggtagacaaagctatagcgtttagagatataagactttccctgggctatgaaatggtgtcaagaaatatgaggttatttgtaactggcagtaggacagtggaaatgaatcattgaagcatagtggccagtccatcaggactatcaacacttgtttccctgtggctgaaccagatcctgagagacacagc

SEQ ID NO: 25058 - DNA, 1028 bp, Homo sapiens
acaataaaggaaaatctgtatagaagagacagcttagcagttaaggccatagattctaaagccaaaccttcttgatttaaaacctggctctgccactcagtatagttgtgtggctttgcggaaattattaccatctctctggctcagtttccacatctgtaaaatgagcataatcgtagtacctacatcagagtgttattacaaggatttgcattaatctcttaggctaagccacataccttttcattatacaatctttgctgatgctaagaacagattccaaaggacagattacatatatgagttcatatatgtaaacagaaaaacagcagctggcagttaataagcaccatttaagtttaagctaatgtaatatatgctgatatgtgagcatttacaccattttgtcattaagattgcgattcattccctgttagtgaactttgaagttgggtagggaattacaaaatgttcttaattctcaactttagtagattttttttttccatttggatgacagttcttatcaaataacttcatatatttgtctttacattttctgtaaccatatagttataattattatatagtcatagttatatatagttatatagttatttttaactttttattttgaaatttttctagagtcagaagttgcagataaaatattgagaagttccttgtacccttcacccaattttctccagtggttacatcttacataatcgtagtacaatatcaaaaccaggaatttgacattggtacaatgcatgtgcatagttctgtgccattttgtcacacaggtagatccacgtaaccatttttgcagtcaagatatagaactattttcatcaccacaaagacatccctcatactactcctttacagtcacacatctttccccatccctaactcttggcaatccctcatctgttttctgtccataattctgtcatttctagaatgttacctaaatggaatcacataaatggggtagcatgtgaccttttgaagcatgtggcttt

SEQ ID NO: 25059 - DNA, 1068 bp, Homo sapiens
tgtgctgtgtccagtcttctattaaacccttctgttgagcacttaattttagttattgtaattttcagttttaggtgtctatttgtttgttttaccctgagatgctacttctctgatgaaattctccatcatattatcttttttcttgaataaattaattgcagttattttaagaaccatgtctaataatgtcactatctgaataatgtcactatctgaactgtgggtctgttcatattgtttgattttcttcttcactttagtcatttggtcttatctcctggtatgcatatttttgatcaaatgctagacacagtccttgaaaagctgtagaaatctcaggctgatgatacctttcttcagagaagatgtatttaataatatgtcccattaagggacacattgccttaatgcagtctttgattgagatcactagaagctggattttagttatgtgaggggtagtgtattagtttactcttactcctagagggtaacctttctgtgattctaactgagagtctgtgttgtttacgagtcccttcttccttagcaggttctcaactccaattcctatcttcccatccctgtgagaatgtcagaatctctgctcagcctccaagtctctttgccactgcactctgctcattttcttagcatttgattctgtgccacttgtgaattagcaaatgacttggagagaaaaaacgccacagaatattgggctcagttcagtgtgcttacctacctaccttttagaatcagtcttggcctcccaagtcctagctgtcttgggagttctccaatgccttcaagtagtttttaggtttccttttttttaagcttatccagcttttttgattattctcatgagagtaagaatgcaacaaattcttccaccatcgccaaaaatagaaacccttatcttttttttaatgttaagtgttgacaacaatatatggttaacagacttcgttgttagaaggataaaaagaaattaatatatatgaaagtaacatgaatagggcctggtacatgatagacacttttaaattactttcaatttga

SEQ ID NO: 25060 - DNA, 1088 bp, Homo sapiens
gtttgaagtcaggtagtgtgatgcctccagctttgttctttttgcttaggattgacttggcaatgcgggctcttttttggttccggcctttgtttctttatgctccaccactatggcttgattcattgggtcaaggtccagcccagggttaagatttccaagacaagtcttcgagctataggagtcaaaggatcagtttaccaagctagggatggaaatactaagacaaggatctcaaaggaggcagatgctgaaagcaggacacatattgagaaagacaaaaggtcagcctcaggttgccatggtgaggtcgggagcccagataagccaagccaagttgtcagattgttgcatccaggtcaaaatgccacaggcagcatcaggatggctggggggaggaccgcagttcaggattatagtctgagctgatgtattattgtgattttcaggtttcctctaccttatgaccctaacttgcatgttaacctctctggaccagtttctcaggttgcccacaggatcctgacataaggatgagtaattttgttgaacccttgaaaattcatgcaaagacacacttttcaaagttttatgttagtgtagagcatagtttttcatcagattctgctgccgttttatgtgacattaaatactctcttaagatgctgaagcattgtttcctcacctactaagaggtatcatgtcagagataatggacagaagaagcccttagaaataaaagcagattttacatttggaaggtttgtgttgtctgtttaatattattcaccctttccctaaattcattattcttaacatagaatattataggcaattatagtaaacaaagaccccttaatttagagtagagtaattgttttaatcaacaagataacttaaatctggtagaaattaaatgtccatataagctaagacatagtcttgttatttggggggaatcttttggcaaaaataatttgaaatgggggctaccttcattaatagtgacagtaaatttgggaagaaattagaaagaagtatccccaaagttgtccatggatagtcagctatcagtcctaaaatttcac

SEQ ID NO: 25061 - DNA, 1078 bp, Homo sapiens
cgattcttctgcctcagcctcccaagtagttgggattacagacatgtgccaccacacccagctaatttttgtatttttagtagagacagggtttgaccatgttggccaggatggtctcaatctcttgacctcgtgatcagcccacctcagcctcccaaagtgctgtgattacaggcgtgagccaccgtgcctggccaacacaatcttaaatactcaacaagctagcctaacgaggaatgccagcaaataggtcattgctaacatctcttttggtgtctttctttgacaatgttccaagtggctacctaacatgctggcaattatgcctatagggtgagtacctcatttaagtatttttgtagattaagtcaatctatgtttatgaattttgaaataatggatatggctatggtggcatgaccctacttgagcattaaaaaaaaaaattaacttccaacatattttaatgcaaatgttacctttgtaagtggatgacctgaaaagaaagtgtttccatagtaacctaagggaacacataactgtttatcagaacttctccaggaaaagagcttggcatggactggggatctgctttgatgtctgctgaaagaaaatagctgacagcattgtgtgagaaaatggttagaagatcccactttatttgtagttaatttagaaaataaactttcataatgaactgctgaaatacacacttgaaacaaccagatgatccatcaggatattttttaaaatgtaatttgtcgggtgtgacaaccaagtcatcagtttaagagaaacagattagggaagagatcttacagcaggtctttgccaccatttcactcattttttttctgtactctgtgttcttctgtaggaatcactaggcctttcagagctcttagatttttttttctttgcttactttttttcctttttaacttcagaaaacgttacgtaaaagctgccctttgggaattgagactctacattgtgaggctatcaccaaaaagaaacctattgattgattatacttcactttctttactgacacggctgtttgagttagtagcttttt

SEQ ID NO: 25062 - DNA, 1050 bp, Homo sapiens
aggaaggagagaagggaagaagttcccttctcttctttttaagggcacgtatcacttctgctcccatcccattggccagacctatgcggtggccacaccaaactgcacaggaggctgaggaacatgttctccagccggacggccagcttaggagctgctaacatgtgtctcttcttctctttccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatagctgagtgccaccgaggccagcccggtccagaaaggaaggtgtctactctacctttgccctttctaaacctgaagacctccttggtgttaggaattctccatgttactgataagctttttctcactgacattgtaacgcatgactgctaatcagagagaaaaagaaggggaagggaattggggaggaaaaaaaatcagaaggaagacgaaagatggggctataaaaacaaaactacctgatagttgaaacgctttcagagttgttcaaatcagtgagagtggcaacggaacacacaaacaactaattatggaactctactctggggatcctctctggctagataacctgtgctgatgtgcagacacgtggacatccccctctgagactggcggtccagaggcagtctctgccaggcagcattacccgctccgaggtggagcctcagcccccttcttagagctgttaagtctaaggtgtggcagagcagacagagatagaggcatctg

SEQ ID NO: 25063 - DNA, 1765 bp, Homo sapiens
ccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccaggtaagccactgaaagtttttctatttattgcaacatggtttcccctttaaaagtgaccgctaaagcaggaaggccacgcagaacggcacagaagaaggctccctcagtactcaataatttaaagagagatcccagccggcccttcctacaccaccacggctgctaaaacccaactttcctctcctgctaggagtgtgtgtgtgtgtgtgtgtgtgtgtgtgtgagtgtgttttgaaacagaatttggcggtgttcatatgtcacatatggactgaatcaaaggtttaaaaatactacaaagcctttgcattacagtttttgggaattttttttccctgtcttgaagcagaacacatctcccttgagtttctccaactagccagtgaaatataaatcatttgcattccctccacttagctacattgagcaatgttaactgaagggcttgggaaagacaagagtttagttttggttttcagatgctgtagattctttggagaatgactggttatgcttcagaatcataaggctcaggctggtggagcaagttggcttgtggctgagataggggcttggggttgggtgctgctggcaaccaagacggttggtctcttctctcttcatccatgtgttgtctgggaaagtaaatcgtacgttcttttagaaattattattagctaaaacaaattgcaggccctcgaaggtctctcactcttgtgaagtggttagaaacttttgagtggaatttgttctcaaccactgccaaaaagggtgtgtggacaggctgctgtggagataagcatttcgaggcccagaacagtctggggaccgcatttgtggggagcggcaaggggtatgctctggaaaggggaatccatggggaatgcagtggggtttgtgcttccttctcggaccactctctagagtgagcctccctacccctctgagaacagtgtctggaatctaacaacaaaactcttagcagctgctacaggtgattggagatggagaaaccatctatggaggaaatgggtgaaagaaaggcgaaaaagccttcctgaagtgccctcacccaaggcacttgcaaggcgatggcggcagtggtagagctaactctgcagcctccttggcatccccagaac

SEQ ID NO: 25064 - DNA, 1068 bp, Homo sapiens
tcctgccgatgtggaagacactacaggaagtggagctacagatagtaaagatgatgatgacattgacctctttggatctgatgatgaggaggtatggcgtcttctataaagaacatatcggccaggcgcagtggctcatgcctgtaatcccagcatgttgggaggctgaggcgggtggatcacgaggtcaggagttgaagaccagcctggccaagatggtgaaaccctgtctgtactaaaaatacaaaaaaatgtggcaggcatctgtaatcccagctactcaggcggctaaggcagagaattgcttgaacctaggaagcggaggttgcagtgagccaagatcgtgccactgcatccagcctgggcgacagagcgagactccgtcccaaaaaaaaaaaaaaagaatacatcgatcagcaattgtatcaatgtggttaagccaaattgcctggatttgaatcctggctttaatttatatgcctttttcaaattctgactggttgcatgatgaataaaatcaaatcaccatctttcggctgagttcgtgatggatttgcttttttctgattaagccagtcttttttgtgatgaccccactagctttaagcagaggaacaaccagctttctgaagtggattaattttttttctttacaggaaagtgaagaagcaaagaggctaagggaagaacgtcttgcacaatatgaatcaaagaaagccaaaagtaggtcatttgtttttaacttcatttcatgttaatgtaagtaatctttttcaaagcttgaccttgaagtaatttcctccacattccttgaataggtcaatattttaaaacctgtacaggttcttccacagctactggtctgcagctgttcttatggtagcagttgtggcattcctctgtgggaaagaaactgttaacacaaacacctctttcttagcaaaacagaaagtgggtatatatgtgtgacagacacaagatgtatctgtagttttgtttggctaaggagatagtctcaaaacaaattgagatggatttgtttgtgtcttggagtagggtgaaaaaaat

SEQ ID NO: 25065 - DNA, 1036 bp, Homo sapiens
gcccagggcatcaggtcgtagctgagattctacccctgaagggcagggcacagcactgacctgactccagggaaaaatagttgctctggaggtttgatcctggggagcagggtgtggctgcagttcagagctcagtggcaacttaggtctcaggggatgaggcattgtgtagtagtgactctagacactgggatggtgggactcagcagcagcagatacacagctgttgtttagacccagggtagggcagggaacagtacaacaatgactccattccccaggtaaatgaatgtctcagcagctcagactctaggggtctagtctggtctaggaaagcagagtactagagttgtttggctagtaggatgaggtgtctaagcgtagccactgctctgtttccctgggacatgaggtactcagccctggggtgcacagctgctcagcttggccaggacactatttccccagggggcaatgtgctgcttcagttcaggtttgggcggggttgggggacagtggcgtgagtgttcctggcggccatttctctgggatgcaaggtgccacttcagcttaggtattggggtgtgtgactactctgaatatgtaaggcagtttcctgcaattcaggatgctacttcaacctaggcactggggacgcatgacttctttgagccgctgaggtactatttttctgggaggcagggtaccacttcagctccagcctgatggggtgagaggagaggtgggtgaagtggcttcacttcttcttggttctatgaggaagggtttaaccactgtttgtagcttggcctggggatgtgaggccaccgggctgggatgattcagcagtggcttagcctcagggacaaaagggagccatggctacttgccaatggagcaaaacacgtttcagccatagttccacttgcaagatggtgtagccacatgggtcacaggggtcagggcacagtattggcttcttctctcaggggaacacagtggtgttgaccccagacggctccctcagctggtcttt

SEQ ID NO: 25066 - DNA, 1029 bp, Homo sapiens
ctacagattccagaataaattttgattctcatgaaccccttcagtccgtaactaataaaattccaggggcgaataaagaaataaatcttttgagggaggaacatgtttgtctggatgataagggctatgtgcccagtgattctgaaataatttatgtttcaaatatccctcttcagtcagtgataaaacaaccacacattttggaagaggagcatgccagtctggaagataagagcagtaattcttatagtcctgaagaaagttctgattccaatgactcttttcaggcagcagcagatgagcttcaaaaacctgtcaaagaaataaatctttggaaggaagaccatatttacctggaagataagagctataaattaggtgattttgatgtaagttatgcttctcatattcctgttcagtttgtgactgatcaatcttctgtacctgtcaaagaaataaacttgcaaaagaaggatcataatgatctagaaaataagaactgtgaagtctgtggttctgaaataaaatgtcattcttgtgttcatcttcagtcagaagttgaccaacctcaagtgtcttacaaagaggcagaccttcagaaggaagagcatgttgtcatggaagaaaagaccgatcaacctagtgattcagaaatgatgtatgattctgatgttccttttcaaatagtagttaaccaatttccaggatcagtcaaagaaacccaccttccaaaggtggtacttgtggatctggtgcccggtgatagtgattatgaagtaatttcagatgatattccccttcagttagtgactgacccacctcagttgactgtcaaagatatcagctgtataaatacagaatgtattgatatagaagataagagctgtgacttttttggttctgaagtcagatgtaattgtaaagcctctactccctcaatgacaaaccaatgcaaagagactttcaaaataataaaccggaagaaggactatattattctgggagagccaagttgtcaatcttgtggtt

SEQ ID NO: 25067 - DNA, 1031 bp, Homo sapiens
gaggaggctatgaactggggacaaatggaggtctctgaagggaaaactaactgcagtgagagagaggccatgagagctgcactcaagtgctatctcccttgatatggtttggctgtgtccctacccaaatcttactttgaattgtagctttcataatccccatgtgtcatgggagggccccagtgggaggtaactgaatcatgggggcgggtttttcccctgctgttcttgtgataatgaataagtctcacgagatctgatggttttatgaaggtcagttaccctgcacatgctctcttgcctgccgccatgtaagacatgcctttgctcctccttcaccttctgccataattataaggcatccccagccatatggaactatgagtccattaaagctttttttctttataaattacctagtctcaggtatgtctttatgagcagcatgagaatggactaatgtaatacatcccccatgctgtcctgagctttctgagtgcaacctgagtgtgcaaggctggcatgatgaactggaaatgagggaactgtgttagaacatgagatgtgttgctgggggtgggctctagtttagattacttctgtctgggattaaccaaaaagtttgatatgtgttagaataaaggtagagagtcaggagaatgtttaagtcagtaatagaggacccaaaagagcttctgaggaaagagggacctcatttccactataggatgatcattgctacattacagacagaggtgttaagttatcaaaggagggaaaggtgtctggtaagtatgtgggctcagggtgtggaggaatgagcacataaaggtgttaccataagttaatccaggtggtgaccatagaatcttcagagttggtgacctcaccaggcccagaagcccagcttgtgaggactaacctgacaggagttcctgagaggagagcctggtttgcatctggcttgtggaggcatctcatggcagtgctgtgtgttttattcatttgttcagcaaatgttgagtgagcat

SEQ ID NO: 25068 - DNA, 1091 bp, Homo sapiens
tcctaactagagaggagaactcaaaacctggcttcgacgctgcaaagaacaggctgactcttgtttggtgataatgcagcttgtgactttaggttgaagccagtgctcatttagcattctgaaaatcctagagcccttaagaattatgcgaaatctgttctgcctgtgctccataaatggaacaacaaagcctgggtgacagcacatctgtttacaatatggtttactgaatattttaagcacactgttgagacctatggcacaggacaaaaaaagattcctttttaaaatattactgctcattgacaatgcacctggccaccaaagagtgctgatggagatgtacgaggttaatgttgtttttatgcctgataacacaacatccattctgaagcccatgaatcaaggagtaatttcaactttcaagtcttattatttcagaaatacattttgtattacattttgtaaagtgatagttgccatagatcgtgattactctattgggtctgggcaaagtaaatagaaaaccttctggaaaggattaaccattctggattccattaagaacattcctaattaatggaaggaggtgaaaatataaacatttacaggagtttggaataagttgatttcaaccgtcatggatgactttgaggggttcaagagttcagtggaggaagtcactgcagacgtggtagaaagacagtaagagaggaacaactagaagtggagcccgaagatgtgactgaactgctgcaatctcatgataagacttgaatggatgaagagttacttaagtggtttcatgagatggaatctactgctggtgaagttgctgtgaacattgttgaaatgacagcaaaggatttagaatattacataaacttggttgggcagagtttgagaggattgactccaattttgaaagaagttctgctgcgggtaaaatgctgtcacacagcatcacatgctacagagaaatctttcatgaagagtcaatcaatgagacaaacttcattgttgtcttatttcaataaattggcacagccactctagccttcagcaaccactgatcactcagttcagcagcc

SEQ ID NO: 25069 - DNA, 1022 bp, Homo sapiens
gtcttattagcaatgcattttagctccattagcaaatatgaaaagtgatctattcctcttgacagcttgtctccatgaaaagtaactctaatgctagagttcatctgtggagcccacagccagagaatcccccaagagatattgccccatttcagatatatttttaagtactattaataagtgaacagtatttcccatacagtcatcatttataagatgccacaacaacagatcaaagaagaatatcacatgatagctgattatacggccattgtatgtggcccagttgatgtgctgattttctgtgataaattgaaacatttttcccttctgtccctaatctctttagctatttgagcccacggaatgtggaaatggatacgtggaagctggggaggagtgtgattgtggttttcatgtggtaggtataagaaaccttctatacttacagcacagatcttacttggtgcaaacaggtatagcatttgtgagaggccagcacattgattgtggtcttactgcctttctttctcatctctctgattagtgcttaattcaactcagacctgttggaatcagtcatgtccttatggccttgtctgagcaaacctaatagattcttctaattaaattccctacctcttaaaaatttgtagctcatattcatctcagataagttttaccaaatcgtaaaacattctttccgtgttgtatattatttttatctttataaaatagattgggtattagaatgtagtggagctaattggaggagaattgcctgctaaaaattaagctttctcggccgggcgcggtggctgacgcctgtaatcccagcactttgggaggccgaggcgggcagatcacgaggtcaggagatagagaccatcctggctaacacggtgaaaccccgtctttactaaaaatacaaaaaattagccgggcgcggtggcgggcgcctgtagtcccagctactcgggaggctgaggcaggagaatggcatgaacccgggaggcggaggt

SEQ ID NO: 25070 - DNA, 1053 bp, Homo sapiens
tttacacttagtcttttgttactttaaaactagaacaaaaaattcttggatccaccttctgaagttagatttagagaagatttaagctctaacaagagaagccaaggttcattctttccaaattttctctccacagtgtttctgtgattttttttttaagatctagatgctatttcctcaagtgatgtataaagatgcctcaacggatgagcagagctaaatttacttagactctgcctttttttctttaagtagagtagggggttattaattgtctggttctgtaatatctattccctgttccttcacccacccatgcctaaaaatctttggaggcattaagtaaagaaagtcacattctagagaaagagtactcacagctgccttttgttttgttttgctttactctctccatttaatgtggtagtatcccacactacctttaaaaaaaaataacttttttgatccttcaagtaatacatacttattgtagaaaaatttgaaaatacggaaaatattaaaactcagaggtgctcaagataagccttattgggcctggctcagtggttcgcgcctgtaatcccaagactttgggaggccgagggcaggtggatcatctgaggtcaggagttcgagaccagcctggccaacatggtgaaaccccatccctactaaaaatacaaaaattagccagacacgatggcacatgcctataatcccagctacttgggaggctgaggcacgagaattgcttgaacccaggagacagaggttgcagtgagccaagatcgtgccactgtactccagcctgggtgatagagtgagacactgagccccctactcatcccccaaaaaagaggccaggcacggtggcttacacctgttatcccagcactttgggaggcccaggcaggcggatcacctggggtcaggagtttgagaccagcctggccaacatggtgaaaacccatctctactaaaaatacaaaaattagccgggcatggtggtgcgtgcctgtagtaccagatactggggaggctgaggtaggagaa

SEQ ID NO: 25071 - DNA, 1038 bp, Homo sapiens
aaactaaaaaattttaaaactctgttgtagattttattattttgtttttgattgtcaggttaaaagaagattccaagtgagaaattatgtgcttttcgttttattcagttagcaaatatttattgactgtctactatttaaaagatagcgtatgcttggcacacagacactccataaatattacactcttctcttttgaaatatgcaaaggaaatgagatggtgcatgctagtgccacttttcagtttatccatattcatttgttttgttgccttgccgacgagtaataggtaatggactcaagttattaaaacaatcagtgttttacttactgtaggctcagcagtgtgtgagacactaagatttttctcaaaaaatgcatgttgtggccgggcacggtggctcacgcctgtaatcccagcactttgggaggccaaggcgggcggatcacaaggtcaggagatcgagaccatcctggctaacacagtgaagcctcgtctctactaaaaatacaaaaaaattagttgggcgtggtggcaggcacctgtagtcccagctactcgggaggctgaggcaggagaatggcgtgaacctgggaggcagagcttgcagtgagctgagatcgcgacactgcactccaacctgggcaacagagtgagacactgtctcaggaaaaaaaaccaaaaactgcatgttgtatcttttttctcatgatccaactggtttggttggcacctgcctgattgagcacagtgtttgggccctccccaaatgcttgccatttataatgggcaccacccacagtggccaatcatatccatagatgaaggttttctgtataggtgcagtaagagtattaaaaatacttagttttatttaatttcaatgtgcttccattatatagagaaaaaaattcaagaaacataatgaaaatatggcctttttaaaaatcatgaacatgggcataaaagataaattgtacccaactgccctttggatcaagaccaaattagtaaaaatgaaggcgaattctatgac

SEQ ID NO: 25072 - DNA, 1061 bp, Homo sapiens
aataaattacagaatagataaattagtgtagaagtagaatttttttcaatgagatgataaattctttgtagctatgaaaagcagctgcaacctttgttttcaaatatgtcccctataaaaatccacccacccgtgagctactcagttaatttatgtcaaggtgatgcacaagttcctacttgccaaaacaaagttcagcactctctaaaggaagagaacaaaagcaaagcagaatcgacaaaaagaaaatcttcacatctttaagagacaaccatgttcagtacaatgacaaagaatcaaatggcactttacatgtatttgcaggatactgtgtcactcaaagtaatgggagggagagagaacagggagggtagggatgcttttgaaaaagctttttttcccacttttaacttgctttagcgttaagagtacttaccagctaataatgtggaggaaattattctttctcattggagattacagaatatatctattcatcttgaatacccacttgaagcctctgtagaaatgtctcgtcctccggttgtatttctaaaacctacatgattttgtcttgtttctgcagtgagaaattacatccatagcaaagacaaaagtctttttaaattatttttatttatctttcatatagttcttacaatttctaaaaaattaacactcatttagtatcacaatttatgggagagggttttttgtatttttaagcatatgtggcttatataaaaattgcagaagtcataggactgtcatgtattgcagctctgagaaccaatgcctgaaacttaagccaaaaaaaaaaaaaaaaagttatgaccaggcacggtggcctcatgcctgtaatcccagcactttgggaggccgaggcaggcagaccacgaggtcaggagttcgagaccagcctggccaatatggtgaaaccctgtctctaactaaaaatacaaaaattagccgggtgtggtggtgcgcacctgtagtcccagctacttgggagggtgaggcagaagaattgcttgaacccgggaggcagaggttgcagtgag

SEQ ID NO: 25073 - DNA, 1044 bp, Homo sapiens
tcttgtagtgctgattaaatggccatgtgcctgatatcatcagagttttagcatggatccaaaggcttactgaaaatttaagcagtcagtggcacaaaataaaatctctgattaatgataaatatatgcctgattacgattcagttttattggattcattggaattttttgcttcttataaatcagaaaaaaccctaccttaggatcgcttagagattttttttttttagtatctcccttctgagttttaagagtggatggctagtaataacatccacactttggacctggtaccaaatttgtaatcaagcaacaaagaaagtagaaggaaatctggttatataaattgtattataaaaaacattctaaggaaggcatttcttcacagctcccatggaattggtcaccaaattatatcccttcttcatgaatgtcttcaatatgtctcctctccatcccattgccatgccttggtttggccttaacagacacatgtatctcacatatatcgactgcactgacacacagttactaatctcaccacattgatgaaagcattgcagggcttttcatttcctgtaagttaaggctcaaacttaataacacaacgtaaactcctgcccacctctcatgatctcaaacctgtttctttttgtagcctcattgactcatcctcttgtagtcaccttaaaggtcccctagaggaacctcttgtactcaaggcccaacaatcttatttaaatgttacgtccattacccataattcattcgtttccatgtcatttcatgtaataaatatagaaacactttaaaatagcatgaatattatacttaaaattagaaagcttattagagtatttgagtgttgtttatatttgactttaaatgaatgatttgtttttgtgtgtgttttcctttaagtcattctgttcttgaggatgacattgaaatgagttctactccatgcttccttagtaactggctgagaaaggtgacccagaaactccctagataatagagcagcaaacctagagttaaaatttg

SEQ ID NO: 25074 - DNA, 1057 bp, Homo sapiens
accatttattagtggtgtcactctgggcaagcgactgcccctgattttgatcttttctgtcttcatttgtgcttaaccacgttatactgtgtaccattagctgtgggtggtaggattaggcttgcagttcttttaacccatagtattgataactagataattttagttggttataaaactgtagtggtggtccaggcgttatagaaaatctagcataattatgaaaaggttctggagcctgacaccttatgttctaatactgcctttgctacttccttgtctgtgtgttcttagacaagttactcaatctctaagcctgtttacccatttttttaaatgaggagaataatagtaatacccatggagttttttagtgtgagttaaatgagttaaagtctataaaatgtttgtctcgtgcaagacatacagcaatagccaacatttattgaatgtatacacttattatgagataaccaactgtccagaatgatgtgtggatacttacttgcaaggctgattttcttatctcttttctttggaatcgttacagatattggccttctgtatatgttgggaaactgacttttctttgttccccagacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcaggtaggatgttagtgcagaattggtcaccaattgtgaccaattctgcactaccactagctaccatatgactctgaatggggtcttagttggagcagtgttagttgaaatttgcagagcaggtgttgctgtggaaagggctgataatggtgaagtcaaaggatagtgcttcaaagcagcaaacctacagacccttctttaatgacaagtcctacatgtagaaaaaaataaggaatgcatcattattccttttatttatactctatccttctatacaaaggctaactgttcag

SEQ ID NO: 25075 - DNA, 1049 bp, Homo sapiens
tagttcctgtgcagatatctgcctgaaagcttcagaaaatgttgcatggccttttcagaggctacctatgattctggaggctgttagtgttgctgctcttgcaataagagcttgtctttgagaacaaaaatacttctctgatgccgtttttgtttagtaaagaaaacaagaattgcagatattagaatgtccttaataccactgtgatgaaaaactcagcttaattgtgcaggtaggtttgtgataggtaaagaaggtggacaccttggaaaaacctcatattcctcttagaaggattcttgaaaacccaacccatactgcttgatgggcccagtaatttcgtgcttgtttctgtttttgtaagatcttatggatatctgtggacaaatgttttcctgctagcatcatcaagatactagttgagttattgatgacttgtctctttgaagagctctgtaaactagcttcattcattcatccagacatctatacatccattaatctgtatatctgttcaacaaatatttattaagcctgctagtatggactaggagcaaaagattttaagcaagtaatttcaatctttgcccttatgatagatttgcaaaaatgtctccaattatttgcctcttcatctttgcttcataactttatagcgctcttccatttctgactctggtctcaaccataagacttgctttggccaatgacttgtcaaaaagcaagtcattggtcaagcaaaggctttaaagtatttgcaaaatcaggcttgttatcactcttaccttcttcatcaacataagactatctgtgctagtctgttgggtgattagagacacttggaaaagagatgaattagcacagtcattccagccaagagtatcctatattggctgataatcagctgacctctatacatcaatacatcttcctaaacatgtgatattatccaaccgaggccagaagattcatccattcaacccagccaagatcagcagagctgcctaatcaaccatcccagaggcatgggtaaggactatttatcattg

SEQ ID NO: 25076 - DNA, 1032 bp, Homo sapiens
gtagttttctatgcagtattcactttccccttctttcttagaaagatgttatttgaggtgccagagtgctcagctaaaagactacattccacaatatttcttgcatgtatgggtggccaatgtgatgtaaactgaaggcagtaagtaaggcatcaagaagaatccccttactctatccctttttctcatctagaatgaaggtgagacatttgcagctttgagaatggaagtcacacgctaaagatgatggagctgcagcccccgatgactttgtgtgctgcagcaccagccctgaactgcccatctttggactttcctttctgtgagagagcaataagcttctcttttgtctaagcctctattagttctgttctctgatactagcagcttattgcagtttctaactgatgcccctagcaatattagtgagatcatcaagttcaatgggctggcattgtgtgtatcagaattgaaaatcagtgtaataaccatgcctgagcacaaccccctgggaatcttttgaacaaaatcccacaagattaactagataatattaggaatgctgttatcgataaagtttattgagcgttcacttagatgcctgggaacaatgcaggaaggggacctagtctagtcttgaaaaaccacagacgtcttcattaggaaggtgacgtgaatgctgaaaactgaagcaaagcagctaaaggaaaggtggaagggagtggagagggtgggggaagggtgttatgggcaaaagaaacagtgtttgcgaaggcagaggcaaagtgaacttgttctatttgagggaactgtaagtgctttataaataaacagaacatcgtgtcagaggtcaggacggggagtagatggaagtactacttcaggccagaaaactaggcaggggagcagatcatgcagacttttaaaaccacacttacacgttccagtctttcccaaaaggaatgagcttccattttcatatatatatatatatatatatatatatattttttttttttttaattatacttt

SEQ ID NO: 25077 - DNA, 1028 bp, Homo sapiens
tgaaccaatacaaccctgccaaaggccctcccaaagtaagcatatgtctctttatttccagcagaggaaattaacagcaccagactttcttcattattaacatgaacaaatggtggcttcggtctgtgatctatagctgtaagataagctgctatgctgtatcccaggaatacactggaacctggtttagggacgcaaggtggggactcaggatagctgaattgcttttggccactcttagattcctaatctctggtgtgacgtgacacttcagaaaagtgggccctagttttctccactgcaaattatgaagtgagattagatcaatgatttatatcagcagttgcacattttttttcttataaagagccagatcataaatacgtagggtttgtgggccatatggtctctgtaacaactactcagctctgccattgtagcttgaaagcagccatagacaatataaaaatgaattggcatggctgggttccaaaaaagctttatttgcacgtgctgaaatttgaatttagtacaattttcatatctcgtgaagtattgttctcattatttttttcaaccattgaaaatgtgtaaaataccttcttagtttgcacgttgtaaatagcagtggtgggctggattttggcctatgggctattattagccaatccctgttctctatggttacatcaaagtataaggtttctatatatgccctatttccttacaggaaacatagaatggtttttaaaagttcaacaatagtatattttctaatgtttgtacatttaataatttagttttaaacacagccaacctgtatggataagacttatgttggttataagggtgcttactttttggtaacaaagatttgtggaaaaactataggaccaaaattaattagcttccctgacactcctactatgactacagatactttaaggaattactttatcaattcttatgttgtcacacagacggataagaagttacagtattaatatttttaaaacttttttttttaa

SEQ ID NO: 25078 - DNA, 1046 bp, Homo sapiens
tcaatatatataaagctgagaaacttcacccaccccccttttttaggaaaatcctctgatgaactttacattaagatatttcacagtaaaagaaaaaaaaaacagcttgatattatgctctttggggagtttggtttttctctttggtattgtgtggtcttatgttagagtaatcctgcatagcactgtaatctagtcacagatcattgttattagtgtcagtgataattacaccatacattttgatggcatcacagtcttcaaagggtttttccatacattacttcagttaatgtgctccacaacctgagaggaatgcagaacaggtataattttttttctttttttacaacagaagacaagtgagatttgctgaaaattgcatggttgagaaatggaggaacatgattcagaacgcgaggcttctgaattctaactcattactctgcacccagcccatctaacgttgcactgagactctgacaaggaaggcagtgatctgtgatgaccttgctgaatatattaagcagaaatgagaagatgtaggacaacaacctggggcaaaatgcagataaggaaaggaaacctgtcctaattgggttgtctttcctttaagtacctgagcaatggatggaagcagagactcaggatgataaccctcttgatcaagtttttcaggatgatgattcagggtgatggtttggaagcattctctttgaaaactagttggtagttgatgcacaatgaaatactgtccagctgagaaagagatggaaaattatccggtggctaattcccaagctgatggccctaccctacctcagttctatccccacctcatgccctgcagattgctggggtttctggtggaaatccaactcctctttaaaacctcctccatttcctcaccctccatctctactcttagcacttgagagtgtacatttcgtctttgctcctcttccctccccagatgatccaaatagaaaatacatcagcacgtgggaaagagcaacgttgatcgtcttcacggaaaggctgaggac

SEQ ID NO: 25079 - DNA, 1046 bp, Homo sapiens
agtcattctgtacagttctacaaaattctgtttctctgttcagagctactgcttatagtttagtgtttaatcttgcacaccttttgcatgcataaacctttacaacaatttgttttacttttttaaaaaaataaatggggctctattttacaatgtgtcaatatattaattttttttcatggttacaattttgtaatggttctcttaatgatggataattgttttcaggggtttttttgctatgatttaaaaaattttacagtgaatactgttgagctacatctctggatattactatcgattatatggtcagtgcacttgtggctttatgaatattttaaataatgtagtcaagtctgttgatctttttccttgtcatctgtgttttgtggattttggtatttccaaactatattcatttctacagagttattttcatttccattttttgaactgtcacttgtaaaacactttctttttatagaaccttatgagtgatagcaagatgtattagtatgtaatacattgtgatggagtgtaatgatcacaaggatcagtgacagttttgatgaccaatttcagagttataaaataaatgaaatatattctggaaaagtcatgggctttttgtgttgtttgtggaatcactaaaggtagtccctcactattaacaaatttgttttgacacataatatgtgaggcactgaattataataggcactagaaacattgcctattttcctgaatcctttagacaggattgcttccccagttaccagagatttctctaaccttgatttacagtagctactgctggtaggaattgctctccactccacttttgctgccatccagtgttacattaccctacaaatatactaagtgcttagcaaagcagagtccaaatgtaagatcaatttttgtcttacccagaattttacaattaaaatatataaataaaagatttctctgtgtgtggatgtatgtgtacagtatagtgttgcatgctatacatggggtgaggtatcagaatgctttttcagtgt

SEQ ID NO: 25080 - DNA, 1044 bp, Homo sapiens
tccaaattttcataaaatcacttccctcgttcccatctctactactactaactgccctctttttggccttcatcatctttccttaactacttcatgggctttcttcgttggtctccccaccaccagttttccccctgaaatatatatctttcacactgccactaaagtgattttttttttttttttttgagatggagttttgttcttattgcccaggctggagtgcaatggcgcgatctcggctcactgcaacctctgccccctgggtttaagcagttctgcttcagcctcccaagtagctgggattacaggcacctgccaccatacctggctaattttttgtatttttagtagagatggggtttcaccatgttggccaggctggtctcgaactctagacctcagatgatccacccgcctcggcctcccaaagtgctgggattacaggcgtgagccacattgcccggcctaaagtgatctatctaaaagcaaacatcaccatggtattcaggagttcaaaagcccttcagtggcttctgcaataccctcaggataaaatgcagtttctctgaggtgacataatacaggctttttgtgactagcacatctagccccacctgcctctgttgttttctctctccctacttcatacatcatacagtaacacacttatgtgcaccattggtgctgagctgctggttatcccactctgccatgtgtgctgtttctctttgcttttgccactactccactctgtgcttgaaattctgtgactcttccctgtaagtaataataacaagtctaacttttttcttttgttttaaattcacattcttccctgatagcctccccttctcttaggttgggtagagtaattctcagtgtgtccatttttcttttagcaaacctcattactaaactgaattgtattgtgtctcttttccccattccttcgcatacatacccccaataatttatttgaggtcagagacccctatctttctcacttttgtagtttcagttctaacattattcctggaacat

SEQ ID NO: 25081 - DNA, 1022 bp, Homo sapiens
cacatctagttcagtttattttattcacagtataggaatatgctgcatctgtatagtcaccttatgtataggaacatatatacagaagaacaaacataaaagaaaatgactaatttcttaagctgcagaggaaaaagaattgattggggaaaataatgaagtacatgagataaagtggaagtgtttgggagaaactgtaggactgaagtacctcagtcgaggaaaattgagatgcaaaaatagtaactaattttctaaatctgcaattggagaaaaatatacccttgatcaaaaattaataaccttacctaagatattatttgaccttagagattacataaagcatttgtaaaatcagctgtgcttagggttttcagttacagtgtgtaactttgaaataatatattcagaggttacatcttaagggtcaggaattatactatgcatgttatctaattctttggagagatctttcctttgggtttgatccacaggtaataaaggcactgtagacctttgaaggtgactactctgtttaactgtagggaaccgagagcagtatagatcattgcaattgagcttattgaaaaaaaagacttgaacgttcattcaagtaggccataaccccagcctcccatttcatattttttgcttcacagtcttcctgtaaggacttaaaaagacttttctccggaacacaggtgagtcctaggtcctagatttggagagaactattattagaaaggaaggtgagaaattattctttatgtctttgtccttttcctctataaacatggaatttcaacacttgaacaaaaacctcagagatcttctgggtctaggccatacttgttacctccccagcccttagtctgttgcttaattctgtttaacatttctcccctcttcctaatggtagtccagcatttacttgaacactttcagagaaaggaagctcaatctcctgaggtaacctgtttacaattaggagtgattgctaaaatattcttctctgtgatgat

SEQ ID NO: 25082 - DNA, 1111 bp, Homo sapiens
attaatgtcctcagtagaatttgtcagccattttatactattgagtcatcgaacttctattaaccacctctacttcattctgtctttgtgcttttggttcactttgacacttaagtgggagcgtgggggaggagaagtaatgtttttgtgtgaaatcatcagttggatcaatttccataagacactgggaatggcatttgttaacaagtaaaagatagtgttgtgcatgtaaagatctaagaacttgatatttctatgaaatcacaatgactgagcaatagtcctttgccttagtttttattccattgagtgctaccttaccattgtccatactgtgccattactaattccctaaccatatgctcctcttagtaatagtgagaaaacttgatttgctagtgaggagacctagattccagacccagtttggacattaataagtcaaatggccttgggcacatctacctttctctttttcacttatagaagatctttctataaagaacacaaaaattacttaagttacagccacaaaatttgctaagattactgttttttattgtaatatgtgttattgttgattgtattcttgattttaatctttattctggggcaacataatttggacatgaagattttatggccattaagtatagaaatattctcttttttttatttgcttgtattcatctttaaggaacacatttgtccattaaggtccattaaggtgagctgtacttctaatttaagagtgtgtatttataaaagaaaagttggacttattgaaccctggattctacaaatagagatacaaatataatatttttttctttaaaaggcctaaactatagaatatctattttaatagttatcttagccagttaatggtgattagtgttaacaactaggaaatagtttttatcaaaagagatgatcaaacaaggagaggatcttctagatgggagacctcattaatattccagaataaagtttccaaaatatacaaggtacagttctcttgttgtgagaatagattattactttaaattatcattcattcctacaacaaatgtttattggtgacatgctatgtcactgttctgcttgctat

SEQ ID NO: 25083 - DNA, 1064 bp, Homo sapiens
ttgttattagggtaatgctgaccttataaatgaggtggaagtcttcccttcccttctctttttctggaagagattataatatttgtattatttaagccttatatggttggtagaatttgccagtgaacccacataggcctggagttttctattttgagaagttttttttttttttttttttttttaatagatacgggatcattcagactatttcttcttcagtgagttttggaagtttgtgtttttaagacattggtccatttcttcaaagttatcaaattcatgaccatagagttgtttgtagtgttagtttattattcttttactgtatgggatgtcagtagggatgtccccccgcttcattcctaatattgttaatttttgtctttcctctctctctgtattcgccacccctaccccagccaccctcctttttttttaagtctggctaaaggtttatcaattttgttgattgtttttaagcaaccaaaattcttagtttcattagttttctccttagaattgtattgatttgtactctgatctttgttattttctcctgcttgctttggtttttttagttgttctctttctagtttcttttttcattaactgtaaattttttcctattaatatatacctttgtcttatttcagtttctaagaaaacttctgcaggtatctagtttcttaagacaatagttggatcagtttggcaaatcttttgtaaagggccagatagtaaatatttcaggctttgcagaccaaatgatctgtcacaactactcaactctgccgttgtaataccaaagcagcgatggataatactgactgtgttccagtaaaactttatttacaaaaacaagcagggaagcaaagtttggcaacccttgatataaataattgatttaagccctttttttctaacataagtatttaaggctgtaaatttccattttagcattggtttagctgtgtcccacaaattttgggttgtcatttttatttgcattcagtttaaaaatttttttatttcctttgagacttcttttttgacctatagac

SEQ ID NO: 25084 - DNA, 1066 bp, Homo sapiens
agtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatgattgattttatc

SEQ ID NO: 25085 - DNA, 1053 bp, Homo sapiens
gagacatccttttgtccatctgtgttccttgtggaggcactgaatacggggaatattttacagcctaaagacctgtcatgctgctctgcacagcagccactgggtggctctcttgaccagcagttcttcaagctagtgccacaaaagggttagttactgtgaaaaggagaaggtaaaaatgtgctcagtattacttgggttttacatatttgagcataatatagctacctgtaaaattactatctaccatgcaagtatgatacattgtacctggtaggcactcattatttattgaacaactctattatgggtgtggaggtgataagagtgcctctcttgatgatgctgtttgctgagatgtccagtcattcctgtgactgggtgggaaatgtatatgggcagaataggcagcagagatatctgacctacaactgtgatttagtgtcttgctttggctgagtaagcaaagtctctgtagaacataagaataaaaggcacttattttctggtcaaaaacaaaagaaatttgtcagtcatgaattcttatcaaagcatttcggggccgggcgcggtggcttacgcctgtaatcccaacattttgggaggatctggtggatcacctgagatcaggagttcgagaccaacctgaccaaaatggagaaaccccgtctctactgaaaatacaaaaattagctgggcatggtggcgcatgcctgtaatcccacctagtcgggaggccgaggcaggagaatcacttgaacctgggaggcggaggttctgtgagccgagatcgcaccattgcactacagcctgggcaacaagagtgaaactccgtctcaaaaaaaaaaaaaaagcttatcaaagcatttaaactgaactaaaatcaaagaccagtgctctattttacaggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctc

SEQ ID NO: 25086 - DNA, 1041 bp, Homo sapiens
agctttattatttctgtcaagtataggggtcaggcttccatttttcctcatggatgtccagttggatatagtaccattgtttttgaaaagaccatctttcactgattgcattataaattccaccgtaagtccatatatgtgtgagggtgtgtcagggctctctttttctgttccatacctttatttttttctatccttgtaccagtaccctgtctaaaattattgtagcattaagaataagtcttgatggctggtaatattaagtccttcaatttgttcttcttcaagattgtcttggttattttgacctttcgtattcccatatgaatttttgaattagtttgttttctgcaaaagaaacctttgaggatttcatttgccattgcatattaataatcagtattttcaagaagccttcacacatttttattgttataggatagtgacctgaaacaatactggatgccagatagccaatgtaaagagtgctatgactgtagtgagaaatttacaacctttaggcgcagacaccattgccgactatgtgggcagattttctgcagtcgttgctgtaatcaagaaatccctggaaaatttatgggctatacaggtaaatgcattttattgccagtttacaatttttaaaggtcataactataagacacttataatacaggatagtgttaagccaattttcattttgggttttatgtgtaagacatggggacacaaaggtgagggagacagctttgcttttaagaactttcctattgaataatacagtagatgggacttatcataaataactagagtaaaagtgtatttattgtagatgctagcaaaaaactataggaacattaaaatttattagacaagatcgttagagtagattactaatttaaatcactatgagagttttcattttaaaaggacagatcttccttgacgtaattacatgacactgtgctttggcagtgaattgtgtcttactcagattcctccataaggaacatagtcaaatttcagcagtacagaaaattt

SEQ ID NO: 25087 - DNA, 1013 bp, Homo sapiens
aaatgtcagaggttctcaaaaagattttttaaaaagccagatgttctgaataagagattgtctttaattaacacttgagacttccaagttctctaagcactgttagcctcatttgtgctcttagacatcgctcatctctaggcaggagctagtctttttaaacagaaactcgtaccaggtaggactttgtcccatggcatgtggcacaacagataacctttcctgcccactcagactgcttctgcatgtgtatctttatggcagtttatatgaaagaacatggtcagttgacttcagttgcccaatcaattatataacagctttttcccccttttctctttcataatctcaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtggctgtttagactgtccgtaatggaatggtaaaactccatgaatttgcactttggtttttgatacctgtggagctgtctgtaggttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccggttaaacacgtgggcatttattgttttattgaggaa

SEQ ID NO: 25088 - DNA, 1100 bp, Homo sapiens
agactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgtttttggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttactttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgt

SEQ ID NO: 25089 - DNA, 1050 bp, Homo sapiens
cccttccttacaccttatacaaaaattaattcaaggtggattaaagacttacatgttagatctaaaaccctagaagaaaacctaggcattaccattgaggagataggcatgggcaaggacttcatgtctaaaacaccaaaagcaatggcaacaacagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaagcaaacaaccccaacaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcactaaaaagtcaggaaacaacatgtgctggagaggatgtggagaaataggaacactttgacactgttggtgggactgtaaactagttcaaccattgtggaagtcattgtggtgattcctcagggatctagaactagaaataccatttaacccagccatcccattactgggtatatacccaaaggattataaatcgtgctgctctaaagacacatgcacacttatgtttattgcagcactattcacaatagcaaagacttggaaccaacccaaatgtccaacaacgatagactggattaagaaaatgtggcacatatacaccatggaatactatgcagccataaaagatgagttcatgtcctttgtaggaacatggatgaaactggaaaacatcattctcagcaaactatcgcaaggacaaaaaaccaaacaccgcatgttctcactcataggtgggaattgaacaatgagaacagatggacacaggaaggggaacatcacacttcggggactgttgtggggtgggaggaggagtgaggggggagtgg

SEQ ID NO: 25090 - DNA, 1035 bp, Homo sapiens
ttaggaactcacaaccatctatttccaactcttgaattagtttggtaaaaatctctacatgtgattatttaaagtaatgtcaatgaagtaatttagatttattcaaattatactacttaatgaagaataaattattgcagtcaggcccatttttgtaacattattaggcaatgtttgctgtttggtgtgggagagtttgaggacgcttgaaggtgacattgtttctgttttcctgaaagaatgaagctggaaaacagtgatattactctacagatattaaactatacatgattgattgattccagtccagcattcattaattatactgtatttatcagtaacacattaataataaaattgcttaggttagaaaaaaatcaacttctactaaaggttacaaagaatggattttaaaaataactgtttatctagttataaggtcattaaagacaactaatatagttttgaaaatacaatgacattaattaaaattgcctgtgttcccccaaaactgaaatcatcttgtaacatctttcttaaaaaagtgttctttttattgttagtgtaattatactgctgtgtatgtgtacatgtatatatgtatactcacacatccagataattataattgtgtgtgtaaatatatactgttctgtatctatcccacccttctcatgtaatatcataagctttcttctcaatgctgcacgcatcatatcacaggaatagactatgaccattcccccagtgttgggcattttagtttttttccaaaggtcgtgaattaataaaatcttagagctggaaggagacttagggaagatttaatccagtcccttttcttttataattagatttttatggttaggactaaggtctaaaaaagttaattgactgagagattattttatttaggaaaataatataaatgacatagttccagaaatacttttgtctaaaaaaaagtgaaagaaaaataaactaaatcagtcaaggcacattcaaaatagaataaaaaatgtgcattagtaatct

SEQ ID NO: 25091 - DNA, 1023 bp, Homo sapiens
atgagaaaattaccactttgggtttgcaaagttgaggcttgttgagcctttttatctactgttcattcacaagccaaacaaagacacaggaactaatgaggttattttcagataactgagcagactatttaacaattactttctttgatgacttcgtccactattccttagaatttcttaaaaatttaaacaagaaaaaatttaatgtcaaaaaattataatatacaaatttgaaaaagttcattagctgttcattttcatgaatcaaaatgactgttgtactcataatgtttcttccagcgcccactgagagaccatttacaaatacgtaaaaatgggtccagtgactgaactcattaatgtctattccactaaaacgttctttccaaattcttcagcattatctattcaccccgggcttttcagtgtggttctactttctgtgccatgcgactcagcttgcgtaggaaaattggtctctccaacttttcttttagagttttgtggaattgtgcattttgacataaactgttatttcttcctaaatgtgtatttaaatatacatattgtttatattggatataaaaaattttaaagaaactattgttcaatgtaggcagggatgattaaaattctgattataatgtctgcatacattttaaccagagtgcaaagtttttaacagatgaatctttgaagaacatcatgtgtgccagagaactttcaatcttcgggaatatctgatgtagtcatagtttgttttactataggatacttgaggattttatagaggcgaaatagttttccttaaaatgaatattatgaaataaaaaatactttcgaaagagagagaaagtattttcataatgcaagaacaaaggaaggcttaattttatgccatcttgagaaatgagggaaacccaaaggagaaacttaatcccctgcaaggttaaagggaagtcagttgagtgccactgttcactcccccttctcaaaagcattctttctgatacaactcagatg

SEQ ID NO: 25092 - DNA, 1040 bp, Homo sapiens
aacctcagttcctcccctccccccacgtaacgtgtggtcttccatcacttaggacccggaagcgacctaaatctttaggacatttcttcactttcagctagagaaactgaggcccaaggggagaagcatgacttgcccaagctcatatagctagttagtggcaaagctggggaaacagacttctctaacgatttaagttggcacctgcggttaggttcccgagttctgccacttgctgggttaccttggacaagccactaacctcattgagcttcagtttcataatttgaaaaatggaactactaacagaacctaccgcttaggcatcttggaagatgaaatgagcgagtacatgagaagtttacagtgcctggcgtatattaagttctctataattgttaattacatcattattacaattctgattttcctgtctattttctcttcaggcaccctgctcttcagggaggtcagttttttgtaagtaatttttaagcaccgtagttacagcacataatattgtttggagtcaggatattagtttctgaagttggttacagaatgaggaaacaaccccagagaaagcagtaagactccctcaagattacagaagattgtgacagacttgcaacttggctcttcctaggtttgccaagtagttctctgagccccactgttaactgactataaaaatcataaataccattatcttgagtggggatggaaaaataaatttattttaaataggtaaaaaccctgtgttccctcattcagtttgcaaattggtgttattttctaaaggtgatgatttccttttctttttaatgttaatctggctttgaagagttttatcttccattgctctatgtggttaaatgtattgtttctctttggcattttacccagttaccttaggagtccacccaactgataatgacaaaactttgaccatagagtactaaaaataataggccaaatgtgtaaaaagtttagtaaatattacctctcacaaaggttggcttttaattggccattatatg

SEQ ID NO: 25093 - DNA, 1030 bp, Homo sapiens
aaataaacttaagttcatgaccagaatggccaacatggtgaaaccctgtctctactaaaaattcaaaaattaatcaggcgtggtggcaaacacctataatcccagctactcaggaggctgaggcatgagaatcacttgaacctgggaggtggagattgtagtgagctgaggtcattccactgcactccagcctgagtgacagtgtgacactccatgtcaaaaaaaaaaaattttttttaaattaaataacataaacttaaaaattcggtttcttattcacgttaatcacattgcaagtcttcagtagtcacatattgtacagtgcagctatgggacatttccaatatcacagaaaattctgttgaatatagtctccagcctctgtgtaggatctatctactttgagttcaccaaagaaaatgtacattattacctcatttatgtggcatgaggaaacaatgttccaccaatatattcaccattttgaaatttccatataatgggatatagtcctctgattatctaaactttcttttaagccatgattagcttatatagcagataccgtgacttttcctatgaattacggttgttctcatgaccatgagaggtagatgaaataaatagcattgttttctcccactgtacaaccaatggccagaatcctcgcttctggcttgcttgtgtgaatttttttaatgcttgctttttttccccttttcgctcccttttatttgggctcccattgtcacaccatactattgtctatatcccttcctgtcagtgcctttccttttagcaatcctgtgttgctgccaccacacacaatctgctttttcttcttgtttttaatttgttgataaacttgctaattaatctttctagaatttggtctaaaagataaatgaactccattcactttaatgtttgggttttgtgacccttgttttttggtttttcgctttttgttgttgttgttgttgttgctttaagagacagactccgtctattacccaggcaagagtacagt

SEQ ID NO: 25094 - DNA, 1050 bp, Homo sapiens
tcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatct

SEQ ID NO: 25095 - DNA, 1014 bp, Homo sapiens
gacatagaaagattgttacttgacagaaaccaagtgtcttcaacagtgtcatcttctagagaccatcaccttggaattagtttggttatacagtatttttccctataatcttatcttgatataattttatccatacctattcacaaccccttacctgcaattccaaaatccaaaaatctgcaaaaacaaatttttcataattcatttggtgacatagcctgatctgaaatgatgtgaggctatttttagtgtttatccaactcaactatgaatatttcactacagaaacattaatgtctgattacttttacgcccgagactctacaggtattacgtgatatgtttaccacattacttttttaaagtccaaaattttctaaaccgaagagcaaattggtcctaagattctgaaaatggcatttaaacttaaataatgagtgagactaatctcatgcagaaaaatataattaatactgacaatgaatgtggatattcacgtaaattcagtatctcaaaaactcataaacaaatgctatattttcttttggcttttttttctttttgaaacggagtcttgctctgttgcccaggctggagtgcagtggtgcgatctcggctcattgcaagctccgcctcccgggttcacgctattctcctgcctcagcctcccaagtagctgggactacaggtgcccaccaccacgcccgactaatttttttgtatttttagtagagacggggtttcaccgtgttagctaggatggtctccatctcctgacctcgtgatccgcccgtcttggcctcccaaagtgctgggattacaggcattagccaccgcgcccggccttggctttttaaattattgtgtatttctatattatgctggtagtcaaatttgcacaaaacatttttcgaatattcttttaaaagaacttccttttcataagtgaaaagaaaaaaatcagtgtaagttaaagggcttatatattcctttagttccctgaatgtcaaagta

SEQ ID NO: 25096 - DNA, 1046 bp, Homo sapiens
ttattggtgcataatcttcaaagagtcttaaggtctccaaaccagagagctagcacaggcataggtcagaagtccacggcgtgctcatgacttattgtaaagtaaaggtttctatttgtcgatgataagacaagtagactaagatcagcccaattcataaatttggtctgggtcagatgcaattcacagatatcaaccaatagatgtgtgaattgcaattgttagtggccttgaactgccccaccttgaatcgagggaaatcaatgtggctttgttcagcagtgactgcctgaaaggaccataaatcaggagcctccacagaacccttttattgtcaaggtaatggcaaagaaaaatgatagcagttattccatttacagagtttagccttttttcttcttcctgattgttgtttcttccagttttctttttgtatctgaataatcacagcatgtagcttttgaatttttttcctagaggaatgtgtgatataaaacaccataaagttcgcagttagaaggatgtcttaaataattttgtcaaaactcttatggctatgctgtagtttgaactggccaaccaaacggtcatccaaaattagagttttatacctttggtaactgttagccaccgtttctaatttcatatcgtaattatatgtcagacccaggccattatacatgctatctatgtgactgaaatttgttcattttcccctataaaaactgattagtagcagtagattgctgttggtaatgctatgatagtttaagtgccatatagtttaagaaccatatatggttctctatagtcatgatgccctgacatttttgtatgttgtggtctgttgtgtctttccagagatttgtcactaatatttctcaaggtaccaactattgtgagtttctaattttataaattagactagatttgcagtgatctctatgatgatgctgttactgccacttaatttctttagtgggagagatagtattgctggggccatttgtcccaggtatattagccaaatgctaattattgctcaa

SEQ ID NO: 25097 - DNA, 1025 bp, Homo sapiens
catggtgactaaataccaggaaactaattcatgctatgaaactcacgagtgctactaaattccttccagagcaaatgcagatttgggaggaatgggagcctcagtctgtgtctaggttatgactagaaatacagaacctggcctggacttggatggtactgtgggctgtggcttcagggcagggagaaaaggggagccatggacactaccccaggcaagaacaatctagaaaacaaggcacagtattaagtgtcaagtcaaggccaagtgtgcagataggtaagaaccagatatgaggggaacagacagggcagaaaaaaattttggaactgaaattcaccagtgttcttcgaaggaatactaggcagttagagggaagggagttttgtgagggctcaaaggcagcttgacattaagaaactggatttaggccagaatgctagcttattatttcagtgaaagaataactttgcatgagaactgtgattagcttaattgtatggatgtttcctggagagtaggatcacctaagagattaaattacagatgagaaagttgctccgtgaaagtagaaccagagtgtacagagttttatcattcttgacgaattaaccttttctactctggcaagattgttatccaaaacaatgctttccaaagtttttcacatacagtactccatcacatcctacttcactctgccttttttaccgtcccaagggccaaggggattgatatctctacactgcactattctttttatgagaacccaagaatgtcatttctctcaggctttggaaccagatattcctggatatctgttgagaaactcatctgttttcattgggtcgatacagagatggtatctgattccatgtccctttttaccctggttactgggaagcttagagtcaaatctgggggttatttttgaccaatcttatgagacctatggtatctgctgcatcttaatcatatttctataatgctatttccttttctcctccaatttccacattcattaa

SEQ ID NO: 25098 - DNA, 1050 bp, Homo sapiens
caaaccggaacataagacactctgcctctttgtctagatttatgctcagataacagttttatcaatgacatcttcaccaccctaaatacgtagcaacccagcttcacataaatacttgtcctacacttggttctatctttagtcctctactttctccccaccccaaggtacttagtaccatctgtcatagtatatgttttttatttagttattcatattctgtctccatccacttgactaatagataggaggacagagatttgtttgctttcatctgctttatccccagtaattaaaatattaatggttcctggcatataacagtcaacaaacattgttgaaaaaaaatgaatggatgaatgaatgagtcgaaggcttatctatatcattaattaatgctttgatgttttcagaataaataaatgcacgtttaaatttcaggaacggaaaacagttcttccttcaaagcatgcagtacctgaagtaatagaagactttctctgcaatttcttgatcaaaatgggaatgaccagaactcttgattgctttcagtctgaatggtaaacaattatgtagataaatagttctcttaaaattctaacatttaacatatacacttttaagtgtcttaggagactttgaaatgactcagcctatgaaaaatgactagaaacttttcccatctccagccctgaaaccacaacacacacacacacacacacacacacacacacacacacacacacacacacacacaaatcagaatagcagttacaaagacatttttattaaacatctttcccaaatatttaagtttaagtaatttttaaaaaatcaagacacttgaatatctcctggagttataaaacacaaagatattttatgaaaacatttcctaatatttttgtataattattgagagtatttcctgtatttagacattatactaaacagtcctgctttacttccttgttttatttatagtgtaatggcttgtctttttctactcacatagctgattaattatatttctatgaatattcttcagtt

SEQ ID NO: 25099 - DNA, 1057 bp, Homo sapiens
tcccagtaaagaaaataacaggacctgatggcttcactgcttaatcgtgccaagcatttaaagaactaacaccagtgttactcaaacaattccgaaaaatacaggaagagggaatcttttccaaactcatttacaagacccatattaccctgatacccaaaccaaagacacatctaaaaataaaaccacaggccagtatctctgatgttgattcaaaaatcaacaaaaataccagccagcggaattcaacaatatattaaaaagataattcatcatgaccaagtgggaattattccagggatgcaaggatgattcaacatatgcaagttaatcagtgtgatacattacatcaaaagaatgaacaacaaaaaccatatgttcatttcaattcatgctgagaaaaatttaatacaattcaacatccctttatgataaaaactctcaaaaaatttggtatggaaggaacatacctgaacacaataaacactatatttgtcatgccaccgtgtcatactgaatagggaaaacttaaaatcctttcctctaagatctgaaacatgaaaaggatgcccattgtcaccactattattcaatgtagtagtggaagtccaagcaatcagacaagagaaggaaataaatggcatataattggaaaggaaaaagtcaaattatccttgtttgcagatgatatgatcttatatttggaaaaacctaaagtatccaccaaaaaaatgatgagaactgataaattcagcaaggtttcaaggtacaacatcaacatacaaaaatcagtagcatttctgtatactaacagtgaataatctgaaaaagaaattagaaagtaatccaacttacaatagccatggataaaattagataggaagtaacaagcaaataaatgaaatatctctacaatgaaaactataaaacactgatgaaagaaattgaagaggacacagcaacatggaaagacattacatgtttatgggttctaagaatcaatattgttaaaatgtccatactaccctaagcaacctacaaattcagtgtgacccct

SEQ ID NO: 25100 - DNA, 1033 bp, Homo sapiens
acctcaaagatcaaaggtagataaactcatgacgatgagaaagaatcaacacaaaaatcctgaaaactcaaaaagccagagtgcctcttctcctccaaatgattgcaacatgtctccagcaaaggcacagaactgggctgaggctgagatggatgaattgacagaagtaggcttcagaagatgggtaataatgaacttcactgagctaaagaattatgttctaactcattgcaaagaagctaagaaccatgataaaacattacaggagctgtttaccaacataactagtatagagaggaatataaattacctgatcaagctgagaaacacaacacgagaacttcacagtgcaataacaagcatcaatagccaaagagacgaagcagaagaaagggtatcagagcttgaagactatcttgctgaaataagacaggcagacaagaggagagaaaaaaagaatgaaaaggaatgaaaaaaacctctgagaactgtgtgattatgttaaaaaaccaaacctatgactgataggagtatctgaaagagacggagagaatggaaccaagttggaaaacacacttcaggatatcatccagaatttcctcaacctagcaagacaggccagtgttcaaattcaggaaacccagacaaccctagtaagatactacatgagaagatcaagcaaaagacacataatcatcagattctccagggctgaaataaaggaaaaaatgttaagggcagccagagagaaagtccaggtcacctataaagggaagcccatcagactaacagtggatctctgcagaaaccctacaagccagaagatagtgggggccaatattcgacactcttaaaagaatttccaacctagagtttcatatctggtcaaactcagcttcataagtgaaggagaaataaaatctttttcagacaagcaaatgctgagggaattcatcaccaccaggcctgccttgcaagcactcctgaaggaagcactaaatatggaagggaaaaaccattaccagccactaca

SEQ ID NO: 25101 - DNA, 1028 bp, Homo sapiens
agattctactcctgtctctcttttgttggatctggcaacctccttttataaaagtaagtgacatattggataatatatgtataaacactttatacattataaaagcattatgtaaatacaaagatattattgttgctgatattattcctattattatagaaatatatcccccaacatgatgctaagattgcagagtatttagtatcttgctgacccctcttgacttatcttctagctctacttgttcctgttcttctcataatgaagtgcaaaaataagctaaggttcttatgggttgtcttggatgtctaaataagttgttcatttgttttgaatgttctaggtcttaatcagtgtatattaagattatatgaatcctcttgaatgatgatatacactccaatagagtgtgtgccacttgagtgtataccatatggtggatacactcagaggcagcagtgggttcctattacaagtttgtaggaccttattctcctggcattccaaactgtgtcttctcttgagtacatctgtagatagtcaaaacatataagacatgaactactgtcctgtttgcaccaactagctccttttgcctataatcataacacacaaagcttattattagtaaacatcatgtttatccattctgattaacataatacaataaatagtgatgttctataatatttctagagagtacagttcccttcagactattttatgactagagtggaatgttaaccttggcaagaacataaacatgtactgttgtctgcccaactgaatgcacattgcttctaatctcactttatgagaagacacatttgccggatcaatgactacacacgatgtgcctgagtacatgttaatctgctgttgcaaagataccatatcaggtagaacagttgcaatttaggctgttacttggttgagtttgcagtagtctcctgtcatcctccaggatctttgtttattatagaaactagactagggaattatatggaaatatgatgagaacatccaca

SEQ ID NO: 25102 - DNA, 1032 bp, Homo sapiens
gaataaatgcagcaatctatctgggtgagagatgggcacaggttggctaagaaagtagcagtgtaggtattgggaagaatagacagatttggtacttatggggcaaatcttcatggttgattacgtttgtagtgtgtgtatgagaaacaggaatcttcagatgtttttggctgggttgacagtgttatcattcattggaattgaagaaaagatgaggggaaggttttggaggagaggatattattaattggtttatgacgtgagggaatttggatgtctttgggacatctgagtaaagctgcttggttaactgtcgtacacagaacactggagtttaggagaaacttgggaaaatgaaaagccccaggttgctgcaagggaatagggtctaaggggagggaacttggttgcaattaaggcaggaagctgcagttagttctttgtgaagatgttgaggatgtagaggagttggttaatcataaaataaggataatataaacatgtaatgagaaagattgaacacaaacatggaagattgtgaagatgagatgatgggaatcagtagaaggccagaagggacacacattgtgagtgataacctgatgagcaggatgtcacatacagtgagtttgctggcccatggctgtaagaaggaatcaatgccagaagctcttggctgaatgggggctgggaaagacttgacattctctcaggagtctgaatagatcatacttccaaagtcctagcctgtggtacatgcagaggctttaaatgcaaccaactctgccacacacatatgcattgtctgtgagctacaggctgctgtttacacaggcactcagaatgtatcagggaccagatctttgtatgatgagactcggggtagggtcccagcagtcataaacctacttttaggagccaaaactaggtcatagcctatattggttactggaaaattagatcagcttcgtgtgtaaacactatttcagggaatgtggtcctactcttggtggtgtgaatacagcatgctat

SEQ ID NO: 25103 - DNA, 1050 bp, Homo sapiens
ctgttcataaacttggaaacaaaatctttccaaaaaatacaaagcattccacaagttttgcttttattgttcacttaagtaacttgtaattatttcatgtaattacctaagtgaattattgtcacataattcttgggatcagtcactcagttggagattcaggtatatctattaaagatcaacagtcagtactgcccttagacttggacaaatcctgctcttgatcctcagaggtcctaccatttggagtgacttccttgacatttttgggtctttctttggtgccaggggatgtctggggctgggagtgccatctgccagatgctttgattggcaggttaccgtatctcaatttatcatttttggagtcctctctgatcctcttatgtgtgtgtggattcaacccaatgccctgtggagctcatgaacttgtgttgatggcatcttttcaggactttaatgtctgggttctggttccaggaaggtggcctggttggtggatgttttctgcttactggtatgataattcttttacacgatcatggaagattgagctactggaaccatgctgatttggggtgacttctcattcacattggacatatgacaattcaaagatccaggtgtgggctcttgccaatttttgcctaggttctcacctgttttcattctgacttgcagtgctgattctagtctgtagcacccaaggacaatcaccacaccttctcttcaggcttgtcagcatatttcaggaagacttccaggatgttagagcctatctcccctgagagcttttgctttttattctcttgctccacaatgccagtggaccctctggttcatgttttttcttgtgtccaatccatgtttgtatgtcgtgcacttctaggtcagtgttaagccatgcctgatgcaggacagatattcttgcatgaatggaactactgatgtgttcctaacctaatctccctgctggtgttggtctgcagaaggccaatgtcaatatcaaaaaaactcttattttagaaatgtactcattgtggtctgaag

SEQ ID NO: 25104 - DNA, 1052 bp, Homo sapiens
atataaaatattgaaataactgaataattgttttagactcttagccaatcccctttctccaactctccatttcaagcatcctccaactctccatttcaagaaacctaacacatacgttatgcatctcagatttgcaacattatattctttcttcctgaggagaggatagaattttgaggattttccaagtcttcagccatggattctctgcatcatcttttatttattcccttttcctaagtggttcaaaatcatcaattttagaattaattttgcctcattgatatgaaggttttggattccatatatttgcttaacaaatgttcactgagctcttctatgttcctagtattgtggtaggtgctgaatctgcctcacctggctaaatgaaagtatagtatagataaggtgttcttccaaagctttatatctttcagttaccaactttctccatccaatttatgctgtaattgtttgtgacaatgtgggaaataggaatgatgatgtattagtttgtagaagtgtgaattgtctggagagaaatttggccgtacttagtgacattaagcatgcatattccttggactccaattattgaatttttacccgagagaaattttagcagaagtttaaagacactctctgtccttttccttttctcgctatgtgttgtagaggcaaaggaaaaaacttttaccttcactctctgaaggttcacttaaaagttaattgataaaaggcaaattagtatgagaaatgacatacaaatttattagcgtgcagggaggaaaaatcacagagccattactccaccacacaatgaggtacagatttttatatatcctttgtcttaggggaaagtgagatggggaagtgtggatgattttaagcaaggagagtaaatgattgtagggaaatgcaatgggcttggagaacataaaatggcctgggacaaagtctgttgggcctgcagaagaggcaatggttttgaaaaaagtttgtccaggtatgttgacagatttcagtctttcttcctgtcatatgagttcagt

SEQ ID NO: 25105 - DNA, 1049 bp, Homo sapiens
ccctgctgaagttcactttgcccacctatgtggcagtccagaaatgatggggcattaaaactttccaggagcaaccctcagtcggtgactggcagtagacagtgtgtaaataaataccccatctctctcatccctagcattggctatctctcagggatgtgtcctgcactgcagaggttctccagcaggactgagatccagtcctccacagtgagctggattgattcctacccttcattaggtacctttcctttcttgccttagttggaagtactgtaggcaaggataactgaacaccaccattcctatccaaaatactcaaagcatattaatgtgtttagctagagaatacagttagagattattagttgccaaaccttgctttgaaaaaaaagtgaagaattttagcttctgaaagtcattgcaatcaaatattgagcaacatgaagataaatcgggagctcgccggtttctatcagaaatgtgcccacatacgcaccacactacactggtcttgaattggtatttggcatttgctttgaacatttcaagagctagaataacaaaaacagctgtgtcaaaagtaagtgtctacttggtttcattaatgtgatcacactcatatggattgttttaaaatatccaaaagactgaaggtcctgatgaatccgacaaaatagagtactttttagggaaattagcagccttaatgtcaaagacaaatgtcagattattttgttccaatttactcattttaggcttaaggattctcaaaagatagtgaacaatatataatacactagacattctactccgcaaatttaattttgagcatataataatagaattttatctttggaaagtttgtgaaaattcttatgcattcaatcttgatatgaatcattgtctttatagttgttttgataataatctaatattatcaaatcacgatccccaacttctcaagacataatgaatatacattgaaatttaaagtacatgtgtttaccagacaatgcctagaggaaataaataattcaatttcatat

SEQ ID NO: 25106 - DNA, 1036 bp, Homo sapiens
acagaagacagatgataaatggaatgctggcattggtccggctcatagtagtgggttcactgggttcaaaggctcacaaagttattgtttccttggtcccaagatatataattggaatagaaatgcttggtagttaatgatttattaaattgcagaataaaagttactctagtgggaagagcaagtggaaatttctaatatgccccttcctcacatgcaatattgcatcccaggggaaacagcagaggacctaaaagatgcaggggtcatggccccattatatctccatttaattcactattttagctcttagaaagcccagatggatctggaagatgaaagtagattgctgcaaactcaaccaaatgttgcattaattgcagttgctcttccagaagaagcatctttgttagagcagattaccacaacttcaggtacatggtatgaagtcattaatgtagcagttttatcctttctaaaaatctctattggaaaggaggatcaggaacagtttgtattcatatgtaataagcataattttgcctaagttaactgttacctaggttaactaggttaactgttttaccctctatcatgatattttctggagggatctagacagatcagctatgtacacaacatcccattggtccattatattgatggcatcatattggttggatcagatcatcaaaaagtggcaaggtaagtacattggaagactaggtaagagggtaggagataagcattctgagggttcaaggacctgattcaatcagttaaatgttagggattcattggtctggggcatcctagaacatccccttcaaagtaaaggataaattatcacatcctcacatctttcatcaagcaagaaaacatgatacctggtttcttctttgggatctgaggcagtttattgcatacttggggatactgctctgccagctgtgagtggaaccagagcagataaagtctgtgcagtaggtccagatgcagcaagccctgtggtacagaggcacttgtgttagggtag

SEQ ID NO: 25107 - DNA, 1827 bp, Homo sapiens
tcaagccctctgtcaacggcttcagcaaaatagatttttgcatgtttaagtttattagcaagtatagacagattgcttaatctatcttcactcttagttgatcagaggttactttttattttcagtttgatatatttctctgacacaaagcaacagttatacaaatagttagaaaagtctttaaggatagtttggcagagatttttataaaaatcttatttcacaataaatttcattgctctccatgtctttctttgggattgattctagcagctttcaaatgtccctacagtcaaaatattttaaacataaaaattccaagtggctacatagaatgacagaattgaagtaacaagttctgtttcttcatctttgcaatcacaatgctatcattgcttgtttaaaacctactagttagctggcatggtggctcacacctgtaatctgagcactttggaaggctgaggcaggaggatcgcttgaggccaggtatttgagacctgcctggacaacaaagtgagggcccatctttataaaaacataaaaataaaaatagcctggtgcagtggctcgagcttatgatcccagctactctggaggctaaggcaggaggatcactttgagtccaggaggttgaggctacagtgaactatgattgtgccactgcattccagcctgggagacagagcaagactaagaccctatctctacaaaacaaaacaaacaaaaccaaataaaaaaaacaaatctaccagttaaatgcagaaatatatagcttcagaggtgatggaggtagaaattgccccccaagctagctagaaagagattcctaactgtcttcaacttggaattctgtgatgagttagttccccagtttccaggtaaagtgtatacactttacctggaagttctcctagttttacctgggagttctcctagttttccttcatgaagaatacagtgtttatcaaagaataaataattttttaaaagctcaaatttgcaatttaccaatatgttattaaaatttagtagcaaccacatcacttctttagaatttaccctgatgaaagattttttttttgataggagtatttgatcactgtattagtccattttcacactgctgataaagacatacttgagactgggcaatttacaaatggaagagttttattggacttacagttccacgtggctggggaggcttcacaatcagggctgaaggtgaaaggcatgtctcaaatggtggcagacaagaagaacttgtgcagggaaactccactttttaaaactatcagatctcgtgagacttattcactattacgagaacagcacaggaaagacctgcccccatgattcaattacctcccaccaggtccttcccacaacacgtgagaattcaagatgagatttgggtggggacacaggcaaaccatatcaatcactgactttgtttagaagtgcctttgctggagcttggtgaaaataagttgatcctgttattatttttaaattctctacggacattgtacaccaattttgtctgcactgggtctgacagatccctttacccaccccccttgagataccacaggaaaggagttgcaaacagagggaaaaacacagattgaggaagactgtgttttgtaccatgcagtcacataacccatcccataaacctccctgccccaattgcatgagagatattagcaaattgtcttgtttgccctctgaatcagatttcctacatgtgcttaagtaaatcattgtttttatttgaggaagagaagattcactgaggatgcttgagtaaatgaactctgg

SEQ ID NO: 25108 - DNA, 1024 bp, Homo sapiens
tagaaaaaaattgtgggaaaataattaagattttttttttttttgaggcagaatcactctgtcacccaggcaggagtgcagtgatacaatcttggctcactgcagcctccacgacccaggttcaaactattctcgtgcctcagcctcccgagtaactgggactacagacgtgcgcccccatgcctagctaatttttctattttcagtagagacgtggtttcaccatgttggccaggctggtctcaaactcttgacctcaagtgatccacccacctcggcctcccaaagtgctaagattacaggtgtgagccactgtacctggccaataattaagattttaatttgtcacatagtatgccaatgaaaaggacagttagaaacaaaacacagtttcttacctctccagcaggtatcccaatgctgatgttgtttacagctataatctttttgtggataagttggtaggtctttgtgagacaataaagttggaccaagtcaaattcagctgcaccactctcaactcttaatctctcagcccgcacatcttcatcctcatctattgtctcccttacatgtgaagaattaaattttctgaagaaaagcctaaaaatggacccagtgattttacgtcaatgattttgaaatgacagcattcaattttgacatgttttgatgggttttcatgtcactaacagtgtactagtcatcattagacttcttttacatttgtaatgaattatgctactcagataacttaaatcagtatagaccctcctcactgtattcactatatttgtgaaacagcttttgttctccatgccttaaatgtttacagatccactgttaagatttataattctaatttcagtaataaggaatacagtaagtatatgtttgaaggttagttcctaacagaggaactaaggaactccagaatcattaggaaaactcatcatctacaaacctaagaccaatgatcaccttttaaaaaaatcctttcatccaggtgtagtggctcacacct

SEQ ID NO: 25109 - DNA, 1029 bp, Homo sapiens
cacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcggtgaggccctagcggagcggcgcggtctgcgtcctcgcctgcggccccccacgctcccgccttggcggcggccggcgggacccggcactgcaggggcggcgctgcgggattgaaagccagcgtccccgctccccggccgggccgcagcctgcgtggggcccgccttagagcagctcgcgggtgtaagacctggggaggcccggaccaggcctgcgaacgcagggtccaggtgctggccttgcgattcgagaatctcctcccccagaccctcccaaggccttgcagaacacagtgcaatgtgctgcgaatcatgagaaaaaatgtcttctctttcagccttatttagtgtctctgacaaaaccggccttgtggaatttgcaagaaacctgaccgctcttggtttgaatctggtcgcttccggagggactgcaaaagctctcagggatgctggtctggcagtcaggtaaggcatagctagttccatcagaaaggagtgtgatcacattaaccaggaagtattgtattccaggcaccagcagcaaaacgccttatttactcctcccagtagcgctgtgaggttggtgtaatacttccccactttatggggaaaaaaagtgaggctcagagagatttagcaacttttaagaccctggacggctgggctaggtggctcacgcatgtaatcccagcactttgggaggccgaggtgggctgatcacttacggtcaagagttcgagaccagcctggccaacatggtgaaacccgtctctactaaaaatacaaaaattagccggtatggtggcacacgcctgtaatcccagctactgggaaggctgaggcaggagaatcgcttgaacctaggaggcggaggttgtggtg

SEQ ID NO: 25110 - DNA, 1045 bp, Homo sapiens
gcccagccaggatgtcagcttttgagagcagaagctgcatctgtttttgtttgtcgctgaatccccagggcttagaagactgcttggcacattccctaaatgtttactgaatgaataattagcaacctgacattttgcacaaatttttccttgtaggacttcttgaaactgatttgtctgctgttatatctgacctatttcctgcttatagtttatattctccattaagattctgagacaaaaaaatccccatgtactgtcagttcttatacttttcattttccaaagcattttcattggactatataaaagccttcattgttccttagactgtgtgtgcgtttcttttgaagtttaaagtattatttgtggtaaacatggcagaggcggccctggacacgtaaataagcgtttcttgtgcgagattcccaggatttctccccaacatgggcttatttccacaatagaaaaggcactttgccttttcatgtggtttgagtatttggcagtgatgttattacagagtgtatggttgcgattgtatctaaaacaaaattgaagcaagaacaaagatggggttgtgtgagtgtgtgtatgtgtctgagattttaatgactggtttgcttatgattggaaagaagaaaattcctatttatttcagctatttactagattaagcaactttcagcatttctctggcactttctatttcagttattaatgtctttgaaaatttgatatttgaaggggaaccggatactcttttttttttgaggcagagtcttgctctgtcgcccaggctggagtgcagtggcatgatctcggctcaccacaacctccgcctcccaggttcaagtgatctcctgcctcagcctcctgagtagttgggattacaggcatgtaccaccaggcccagctaatttttgtatttttagtaaagacagagtttcaccatattggccagaccagtctgaaactcccaacctcaggtgatccacccaccttggcctcccaaagtgttggggattacaggcatgagccaccg

SEQ ID NO: 25111 - DNA, 1023 bp, Homo sapiens
aaaaagttttctgagtgtcactctagagggtaaaattaaagaatactttcttactggttacttcagttaaatgacttattgatctgttaaaatcttatgtaaacagtaagattagctttagagtaatgaattttatatgacagtggagaattttattactttttctgtatcaggatactttgtgataaatacctcattttaattttatttacaggggctgataggatgtcttcatttggtgattttgttgcattgtccgatgtttgtgatgtaccaactgcaaaaattatttccagagaagttagtggacattcatgtatcttaatctgtgtgttgaataaagctttatttgttcataatgttaattgaaaccataacctataatatttatatttataatatcttttaattagctaagtttatcatttaatgttcatattttaaatagaacattaatcttaaattgttaattttgaaatgtagtgaattattgtttcagatggatatttggctgttatgatgttttttacttatatatttattttaaattctttgttgtcttcatgccaaagttactgtttctgaagagcagaagttgtaattttaggtggtgatgcgatataatccatcttactgcatagtgggtaaaaaacagaaactacattaataaacttaccccatcagttgaataccaaacaggtattccagacaggtgggggtactgttggtagtaggaagacaggaagaaaagagaaaaagattaaatagctcagaaaggggaaaaaaataagcagaggtgaaggctgaaggagcatgtggcttggcactattttgttgctttaggattctttccatggccactgccatccctgggttacaggttacaggagggctgtgacatttgtatctttcgtcatgtcaaatctctgatttaatctggtcttgctgttaaggaaaacgccttgccggaagaggtcatttaaccatgtactaggagagtcaggactagaatgtgctcttgct

SEQ ID NO: 25112 - DNA, 1034 bp, Homo sapiens
ccagggagagagtagtgttacacgtattgttccacacaccttaatgttctttcggctcaaaatttgggagaggaagatggcagtaaatgatacaaattccttccaaatagcaaagacacagattacaaatcctgttttctcacttttagctttcaattcctgggttagctgggtattttgtaacagatttttagaaaggaaaattagaatttaatttttgtgccattgcttatttaattagcacatctgttttatctgctgaccttccaaaagaaccatataggtagtaacttaaccaaaaatacactcactggaatcattgttttttaacatgttgtatataggttgtaaaatctataaaatactattgggtagtaaaatctataaaagactttggagaaaaatattagcgcctggctgttgtatcataccagaatgttgaattgtatcataccagaatgatttaacacatcatttgttgtgtgagaaaaattagaaaattagaaaactgtaaaaaattagaaacatgcatataactttacttacaatgaaatcttttgtatataaattaaatgaaaaatttgagggaagtggagagattaactttaacttttaaaatttgtattttagatggaccaatcttacaaaccagatgaaaatgaagttcgaactctctttggtcttcatttaagccagaagagaaataatggtgtcgtcgacaagtcattatttagcaatgttgttaccaaaaataaagatgtaagttgggaagtatctgaactgactgctagtaacttccattggtctgttttcaatacttaatgagctttacatttattaaggtctggatttggaactggtctgtatgcacacggctagctagcttatctttgagttgtcacataagctttggagtttaagaaatgaatcaaaggccatgttagaagcttctgtgcatatgtacacactagagataagtagctttaattgtgtataaatgggatcatgtcttccataatctgactcctgtaact

SEQ ID NO: 25113 - DNA, 1047 bp, Homo sapiens
ggattttctataccttggaagtggtaaagctgatttgcaatgtcagattcaaattgttataattgttttgttttgtttttttttgagatggagtctcactctatcacctaggctggggtgcagaggcatgatcttggctcactgcaacttctgcctcctgggtccaagtgattcttctgcctcagcctcctgagtagctgggattacaggcacgtgccaccgcgactggctaatttttgtatttttagtagagatggggtttcaccatgttggtcaggctggtctcgaactcctgacctcgtgatccgcctgcctcagcctcccaaaatgctgggattacaggcgtgagcccagccctataatggttcttacactcttcttttcccctctctattaagcatttatattacactctggtccagccatagcccttcaaatgccccaaacataaagctacatgaggcacacttcaatcaactttaccatccagttgtagaaaagacggtctaggaaaattttttgtagatttgctataggcaaataagatttcgctgaggccatttgagcaaaagaaattcaaagcacagcaactaactatggtggtttcacaacttctttctctgtaaattcctcgcttggcactgagaaggaaaaaagatgttcgtaaagggctcagctcaagacataaactaaccaacaagttcactttccctatgtgtaattgcaaaagacatgtcgtgggcattcagacacccaagaacaaaatttgactttgaaaatggaaaccaagcagtggttacgtactggttactgcagtctgaaccagaggctgactctctccgcttggattctgagcatagacactaaccacatactccactgtgggctgcaagccttcaatagtcatttctgtttgatctgcaaagggagtgaaaagcaaatgcaacatccacgtcatccactataaagtcctcaagtggcgtctagagtttggtagtaaacatatggtggcctagaatttttatttgcagaattgtaacaaaaata

SEQ ID NO: 25114 - DNA, 1096 bp, Homo sapiens
gtgtatggacgtgggctttaccatgagtaactccattcctggtatagaatccccatttgaacaagcaaagaaggtgataaccatgtttgtacagcgacaggtaagtttcagattgacactgagcttgtaacccatgtttgaactgcttgttgcctctacctactaatgcaagataccagcctccttatagtgtccagcccctctgtttggggggattctggggagtttccttacatgtactcacatacaacttcacctaccactagagtctgatattttttcttccctcgttttggccccttcactagatattacagtttttatcggaaacaagaggcagtaaaaagtaatgtttaaaagcacaatctctagagacagatggcttgggtttgtatccttgctctgccatgtcatttactaaccttctgatgttgaacaagtccctcaacttgtttgtgactagttcagttatcttttgctgtgtaataaactaccccaaaatgtagtgtctcaagtaacattttaaaaattcatcattcatggttctgtgggatgactgggttgctcagttgggtgattctctattgaggcctcttacgcagttgcaatcagatggcagctggggctggagtcacccaaaggctcaactggaccagatgtccaaaatggctcactcacatggctggaagacgatgctttctagtggctgtgagctcagttggggctgtccgttagaatctctacatgtggtttctgtatagtttcaattttcacatgaagcagctggttctaaggagtatcccaagaatgggttttctatgagaccctgcctatgtggcttcttaagacctatttttagaagccccagaaagtcatttctgttttctgttagtcaagcaagacactaaggttaggtcacatttaagggaggagaattagactccctctcttgataaaaagagtagcctgcaaatacaaggagagaaagaacggatggtggctatcttggaggttagctactacagtgcctcagtgtcccatgtgtaaaatgagaataatgatacctgtcacatagggtagttttgaagaataaaag

SEQ ID NO: 25115 - DNA, 1028 bp, Homo sapiens
ccagcccagccagcgtggcgaaaccccgtctctactaaaaataaaaaaattagctgggcatggtggtgcatgcctgtagtcctagctacttgagaggctgaggcaagtgaatcacttgaacctaggaggcggaggttgcaatgagccaagatcatgccactgcactccagcctgggtgacagagcgagactccgtctcaaaaagaaaagaaaaattagaggccaatatagattactctttaaaaagtgtttttgtttgttttttaaatttttctgtagcatatcagatagggaaattactgactatgcattgttttagcatttcgacgctactttgattttaggtctgccatgaaggtgtagaccagaactttgccatccagtacagtagccattagctacatgtggctatttaaattcaagttagttaaaattaaatacattttaaaattgagtcccttagtcatattatctgtgtttgaagtgtctattgggctagcatggttagaaatagaacattaccatcattgcagaaagttgtactggacagcactggactagattatctccatatagatcttaggaagagaacttgacatctacctgaggagattgagctctactgcagaactgagtcagttgttcttagattttttttgagacagggtctagctctgtcatccaggctggaatgcagtgacgtgatctcagctcactgcaacctctgcctcccaggttctagcaattctcatgcctcagcctcccaagtagctgggattacaggcatgcgacaccatgcccagctactcagatcttatatattggatgcccgtctttagaattttccctgaaatagaatctaaatctcatggtgattttaggccatgaggtttatattctgtttgactagtaatgttgtatgagacacgttagacctggttcagacccattcattcctcagcaaatccaaagccattgtgcaccataggctttggaagctgggtgtcaggtaagatatctactattcgt

SEQ ID NO: 25116 - DNA, 1105 bp, Homo sapiens
aggtgatgggtgacttcagaggataatttcattaaggaagtgggggcagtagctggactagactgaagaataataatgcactaagcagtggaaacagcatgcctattattttaagaaattcagaggtaaagacaggaaagatactgatagcaatttgtggagagggaaggacaaacaaaagatttgtttaggagggctgacatgagtttatttttagggtaaagataaaaatttagagaaggaaggttgaagcagtaagacggatttagttaatgaggttaagtcccagaagagctacagtaaatgtaatcaaaagcaaatgtgtgcacttcgtccttcaagtcagggggcaccctaaaaaatgtaaaatagaaagaaagtgataacagtcttaaagtattgagttctgttgtgaaaactctcacatgttgaatatgtgttaatacatccatctttcttaccaggcagctgcagttgcactttcctccctgattcatgctttggatgacttagacatggtggccatagttcgatatgcttatgacaaaagagctaatcctcaagtcggcgtggcttttcctcatatcaagcataactatgaggtaaaacccaaagtcttaatgttattttttttcttcagttcctttattctaagcagtgtttctcagctgttaatgttcatgacaattacttggggatcttgttaaaatgcagatcctcattgtgtagttctggggcagggcccagattctctgtttctctcgagaaatgctgatactggtctgtgaaccacactttcggttggaggaaaaagtatacgttataaaaataatataagaatcttttaattataaagtatcataagaatctttttattaagtattatgaaaatcgttttagattaaaagaataatcaataaaggttcaccatggccttttcttggttctcatccttcttgacttattggaaccaaatagagaaattacctccatttttacaaatgagaactatgaataaaggctgaggatatgattttgttgtgatctttgtgaaacggtttatttagggctctcttgtgtaaaatacagttctaaattccttatc

SEQ ID NO: 25117 - DNA, 1058 bp, Homo sapiens
ttgatgtgaaagctcctgattgagcatctggctgcaaatgtcagggtcctatatagaattattcttagagccacaggtccagtcttccagagagcctgtcatttaaaacaattgtaataaaatataatagggggcagaagtagaaaacataccaaaaagaacaacaaatgatgagtagatgttttaggttacaagtttatatataatgtctgtgtctgtgttaagattagggaattgtgaggtgagtctcggaactcaattctttctgttattttggctagaccctttggaagtagtgtgctatagaaaggccaagaatcagatgggtccctagggcctgtatctttatcttccttctagaaatgagtctgtctgcatcacggtggaggcaggcatggacctgattatatggaagttgccactgtattacagtattactctgtctctatttcctgataattccaaaatttaaatgagtagaatatttaattatttatttatttgagacagggtctcactctgtcacctggctggagtgcagcggcgtgatcatagcttactggagcctcaaactccctgtgtattagttcattttcatactgctgataaagacatacccgagactgggaagaaaaagaggtttaattggacttacagttccacatggctggggaagcctcagaatcttggtgggaggcgaaaggcacttacatggtggcagcaagagaaaatgaggaagaagcaaaagtagaaacccctgataaacccatcagatctggagtgaataaatctatagacttattcactatcatgagaatagcacaagaaagaccagcccctctgattcatttacctccccctgggtctctcccacaacatgtgggaattctgggagatacaattcaagttgagatttgggtggggacacagccaattctggctcaagcaatcctcttgcctcggcctcctaagtagttgggactacaggtacgcgccaccgtggctggctcatttttaaaattgtttgtagagatggaatctcactatgttgttgtggc

SEQ ID NO: 25118 - DNA, 1011 bp, Homo sapiens
cgtgtatctgaaaccttgtacctactgataggacttttgatgaatagattgttcttttatattgaatttgactttgagacccagcatgttgctagtatttcgacaaaagatgtccctctgacctccgtctaagacttggtgaatcagagccctctagtgatgtcacaaaaccagactctccacagagctgtcggaaaatggattgcttattagcaactagttctcgtgattttaacttggcttccgttttatcccttctgccgttcttggtgccagctccagaattgatgtcctgttctttgttttgggcatcttgtttgtttgtttttccgctagggcatctttttactaacgccctttataagccaagactcacttctcttgcaggcccaaagagttctccctccctagtagtggtcttcttttagagagatttctgtccagagtcgggagacaggaatcccttccccttttctccagtaaatttattttttaaaattcagttgtcaaaagggcgatcagcgatagatagttggtaagattgtttgacccttaggtagaactcggctgttttacctatcattataaattaaaatatgggtgtagttactttttctcaggcctgatagtagcataatcaaactgagagtcttgtgattctgtccccgacatcagcagtctatatatagtaggcagctacacattttcttaacttctggttttcagtgtgagggatgtatcttgttctaagcttactggcagagaggagataaccaatgccctgaaccccaggaagcatgttctttctggctgcccttttcccagtccctttcctccattctccctacccatcaccattctatcaccacagagttagaatagaaaacaattttttttctcttttccttttttgtgaaggggtctcagtctgtcgcccagactggagtgcagtagcatgatcacagctcactgcagcctctacctcctgggctcaagtgattctaccacctc

SEQ ID NO: 25119 - DNA, 1069 bp, Homo sapiens
aataaatctggtcagttttaaaatttcttattgaatcagttttagtaatatgtctttataagaatttgttccttttgtctaattttttagtataacattgattattattcccttataataatatttttgagatctgttctttatttctgatttggggattttgtatcttccctttttcttggtcagtctaggtaaaggcttatggattttatctttttaagatcccagcttttagttagttttattgattttctccattattctcatttaattaatttctgctctgatctttattattccattccttcttcttactttggctgtaattcacttttcattttcttgtttcttaaggtggaagcttagatgattgatttgaaacctcttttctaatataggcatttaaagctatacatttcctgctaagcagttttttagcttcacaccataaattgcgatgtgttatgattttgttttcatttagtttaaatatattctaatgtctttcatgattgtttctttgactcttgggttatttaaatgtgttcttaaattccaaatattgaagatttcccaatttcttcctgttgttgatttttaattctgttatgattggagatcatactttgagtggcttcagtccgtctgaatttattcagacttgttcttatgtggtctcacatatagtctgttctgccagttgttctctatggccttaaaaagtacatgtattcacctgttactaggacaagtgtgctggaaatgtcagggcaatttggttgatagtttgttcaaatctgtcttttgactttctatctagttgttttccgtgacgttttgagtattgaaagttattcaccttgagaccttgtgtgctagtgagacctttatgattttggtctcacctagctaaaccagcttgggtcatgagatcctagtgaatttttacagggtgacactaaagaaaacactgtcaattcaggtaatagagtatatgttaaataaaagtcttcaggtattggcattttaggaaaaataaacttagctatgtgtgctgcaagactgtatg

SEQ ID NO: 25120 - DNA, 1051 bp, Homo sapiens
tattaattactcccattcagtcccccattcaaggcttgccacaatctggtcccattctgccactcccgacccattcttatacagattccctctgtgaaccttgtattcaaaccatgttcctgctaatgcccttgcagcatcggctttctaaagctgattaactcttttaaaaaaatggccattcttatctttacccccaaatcctactctaaagagatgcttgtgatttgagaaccggtatatctttggatcccaatgccgcccgtagttttattgtagtatgactcattagatactgctgctgctttaccatcagtgagacaaaatgacctccatctggcttttttggttttcattgcgactttaataaaacagtgcttgggagtaataagaatttgaatttttgaattgtagcagatttacttctctggttctttggatcaattcctaagtcttagccccatcaaagaagaagtgcagaatctaacgtgtctgtattttgacctctagaatactgtaaaactttcttcataaaattagaaaggatagaggggggaaaatgaaaagaaaaagaagaatctgagaggtccctaaggaaaaataccgtataaaccaaggcattatttatcagtttttagaaggagttatcacatagaatgtggtctttctaaaatttctggtacctaatatttcctttcaaaaaagactcaaattcttgaggcatcctagaagacttgtgtgctgcctcccccttgtccaccctccccaaaagcacattcaacaatggctgcctgtttctctccttggtgaggagtctgactcatcattcactctgtcttttcaactgatacctgcgtttcagttccattcaattaccaacttttaattggatcccattgccagattgattttgtgttcctgttccctcttggctgcactgttactatgactacttggtatcttctacttacttcctatattagtttgatgacatctagtcaggtatgaagctagatagatactataaaattgctacagtaccaatcactat

SEQ ID NO: 25121 - DNA, 1048 bp, Homo sapiens
tatagttttaaaaatctccagctcaggctgggcacagtggcgcatgcttgtaatcccagcactttgggaggccgagacgggaggatcacttgagcccaggagtctgagaccagcctgggcaacatagtgggaccctgtctctatttaaaaaaaagaaatcttcagctcaaaggtgggaggaggtgtgatggaaacgaaaatgggattggggttgattctttgtgttttgattttactctctgaattactttttagatggaattactctgatcaccaaagaggaagcctctggaagttctgtcacagctgaggaagccaaaaaggtattgaggggtaaacctttgtctttagttgaattattatagtggactttattttcttgataccctcgaagaagttaaattttatgggtaactaaattagtgtactcattttgtattcaatatgtaaattgcttcaaccacagcatccccatgggagaaattataatcttactcagtttcctgtaggctgtggttatatttctggaactcacctgtaatcccagcttcagtacccctagagcatgctgttgaaccccatagtgcgcaaacttagcctcggccctggtaaaggctatgaaatccacagtgattcccaccctggccacacattagttacttggtgagcttgtttttcttttttttcttttcttttcttttcttttcttttcttttcttttcttttctctttcttttctctctctctctgtttctttctttcttttttttttttgttaatactgattaaaaatcagaattaccctagagattctgttagtctgagatgggtcctgggcacagttggtttgtttgcattttaaaacccctcaggtgattgtattgtatagtgaatagagaaacactagtattctagcataagggacatccaagtattttcagtaaaagaccccatgcagtccccatgagcttcttattcacacacattgttaggcctaggcctccttgtttggtgtgtattgaatctgattcagccatgagtcagatac

SEQ ID NO: 25122 - DNA, 1032 bp, Homo sapiens
actaggctgcaggatttccctcttgcaccatgttagtgtttatagcatccattaagctacaagtggcattaatgaaacccaaatatatgtcattttaggcaaagtacatgcaaactgacttttattctttttgatgcttttttacacatctagattgtcagtaatcctttggaatcacctgatggtgttggaaacaacccagtggaagtcatgtgtttttactttgggggtcagtaagggtctgagcacaagatgatagtcttttagtcttatggtggtataggactggcagtttctatatagaggttattgatttcattactctgcttgtggccaggattatatttcagtgtacttgaaaagtagtaggttatccatttcataaagttctccaggtaaggaggcacttttatggtaaccccaggtaagtgatggtggtttgaggaagaaggaatatgtcactcacacacatgccctttctatctgttctctactttctcagcatattgcagagggaaagaacacatgagaaaagatgagaattgactcctacccctttctgcagaagagattcggagaatctcttgcttttattgagaaagcaggccagtcattgagttctctgctctatcttgcttccctgtcactgcatgggctagaattacttgcagttacaaacattaatgatgaggagtgatatgtggaagagatcagccttgcctggggcattgggaaggataatggatggcagcccagcttttaaacataatttgcttacacagaaatgtgaagcagatctgtcaggaaaatcagttgcagacgatacttagcacttaatgaaaatgtaggatttttgttgctgctcatttcttcctaggaatttggcctagtctcagagatgtgccatttgtgcttaagtatatataccatggtcatactgtgccaacaataagtccttatctaaggggtcatacaagatgtagtggactacagaaccattaagcctatggagtttttcagatgtttggaaga

SEQ ID NO: 25123 - DNA, 1023 bp, Homo sapiens
gaatcagccaccattgggtagaaagatgctcacctttcttagttgatattgtgtgtaatttatactacacgatgctgattagcagatgatgtaataatcccactaacaataattcataataactggctttggggtgctcattgttttccagtcatacttttataagcattttcctttaatttcatgtaaacagtaacctgtgaggtaggggttgtaatatctttatttttcagatgtggaaactgagggagaggtgttacagtgacttgcccaaggtgacatagctagcaagaggcagagccaaaattgaaactttggcagtttgaccactgaccacatgcaacttgtttcccatgtgtaaaatggagttaacaacagcccaccttacagacttgggaggggcagatgagagggtgccactgagtgttggcacagtgccgggctgaatgcgaatgctgcataggtgtgagctacagttaccatccctgtcactcagggcatttctgacctgctagaccctccccagccatgtatcctgtggcaccttttatcacaacccttacaacccagtgttgtcagcatctctgcctctttttcctcccagtatactggggaagcctccagggaaagtactctcctaatttctgtatccgcagtgctaggtacaggaccagctgccacattgtctaagctgaatggaagtttatgaaaccaaggaataaatgagtaagtgtgatcacgtagcagaagggcagggtgtcctatttgcttatttatttcttgtcattgcagatgtcaagaccaggaagtggagctttctcttggaagagcacagtaaactaagtgagaagccttccttacttgttttatatcatgctattgttaagctttaataattcaccttaaatttgatgtatttttgaagaatcttctcctccctttgctgtggtgggatgcttgagtacagggtaagtaaaggtgaggatgcagccttgtccacatccactgagatggtggctttat

SEQ ID NO: 25124 - DNA, 1098 bp, Homo sapiens
tatgtttattgcagcactattcacaatagcaaacacttggaaccaacccaaatgtccaacaatgatagactggattaagaaaatgtggcacatatacaccatggaatactatgcagctatgagaaatgatgagttcatgtcctttgtagggacatggatgaagctggaaaccaccattctcagcaaactatcgcaaggacaaaaaaccaaacactgcatgttctcactcataggtgggaattgaacaatgagaacacttggacacaggaaggggaacatcacacaccagggcctgttgtggggtggggggaggggggagggatagcattaggagatatacctaatgtaaatgatgagttaatgggtgcagcacaccaacatggcacatgtatacatatgtaacaaacctgcacgttgtgcacatgtaccctagaacttaaagtgtaataaaaaaatatatttaaaaaaagaatcatccttacatttgatatttgaatggacaaatgaactgtatgtaatatttttgggtcaactgggggaattttgaacatagtctcagtagtagatgagataaaatgtactgaaagagaaagttactaaaaaaacaaaaccagattaaggaatggtatgtacaataaaattttatattgatgtaaaactagaaagaggtgtgtgtgtgtgtgtgtgtgtgtgtgtgtgtgtgtatgtgtgtgtgtatgtgtataaagacctggaaaggtaaacattaaggtaatgagcattggtggacactgatggtaattaaattgatttaattaaattcaaaaatttcctatagtgcacatgtgctgcttctgtaactatactttttaaaagtacaaacaagataataaaaagttaaccaatttaaaaaaaaagaatcatcttttatacaaccataattttggcatatataatttgagtatttttctataattatgtgtgtatatgttgctttaagatatatttttatgtatctgcatataaatatatataaaatattatatatgcaataagcaatatgtgtattttaaaagcagaactgggatcatacaaacacgtcaagtgggaaggaaaaca

SEQ ID NO: 25125 - DNA, 1315 bp, Homo sapiens
cctgacttcaaggtattttataagccgtgtgctggtgggcagttggaattactcataccgttgattatgagttttaagataaaagtgttgatggtaacttcagattttgtgagacgtttttcatttaaagaaaaccgcttaaacgttaatgggtaaaataatcatttgacagagtgcccccagcctaagccaaacctgctttgtgggaaatgattccatcagttttgtctactgatgtttctgcaccaactcccaagatgtctgtgcatctaataccattctacttgttctgcgagggatttttgtttgataaaggtttgaacgtttatgtgcaaaatactgcattacagcaatccctgttttgtttttgagggagaaagggaggctttcacatccctgacaataaggtgaatccaaatttagacttctggatgcttgtaagagaaaatacttacttggttcatagtgaaaattggttctcttttatagaccaagatgaagagacgagctgtggggatctggcactgtggttcctgcatgaagacagtggctggcggtgcctggacgtacaagtgagtctagttccttgtggtatttggaagtgtgtggaccacataggcccaaattccaggttgctgctggatgggctagttttaacactttctcaggactgagagaataaggatgcctttgtattttcaggattcttccgtggtggtttattttcagttattgaaagagtaaacacaaaactaccaaaatagaagtcggaaatctaattcacagactactttagaatttgatggtcactgggcacattgttgtgaacattgtcatgatactgtgcaggtccattagtggggctgaatctactgaacgttgatttgcactgcaagttttgataaaaataggtgaaggggtcagttagttcaaaactgtatttggaacttgaggccatcaggaccaccacagtttcgtctttctgaacagtattagactgctgcaggtttgtgaatctgcaactcagtatcacctgacagggcgatactacaaacactatactacaaactagcatctagacctgtgttgtccaatacactaagcacatatatggctagtgtaattaaagaattggattttaaagtttcagtcaatttaaacttaaaccgaagcagtggaaaatgttgaaatatatatatattccttgtgggggtttttattagggcagaatggaaaatgggaactagagtgctttcttggttctgataggaaagtgaattatttatatacttacaatacaggatggtgattttca

SEQ ID NO: 25126 - DNA, 1051 bp, Homo sapiens
ggcgggggacagtttacagaccagtgaaagtgctgagataaatatttttatacctaaggaaatagtgattttcccaagatgatagggaggcaggtgatgtagatagggctgaagattagatttctggctcctatctgtgattttctgctgtaccagtctgccttctattttatgggctcagtattccttacctgcctcttcccatgctaaagatggcccaccttcgttttgttatttaagcaacttcatcccctggcttgttttcacagtggttttctgagcctttgactctaagtcatctaattgaacattgtgttgtgatataaaaagtaagttaggcttgtgtttttcaccaggccatttcattgtatcctaactaggcgggtggctgtgataaatgtacagattagccaatacagaatcacgtctaattccaagttttcttttgggtatgaagttgagacatggggaagcttgagctttgttttgtcagcaacaggtgaggtggagaactgggactgaaggggtttggggaggatctgtttaagattggaaaaaatacatcaacttgggaatgtaagcaactagaaccaagcaatctgtacaacgtttttactgttggctgtcttcctctgggaaactaaaagccattttgttgatagcacttcaggtcagaattcatcaacagggaatggaaacattgtttatatgctttggggtacatcaagataagttgagggtcaagttaatgtcatgccacaatcaaccctgtatgtcagggcccttgagagcagagtagtgtcgggagagtgggtggtatggttgacacaaagacccacaggtatttttatgggttcacttaatgaagcaggggcttagttgagggtagagactgttcattaaaccagcctttgttgaccactccctgcagtatggacaggacatgatcaccatccttaagtcccactatagcaggggggaaacagtatgcttaattaagcttaattataaactctttgagttagaaaactggtgaaagtgttatttcctc

SEQ ID NO: 25127 - DNA, 1048 bp, Homo sapiens
atcagccagcaccttcatcttgaacttcctggcatccagaactataaggaataaatttatgttgtttaagtcacccagtctttggtattttgttatggcagcctgagcttactagtacagtaagcatatctgaaggctaaaattgccagaaatagaaacatgtaatcactaggtcaagaggtgagtgcatttacaaatttgataggtgttgccgaattactgaatgaaagggatacccactttaattcccttcagcagtatacagtagtgcatgtttacccacagcttcaccatcaagttgttttcaaacttagttttttcccctaaactgaaaggtgaaagtgattattttatattcttaacctagtttatttaccaaggaaataactctattactattgtaaattgaatgctagcatattttcacatatagaatgtaactgtcagaataaaaacaaaaaatactattaaatttgtgctgaatgttgttgcctatagaaaggtctgagtctgagatgtgttctttcttgttaaaaagagaaatcaggaagtttaaagggatgttaatgacaggttgaaactgaggcttcttgttgatgtaatccaacagtggaaatcagtctgactgtggtcccacactctcttaccttctgccatcccgcccaatctgctgttgtgtagctgaggctatgttgtgttagataagccaagggagccatcagctaggtggttctacatgcataactgcaaaaccagcccaatctggttcaactttgtgttataaaatggttacatttcagttacctccatgttgcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgcccc

SEQ ID NO: 25128 - DNA, 1027 bp, Homo sapiens
aaggggaccccttccctgcgtgaaattccccggcattgttctgaacccagagagagcctgtttggaattgggttggaaggagttttcaggaattcccaggactggaggagggaaggagatgcaggcccacatcgccaccagcattctcgttccccacccccatctcctttaaaaggagcagaagagaagactaaaagccgacccagtcttagagccggaaaaacgcgatctctggtttcccttccccgaacccttctgtgagagacactgggccattttgttacatatttttaaagcaaagccaattgtccctcgctccacaccccttccttatctctcctttgaggttctaatgctctctcctcacccactagcctttatctggttatcttgtaaattcttacatcaagaccctaggtctgtgatttcttctgtggtagccctggcccagttacacacttcaaagactccagaatctataaagttcttagataacctgtctttacgattggactttttaaaagatgggcttagggcatctttccaaggcagcctctctgccaaacacaagaatcagtagaagacaatctgctcctccaaagctgctttgcttttctagtataatatttaaaacatgagctaaggattttgggttctaatttttggtggcctgtggccagtccctttgcctcatttccctatgtatgagcatggggcttcacatctgggtttcacagttaataagtgcagaccgtttctggtgaactgggaactagtaataggaaagtgcttgcagatccacagatgggagaagattggtagaggggaatttttaagtggtcataatgtacttgtggcttggaggcattagaaagtattaactgccatttaaattgaatatatagtatgtcctgtctcctttataaggccacagattttatctgtaaaacaaagcactactttccttgaagtaatacgtgtagtgagcagtactgtttcctgccaggggctgcagttggttatattt

SEQ ID NO: 25129 - DNA, 1039 bp, Homo sapiens
aacttcagttctttctttttcttttagaaaattattcttaaaaagagaagctaaccatttcggagggattaaataggccctcaagtctggaagacataagttagaacttccaggacttttttttttttttccgagacagagtctctcactggctggaatgcagtggcgcgatctctgctcactgcaacctcgccctcccaggctcaagtgagtctcatgtctcggcttcccaagtagctgggattacaagcacgtgctaccacacctggctaatatttgtatttttagtagagatggggtttcaccatgttggccaggctggtctcaaactcctggcctcaagtgacccgcccgcctcggcctcccaaagtgctgggattacagcactgctcctttcctcaggacattttttacaaagatatgcattgtagggaagctgtatagggggtgcactggtgtgtatgcttgtgcacatgtgcgggtgtatgtgtgtataaatctaggcttttattctggcccatctccccctttgagatgtggttttcaataagcaggctcaaaacattctgctgaaaatttgaaactttgaaaatctttaaaaaaaaagagaccatgatattgtgcctggtaggcagggctctcctgggattacagatgtatcacccagtagaagcccgaatgaagcaaatgtaaattatcagacattccagtaaggtaaggcaaggtgcatgcctattccagaacttacagcagagtttgcctagtgtggttatcataaacatgtatgggattctaccagtgctcagcccaggcagcaacagaaaaaaaggggcctctctgagagcctattagccaagttagggaggtgctaaggggtgaaaggtgttggggtggagatcagagaaagacattaaagggagtagtttggaggagaaaccctggagatttgaaaggctttgctggtgtgggaacctgctaggagaggtcagctccaccctactttttgcacttctcagaataaaccgatgggggaaattac

SEQ ID NO: 25130 - DNA, 1051 bp, Homo sapiens
atgaacccaggaggcggagcttgcagtgagcagacatcgcgccactgcactccagcctgggcgacagtgagactccatctcaaaaaaaaaaaaaaaaaaaaaaagctttgacattttggatactgtccctcatcaggtctttttgagctctttataatagatgaccatttcatgtatttaatccactgatgactgacaatataaagttacctgctgataaattagaagtttggatttaattttgtggtaaaactgaggtttttttgttgtgttttttttttaatttggaaatattacattatcttcaagtagctgtcagtcttagtttgcctagcactagagtagtagggaaacatgaacagctagagatgtgttcatcaagtcagagagagatgttgctgctttctgttccctataaagaattaggtgttggtactatttacttgttaggtgaatgaactcagaggaatacaaccaccctttctacaacaagagtcctcgacaagatgatcttggaagacttttgcagctctgaagtgctgttacctggaggccaggcaccatccctttaccctcctactaactggcattgccagatatcccttcgtgattcccatgacagctccataaagtgatggcactcagcacctaattctagtttcaggaacctattcctagtttcaggaattacacaggctgagtcagtcctgtgtactgcagaaagatagaaccgaaaaagaggggagtcctatagattagaagcaactcaaaagataaccaaatgcaatgtgtggatattgtttgcatcttaattcaaataagacaacaatgcttaaaattttttgagacagtagagaatatttaaatacttgactgaatatttgttttgtttttttgagactgagtctcactctgtcacccaggctggagtgcagtggcgttgataatctgctcactgccgcctccacctccccgagttcaagcgattctcctgcctccgcctctcaagtagctgggactacagatctccaccaccacacccggctaattt

SEQ ID NO: 25131 - DNA, 1033 bp, Homo sapiens
ctcctgtaatcccagtactttgggaggccaaggtagaaggatcacttgagcctagaagttcaaggctgcagtgagctattgtatcaatgcactgtagcctggactacagagtaagaccctgcttccaaaacaataataataatcgtaaattttggctgggtgtggaaaaattagccaggcatggtggtgcatgcctgtagtcctagctactcaggaggctgaggcaggagaatcgcttgaacccaggagatggaggttgcagtgagctgagattgcaccactgcattccagcctggacaacagagtaagactccgtctcaaaaaaaaaaaatcataatttttaacatgagttttcgaaaggacattcaaaccatagcagaaggtataaaaggggttcttggttttttgggttttttttgttgttgttttcatttaattcaaaaacctggaaagtagccagcagtaggttctggtttggggggaaagacatggagagtatacaaccttctggacaccagtattaatagctagctaagatttcattattgactgtcctttgccttaagagctggctatgcactgagtaattttaaagcatacaagatcagcagacaaacagatcagttcccgagagtcctggttttttctctttattcacctgggttagtggctcagtctgtacttaggttgataactaacaatctgttctctcacttggaatttggcatccttttgctctcttgaaaacaaaacatgattaagtacaatgtaggatctggaggagaacagagaacatattaagggtgtagtcaagtcctaaaaaaggatgagctttgattaaagattctcggccaggcatagtggctcatgcctataatcccagcactttgggaggacgaggcgggtggatcatccaaggtcagtagttcaagatcagcctgaccaacatggagaaaccccatctcaactaaaaatacaaaaaaaaattagccgggcatggtggcgcatgcctataatcccagctacttgggag

SEQ ID NO: 25132 - DNA, 1039 bp, Homo sapiens
aacataatattttttactcaactattacaactttggtaccttgattagaaaagtcttctaagaaggaagttctctgtcactcttaacagcagttacttgtgctagcttatttcatcacctcacctattttttcagacagtctcattctgttgcccaggctggaatgcagtggtacagtcatagctcactgcagcctcctccaaatcttgggctcaagcaatcctcccgctttagcctctccggtagctgggaactacaggcacatgccaccatacccaattaatttttttaatattttgtagaaacagagtctcactgtctgctgcccatactgccaaaacagagtaaggaggtctcaaactcctagccttgagcaatctacccacctcagcctccgcctcccagagagttgggatcacaggcatgagccaccatacccagcaccttttttttttttaatctccaaattggcgggatgaatgtgtcacagaaataaaagccaagataacactgtaggcttttggcaaaatcaaggtattaaaagaaagaaacaaacagatctagaacagaaaaatcatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctcaaccaggtgcagtggctcacacctgtaatcccagcactttggggaggccaaggtgagtgaattgcttgagctcagaagttcaggaccagcctgggcagcataatgagatacctgtctctataaaaaatacagaaattagccaggcatggtggcagccacctgtaataccaggtactcaggtggctgaagcacgagaatcgcttgaacccaggaggcagaggttgcagtgagctgagattgcgccactgccctctagcctaggcgacagagcaagattcagtctcgagaaaaaaa

SEQ ID NO: 25133 - DNA, 1002 bp, Homo sapiens
actaaaccagctagggtagaagcacttgctttctctcagcaaggcatgtgctgcatagcctctttgaaagacagaagaataaattacaaagataaattaagcaggatctttgatttgaactcataacctggtaggggagccagatacattaatgaatggtaaaatatcatagtagaggtttgtagaaaagacatggcagctccagcaagagagcagtacctgcctgggtttgttggagatggtattaggaggcagtatttgagcagcagtagaagggcacgcaggccacatggctgtgtaaccatgccttcagaactcctaaaacaagagaccttggagagtccttggcagcatcctcctgctgtctatcatcttggaaggcccacttgatgaatttggattatccagttttactggcattgctagaaaatctacttctgttcttgcagatctggctgagagagagaagccttgtattacttgtctatttacataggaatgtatggactgtagaagcttcaggtttggagattggaacatagaaggaagggcttcctttatgagcaccaagacaactcagcttctttcattccattgtcttctgtccgcaagaagagcttaagtttgctctaaagattttattgatgaattctaaatagcaacaggatcctcagtgaaaaaagactcatgcaaagtcccagagcccagagaaagtatggtagtttatcacctatgttagtgcaaaggaaaaggattatcactacttttcatcacattttgaagatctgacttattaagtactttgcagtctctcccgtttgaatctgaagtgtagtggtagcagctagcacttgtcatatttcaggtttggtgtagtttatttttaacctcctgctggtctggagggctacaaaggtcacaccacatagaacaaaccctatagcttgagttgccactcatcttacacccacttctcttctggttgcttttgctttgtcttgg

SEQ ID NO: 25134 - DNA, 1030 bp, Homo sapiens
ggggactggcagtttcgccttgctagagagggctgacccttgtccgtctgcccgtgggatgtgtcccatatgctccatgttcacacgtgcacatgcgcacacatagcctggggaaggggggtacagggcatggctgggcagaaggggagagcaggagtgggggatgcagagccagagggctgggggtgttggcccaggactctgggtctagtgagtttccaggctggctttcactcccattggcccccttcagaccccctttctttctgtcacctctgtctgtcagtatctgggtctctctgtctttccctcccattccttatctctctgtgtctgcctctctctatgtacaagtgtccctctgcctccatgtgccccgtgcttcacattcctggatctctcccctccagctccatccctttcctctgcttcatctctccatgctctcctctcctctccaccagcgcccacactcctggctcttgctgcttcaagtgcctcttgcatcctgctccccagtctccaaacctcctctctctcgcaggcttccattgaaaaggaaggggtcaccttggtcgccattctgtgtactcacaagcactggtaaggggctcccgtcttccctggcccacccttgtcccagctgggcttgccaggactgggcccattgaggacggccggggccagagatcaagaagtcagtacgggccggcacccgccttcctcgtgaagtcacctggacaccagcagggagggaggagaggggacagtctcccaccactccattgatcaagcttctgaagccccagagggcagggcagtcatttctctttcatttcatgggcatgtattagatacctactgcacactgggcatggacaaaagttatgactcttccatcaaggaaattctaagaccaataggggaggtagccctgtatcaaagtatataacagcggaggcaagagggttgggagttcaagcccaacctgggcaacatagtgagaccttgtcttcaaaaaagaagtatg

SEQ ID NO: 25135 - DNA, 1050 bp, Homo sapiens
cttaggtacagttgcccctcgaagccccctgcctgtctctgctgtcctgcagggaccacagtggagggaaccgtgacctcagccggcggcaccgggactgtcgggtgtacgggagccctcaggacggcatcccctacctcacccagtaagtccctgacctaggcaagggatggcccttccatgggccctttcccccacccccagccttcagtgaagtgtttcaggggtatcagcaggtggatctttgccagtgcccttcctggcccaatcccagcctatctgaagactggcactgcccatcccccaactgatccagccatagtccccaaaagaggaaagggggagggttcggacctgagacccgaggcactggggtgacttcttttgtatggaagcccactctcttgtgaatcacccagccccttgggcctgggatggggacagggatcagcatggcacagatccaataccttctgtcccctgctcccttgttccccagtcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtggtgagtttccccgaaagagagaggagctgggagaggagggagagacagaagccagggcagccacagtcccatggagagcactgaagccttagttttagcacagatgttgccgtggcagttacttccatctgtgttactcagattggttttaatccttgagacttcccttggggcaccttgggaggctgaggcaggaggatcacttgaggctaggagttggagaccagactgggcaaaatagcaagactgtctctacaaaaaaattttaaaataggccaggcgtggtggctcatgcctgtaatcccagcactttgggaggctgaggtgggaggatcacctgaggtcaggagttcaagaccagcctggtcaacatggtgaaaccccgtc

SEQ ID NO: 25136 - DNA, 1112 bp, Homo sapiens
gatgaggggaattccatggtcaatctgacgcggcccctgctcttagaactcaccacgtcgcagcgggaaggaaatggcttctagttcaaaccacttgctttatttatggaaaacctgaggcccggaaaagtgcataatttttgcatctgacttaggttctctgcatttaaaacttttcctcgacacatctcgttttacccgcgtgatcttttaacaaaaaagaaagatagtgtaattcagctatccgaagtaatcctacttctcttggcatttaaataaaatctagactccttgccatagcctgcacggccctgtatgatgtggtacttaacccacgtttataatctcgttttatgtctcttgctcctaaagcttcagctactctggccacctaaccctctgcaacgcgcttatttttctccaagatgcactttgtggtctctatgcctggagtgaatgttcttcttatccctcctcctttacatacacagcatgagtgtaattggtacctcttccttgaactctccttcctctccttaaactgtttatccaaatccatctttcttcaggtctctgcctaaatcggtctcagagtggccttccctgactatcctcttcaaattagttccgcagcctctaactttagtagagtaccctttacagccctgatccccgtgtaattattgtattcgtttatttgttgtctgtctccttgagggcagggacagggatcatgtgagccctgttgacgtggtttccccggtgccaggacagttcctagtacaagattaaagactcagatactttgctgcatgaaagaatattgaagggaaggtgaccactgaaagaacattgccatgatggggaaaggagatcatttgatttgagcatacctgcctgaagaccaattctgctttttctgtttaaccaaagggaaatgatttaaggaaagtaatgtactgaaattgtattatcaggcaaaatgacgtaattactaaataaagcaccaaaaattgccatacgtttaagtacaaaaagtgaaaaattgagccaagtatgactaagctatagaaaactgctttttgagatttgatctccattgtcagttccag

SEQ ID NO: 25137 - DNA, 1039 bp, Homo sapiens
tgtttagtgtagtaggcttttgtgattcttttttttttttttgagatagagttttgctcttgttgcccaggctggtgtgcaatagcgagatctcagctcacagcaatctccgcctcctgggttcaagcaattctcctgcctcaacctcccaagtagctgggattacaggcattagccacgacgcctggctaattttttttttttttttttgtatttttagtagagatggggtttcttcatgttggtcagcctggtctcgaactcctgacctcaggtgatctgcccgcctcagcccccaaagtgctgggattacaggcatgagccactgcgcccgaccttgctgttgtcattcttgatggaatacatcctaacatcttcatatattcattaccgctaccattgagcataatttcttttttctctcctctaataaataaggacagaagtaccacacaggattattctaaagattaagtaagaataacaaaatgcggccgggtactgtggctcatgcctgtaatcccagcactttgggaggccaaggcggatagatcacctgaggtcaagagttccagaccagcctggccaacgtggtgaaacctcatctctactaaaaatacaaaaattagctgggcatggtggcaggcgcctgtaatcccagctactcaggaggctgaggcgggagaatcacttgaacccaggatgtggaggttgcagtgagccaaaatcgtgccattgcacttcagcctgggagacaagagcaagactccatctttaaaaaaaaatgaaagaaagaataacaaaatgctcagtggttggctagattcactcactgatatgtgacttgttcccagacttcagctttgggaatttaattcccaaattaaaggctcacacacctataatcccagcactttgggaggccaaggcaggaggatcacttgaggccgggagttcaagaccagccttggcaacacagtaggaacctatctctacaaaaaatgtttaaaaattttccaggctgcagtgagccatgatc

SEQ ID NO: 25138 - DNA, 1052 bp, Homo sapiens
aagagttgtagcatctgaactaggaatcattagaggtgatcgttacagagtggcatgaggagtaaatctgcctgttgtctgcccatggtttcatcgattgttaaatgaggttaataaccaccatgttgtgatcattaaatgaaaccatgtttttaaaaaaaggtggtacaacagaactaactcttccctcacctgccgtaccccttcttctactgcccgcctccttttaaaaagatgtcaattacagattctttttgtgaaagatgggcctaaataactcttgggatatggaaggagagtaagatacattttgagttttggtgttttatttaggaatgtccaaaatattttatcaatcatctggttatataaattaatatataactcaaaatataagaatatttcctttttattctccaaaacaatgaaattcctatatgtgtgttacaaaattgcttgttatatgtccatgtgtgtgttggtggttctcactaagtaaattatgccccatctgatccataatgtgacacagggaactatgtgaaactattgtactgacttctctctgaaaacaatacctattaagtgctttgtaatctcaataagtagagaatttctcctaacatcaatgctactgttcatagtactgagtgttctttcagattttgttgaactaccaccaataacattttactttttgtctgagatttttatgtattaactatattgtctaggtcaaagaatataatttattaggaagtcatttttaggctgagcacagtcgcttatacctgcaattccagcactttgggaagctaaggcaggcagatcacttcaggtcaggagtttgagatcagcctggccaacgtgggaaggtcccatctctgctaaaaatacaaaaattagctgggcatgtggcatatgcctgtagtcccagctaccggggaggctgaggcagaagaaccgcttgaacctgggaggcggaggttgcagtaagctgagatcacaccactgcactccagcctgggagacagagtgaggctccatctcaa

SEQ ID NO: 25139 - DNA, 1049 bp, Homo sapiens
gagactgggcaggaaacctaacactaaaattttatcctgtgtttctgctgagcgtctaaggtgatgtaatattctaaataaacacataccctatcttcaggtaggaattacatttccaaaaatagtttttaagttgagggcctgtttgtggctgcctagaaagggcaagtgcctgaacaacactgcttttgctgttgggaaaggaggaaaaaagctaccatattccttctatcatattgttgctttaagagcctatgattgattccttgaggaccatccctgaagggagttacaaaacagcttttagcagattactgtaaggcacttaaagcttaagctgcattgtatttcagtctatttagcagaacaacttgtggttctttctgtcaggctagtgaaatagtaaaaataaagctaaaaacttacaatgaagcttccatttttaaaaggccattattcagattgggtagagtaaatttgaatccacttcaaagtctattttatgcttctgatcttcaacaaaggcagttctttgtgttctttgtctttacatctgtacaatgggtaggtcatcattctgtcaagctaagatcttttgggaacttataagtactgtgagaaactgtaatatagttcaaaaaagtacgggaatatgcaacttcataccttcatacctggttaaattgagtgagttaattcctctgaacattagtgatctcatctgcaagtgtagatagccttcccccccgcctcccgctccttcttttatttctcatggttgggggcaattacctgagaacatattgggcatagagatggaaatcaccaggaatttgttagcagtttagagcttaggggtagcaattatcatttttctagtctcccatcttgttttccagataagaataattaaggaacttaaccaaggtcacaaacatatttgatgactatagagaattataaaatattcaaatttggggggaatattgtgattctttagcataataatgaaagcatgccctattaagtatgtatttcctacatgagta

SEQ ID NO: 25140 - DNA, 1035 bp, Homo sapiens
gaggcatagtgcatggcatataagaggagtttagtaattatttttccagcacttttcccacactgaacccagatttgacttcagaatccttcttaacatagcattctgggcggcctctataatagacgagaattggcatgtaagttaaaatatttttgccacctgtcatatctaaaaaattaagaaaagggaaatcctgttcaggaatctactttgtgggcttttatggccccaaaggcacttaatagtcatcttattaaagcctttcctctttgtcaagtttccttatgaaatatgtatgctaggttggcactgaccttacacagctttagagaaattactaagaaaattacttttaagcacttaacaaaaacacaagagtactttgagtgttaaaaatcttgggcgttggctcttctacaaggtgtaactataaataatataaaataatagactgatttccttattagttgcctgactaaactgttttcagaatggtttgtgtatctgaaatgccctaacaaaaaaagaagaatgtgcttattaaagtatagcaggtaagcctgataatggctgctttgttttgttgtattggtttgtaaggtttattcgactgcacctgtgaatactattattcagtcataggtgagggagataatctaggacaatctcttggacacttaatagcattttgtggtctattttttaaaatccacaattggatattttaagttaatcagtttgtaaggtactttttgctgattacagggaaaatcatgtgttttcttaaccactgtgatctggactagggttttcagctttggcaccattaccatttggggctggatgaatctttgtgatggaaaggagagggcaggagaggactgtcctgtgcattgtaggatgtttaatggcatctctggcctcttcccactggatgccaatagtgcttcataatcctgagttgtgacaatcaaagatgtctccagacattgccacatgtcctccagggggcaaaatttaccccatttgaga

SEQ ID NO: 25141 - DNA, 1097 bp, Homo sapiens
ggtgagttctttcatctatcccctttacaactacttctcatcacaaagcttaatctctttataactggcattgaacaacttcagtcctctgactagaactaacaattttggaaccttttatgattcttggactatctgatctctgatgtcaattagaatttgtttgtgttttgtgtgttttttccaacccctccccttattttgggggaaacagggtaagatggtcctgcagctatccaaagagccttctgcccgtctgctgaagcatgtagtgagatgttaccttcgactttcagataaccccaggtaaacatttataggatgtataggactttagggaaatactctgctgaacagtttcctaatctcatggcatagctcctgtgtctttaggacagggaagtggggatataactgcatttagtttgtctgagacagaacttagattcttttaaaaatctgaaatgctgaattttagtagccatcagtttcatcttctcactgtaactctccatcctactgtgaaattccagagagtctaggcgattccaaaggaaaccttatgatgcattactcctgttgtttgaattttctgttgctactctacgtggtcagagagagaagtatattttcaaagatctcttaaaaaggaacacagcccagagggctcttgaattctatttccaattctgtccttgattcctataagtttcttgagctaattattttatctgcttatgttcataatctttctgccagaaatcatacactgtagatataatgcattttagaaatgtttgaccttttgctttgtaaatccataattcatgctgaaagcaacctgctcatattctgctaaaccacgtaatggagcaatttctgtgttcctgggaagagagctagcttgatttgatttaatgtgaactcagtctcctgccactgagtttattcaagccctacctgtttgttgaccattttatcctgttcttcagtggttcttgtttcactaaagtttaaaaatgtgtttatttaaaattctacttgtacaaagaaaactagtctgagtgcaaaaactataactttgtttaaaatagctc

SEQ ID NO: 25142 - DNA, 1658 bp, Homo sapiens
tctatggtcggccgcggctggaacggcccccggggcccgctttgtgcgaccgcctccggctcagccgcctctaggatattggggatgtggaagccactctctcttcctcttgccggctgccggggtactctatgttttgtctctgtggtttttcccgccctccacccccactccagccctgaagccggagaagcaccatcgagagctctggggtagagtggcgtgggcttctctgtgggtgtggcgggaagtagatgaaaggacccggggcggggccgaacgcagcttccccaaggtgcaggcgcggtgaaaccatcgagacggagggccagagagtcacggcggtgagagggctgagtgacgggttaccccaaaccatgtggctggaggcgcgagctggggtgtgggcgaggttcaggagggggttcctgggtgtcgcggaggggccggggacgggagagctttgtctgtggccttccatgcataggtgttttggaattctggatcccagttctgaggctcagccgaggtcactgctgtcagctcacctccctgcatgccaggcgcagggcaaagtggccggggttcggggttggaggagaggtgtactagaaacaactttgctcttgtccctcaggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggtaggtgggcgccgtattgtagagagccttgagtaccaggctgagtttatacccaattcaggggtctgctgggagccagccattgaaggtgctggagcagagagagatatggtattggagctgatccctatgatgaaagatctggacccttgtgtagatgttccgtgaagcaggaggtgaagacctattaaaatgccatttcaagaactacgattttaaagacagtttaggtgggaggtaataaaggtctaaacaagacgttaaatattggggacgtaagggggaggatatttgaaggacattactcataacaagacatagggttactgacaagtcaacggacgcttctcccttgctgactgcagccaatggacccctttttatcatagctggtcccagggaccacaaaaatcctgtccatccattaccctgatgtgaagcctgtttatatagctctttttggtttaaggcatctccagacatggtcctctggtaggaaacaggtatgagtagactaatgaaggacaaaatgggatgagggacctggagcctccacccttgcattccaataccacccttaccccacaaaaggagggtattgacccacacagtaatgctgacctgtggccagggctggggaggtccaatttctaatctgtgctttgtcccatctccactgttccccacccctaggttttcgtaacaccccagggcctgtaaggtttggtgtttccctttcaagatgccactttcagactttattctggctctgaaggacaatccctactttggggctggatttgggctggtgg

SEQ ID NO: 25143 - DNA, 1058 bp, Homo sapiens
agctagaagagagccacagagtcagcaacggggagggagaaagaagaaggcaggaaagaagttactgacagattgagctataaagcaagaaagatgagatcaggtttaggctggaaacctaagtagtggctgagactgtagaaggggagttgggcaaaggaattggaggagggagggaggaatgataaaggttaagtgaacaagaccaagtctcttcgacattcctctccttaggcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtacttgggcagctagcatgaaggtgggagaggaagatagccaaccttgtatcctctaatttacttcccagcagctccagggctcttctaggcccctgtaagcatggaacagctggcttgactcaaaagttggcgtggagacagtactcagacctgcgcatgtggtggaggcatgtggtgggagctgggttggtgcctcctcctctccatcagtccatcacctggttctgttggtgctcattggggagaacatcctagtctaggcactgaagactcacctccttggccaggaatcatgtttctggcaattcttggcattgcacagtgggtctttgttcttttgttgtttctttttgttttttcacagtgggtctttgaaggcagagactgagcccttgcaaagtaaggaatgatcttggaaagaacctgctctctcaggctccacgttgtgtctcatgtggagtgctgtggggcaggacttccagctctctgtggcatttctcaccatagcttggcttttctctctcccaggttttgggcttctttatagctgcatatactctctctctccctgaatccttttacctcctgttctctcaggtctgctgctaccatcttccgttgatgcaagtggagctgcccatcagccttctcacacgcctggccctcatggatc

SEQ ID NO: 25144 - DNA, 1048 bp, Homo sapiens
caggaacggtctcctcttcatacttgagttctgggattttactggtgataatcttggtgctgtgtatttgtgtttggttttctgtgaggaagagtgaagccagcttgcttctacactgccattttggaaccagaagtccctattcttagatactttattctttttggtgctgttgtgaatggaattgtgtatttcatttttacatgttgtttgtttgttgctagtatgtagaactaaaactaactttcgtgtattgattgtgtattctgtgaccttactaaacttggttattagttctagtaggattttttatttgataaatgttttaggattttcttttctctctctttttaaaaaaaaaaaaaacaaaaaaaaaaaaaacaggatcttattctgtcacccaggctgaagttcagtggtgtgatcatggcacattgcagcttcgacctcccaggctcaagtgatcctcccacttcagcctcctcagtagctgggactacaggcttgtgctaatttttaaaattttttgtagagataatgtctccctatattgctcaggctgttctcaaactcatggtcttaagtgatccttctatttcatcttcctaaagtattgggattacaggcgtgagccaatgtgcccagccaggattttctatgtacaagatcatatgtcctacaaataatgacagttttacttcttcctttccaatctgtgtatctttgatttctttttcttgccatgtcaaactgcttagaatttctagtatagggtctaatagaaatggaggttaggcatggtggctcatgcctgtaatcccagtactttgggaggccgaggtgggcagatcacgaggtcaggagtttgagaccagcctggccaatatggtgaaaccccatctttactaaaaatccaaaaaaaaaaaaaaaaaaaaaaaaaaaaaaaaaaaaaagaaaaaaaattagctgggtgtggtggcgcgtgcctgtagccccagctactcgggaggctgaggcagaacaaccacttgaacctgggagggggagg

SEQ ID NO: 25145 - DNA, 1033 bp, Homo sapiens
gaatagttgcctccaggattccctgggtacctttctttcaaggatcaaaaagtgctttgtaggcctcaacttcttgtttgattcagaagagaactgagacttttacccacctgggcccatgcctgaggggtagggaaggggagaaccccatgatccatttagaggtagagctggagggtaccaagaccccaaacactcctgccttgcctccgccaagccttttggtctcattgcttcctttgctcttagtggtctctcccgacatcacttctgactatctcaaaggatgacgtgatactcaatgccttcagcaaatcagagactagcaagctggggtgagtgctgcctgggcaagggaggggctgctggctgtgagtttgtagagttttcttccttcccctcttcccagactgtggcagtgagatcagcattctccagctgggggttggtgggagcgtcaggacatgcagccatagcatcctttttctggtagatcttggtatgcccagggaagctgagctggaggacagaagtgcttcctgaagcagccactgtcagccatacccactagctgtgggaaattgttagccctctacccgcacccccattcactcttgcactgcaggtctcaagccttcaagtaaatagaattttttttatggttattacatttccatgtaattttggcctacaacactgtaatgtcgtgaatgcctgctccagactgaaggcaaatcctaaggtaaagtctcagttaaacagtgtctcagtcatttctttcaccacctattccctccagaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactc

SEQ ID NO: 25146 - DNA, 1049 bp, Homo sapiens
attacaggcttgcgccaccacgcctggataattttgtatttttagtagagacagggtttctccatgttggtcaggctggtcttgaactcctgacctcaggtgatctgcatgccttggcctcccaaagtgctgggattataggtgtgagccaccatgcccagcctaatttttctattttttaaatagagatgggggtttcaccgtgttggccaggctggtctcgaactcctgacctcaggtggtccacccgccttggccttccagagtgttgggattacaggcatacgccaccatgcctggacactgcactccagcgtgggcaacagagctagactccatctcaaaaaaaaaaaaaactttgtggtttctggtttcctgtcaaaaattatagtttggtctttgtaggtttgaacatagcaagcacagatgttttatgttggaaccaatgtttttcattgaaatcactgtgagtctgtttttgttatctattgtgcagagcatagtatttggaaaattatctgtagaaataatttaaagttttgatggattttcatttatgtctgcaggtgcctgaaagcactagcaatctaatataaccttaatccaatttcacagccatactgcagactgagcaagggttactacttatttatttatttatttatttatttatttatttatttatttatttttgagacagagtttcactcttgttgcccaggctggagtgcaatggcacgatctcagcttactgcaacctccacctcctgggttcaagtgattcttctgcctcagcctcccagagtagctgggattacaggcatgaaccaccatgcccagctaattttacttttttatctttatgcttggagtttgtttcttgttcccaggccaaaacacggagaagtttactagaattcttcctttcacaagccctggattctaacatctactcctctagctccacaggctgtctaaatcagtcttttcttggctttttccccccactgccgagagagggtcttgctctgtcacccaggctggagtgc

SEQ ID NO: 25147 - DNA, 1021 bp, Homo sapiens
aggtatgcagcaccatacctggttaattgttttaaaaaaatttgtagagacaaggtctcactttgttgcccaagctgatcttgaactcttgggctcaagcaatgtttctgcctcaacctcccaaagtgctgggattacaggcatgagccactgtgctgtcctgggacctttcttaatgctaccaaagcccccttcccttccgtccacccttccgtcccatcctctcctccctgtcatctcttactgggtgaataacacctgaagtttacagggtactgagagtccacaaagccctttcatctccatcatctcatgagctcttcccccttgaggcccagcctccttctcctcctagcctccttcctgggctgagctgtcctatttggtgggagaagttgggggctggggaggaggtgagattagccccagacttgtcctactttggcagaaagtccacagcactctgtgtctgtaaaaggagcgtggggcaggaggggcaggagtcggggctgtggggccctccttggagaaggagcaaggtcggggtgtgggggtgacgaggacgatgaaggaggggttgatgagaattggggtgggggtgccagtgaaggaaggggcccaggagagggtctgggggctggaggtggaaaaagttaggagagggaagatatggcccgaatgtcttaagccaaagagatgtggagcgtggccgatgggaggggggtggattgctggctgagcctggggaggaggcagcgcagcaggagagggatgagtttcagggagaatcctgacgccatcccggctgggcccccaactctccagcctccccccgggtgatatcagggagaaacagccgcctctggacattccttcccttttacagtcactccagctcctcagcagcctgtggaggtcaagcagctgctccagctgggggaaggtggatggaggggatggggatgcatgggagggggctgctggagggaggggctctggacagggaggccaggggacatta

SEQ ID NO: 25148 - DNA, 1033 bp, Homo sapiens
tcttggtacccatacagtactcagtatgccgggagtacagggtcactatttggtgaacggatgaaatcaaatctgatcttcgtaggcctctcagactgcctaccattcactcttttgaatctgacggcttcacacatttgacaattcacctcgtgttgctctgtgacaccgctgttattgcttaagtcttgggttgcttttagcttgttctttgtctgtttgaaagcttgtgcccctccaggtgccttgcatggggcctggtacgccatacatgatggctgacgtgttaaagacatacacagtgcagtcctgtctttctccagaagccaacgctctaattgtggatgaagttgaggaacggccacactaacatggagtcaaggctgccctgacctgtttcgagaatgctccttctgacttccttttttccctaaggacattcaggaggcagaccctcttctccccaagtccctgctttctagaagcccctctgtctgggtttggctttctaggatgcaggccaccaggactctctctcccgctgtcatccctgcagggatcatggccccttaccccgttattcctgtgtccggcagagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaaggtgagctccagcactgggccaaggtgcggtcgaggttgggagggggtgtgtgagaagggaaggggaggttcccccggactcctccaagggaggggtgggaaagaggggaattatcccctccacgggggctgccctgacttgggtgtgtgttcagggacatttctcaggacccccgagagaagggagggcaacctgagcttcccaaaatgagggcggactcttccagattccctggggtgctgagaggagaggtttggtctcctgtgtggtgtgtggggtaggagtagagattc

SEQ ID NO: 25149 - DNA, 1072 bp, Homo sapiens
agcaggatggctggaatggccttagtcatgaggcttttagaattgtttcaaggcaggattatgcgtcagaagcaatcaatggagcagctggtggtgtttatttgggtactaccaactcctgtgtggcagttatggaaggtaaacaagcaaaggtgctggagaatgccgaaggtgccagaactaccccttcagttgtggcctttacagcagatggtgagcgacttgttggcatgccagtcaagcaacaggctgtcaccaacccaaacaatgcattctatgctaccaaatgtctcattgtccagctatcctgaagtacagaaagacattaaaaatattccctttaaaattgtctgtgcctccaatggtgatgcctgggttgaggctcatgggaaactgtattctccaagtcagatcggagcatttgtgtcgatgaagatgaaagagactgcagaaaattacttggggcacacagcaaaaaatgctgtgatcgcagtcccagcttatttcaatgacttgcagaggcaggccactaaagatgctggccagatatctggactgaatgtgcttcgggtgattaatgaacccacagctgctgctcttgcctatggtctagacaaatcaaaagacaaagtcattgctgtatatgatttaggtggtggaacttttgatatttctatcctggaatttcagaaaggagtattcgaggtgaaatccacaaatggggacactttcttaggtggggaagactttgaccaggccttgctacagcacattgtgaaggagttcaagagagagacgggggttgatttgaccaaagacaacgtggcatttcagagggtgtgggaagctgctgaaaaggctaaatgtgaactctcctcatctgtgcagactgacatcaatttgccctatcttacaatggattcttctggacccaagcatttgaatacaaagttgacccatgctcaatttgaagggattgtcactgatctaatcaggaggactatcgctccatgccaaaaagctatgcaagatgcagaagtcagcaagagtgatataggagaagtgattcttg

SEQ ID NO: 25150 - DNA, 1110 bp, Homo sapiens
caaaacattaaaaaattagtcaggtgtggtggcatgtgcctgtgggccctgctactcgggagactgaggtgggaggattacctgagctcaggaggttgaggctgcagtgagccatattcatgccactgtactccagcctggaaaacagagcaaggccctgtctcaaaaaaataaaaattaaaaaaaaatctatctgcaccgaagtccttttatattcaaattttctcctgcaaatgaaaaactgttagagaatatcctcaagatctcttggcttaaaaatgagaggaagaaaaatggccttgttgaattttacttgagctctctatgctgctagaaaacagaaaccatgaagataatcctcccactcttttttgtgttccaagaaaggatttactacaaggaacccccaccttctccctgtggctcagataagacccacagatgcctcccttgtttattagtgacaaggccagacacagactctccaaattcccattctttggctcataaatgattagctgaactctgtaccccctggtcagtctgtacaaaatacctgccaccttgacttgaccaaactctaattaagtttctctccatctatagacccctgaactttgacccacccttaccacacagaataggctgacgtcagggtacacatggttttagtatcctgacccaccttcaccttccatttcacttccccacatccagttctcctgagccttgttcattcttccctaagtaatagaaatgcccgttcctcctttacattcaagacacttgcagacctcttggtctccgtgtcacatagtgccccgactcccttcgtgcaagaatcctttcgaatggcatctctccttacctaaatccagatttgctttttatttgacaaagataataaataaataaagcacagagttccaccctacagtacttgtgcctgcctgtggagatgtctgttaacacacgacaacatgaaacacagatgtaaaacagttcccgtccatgaggtcttcacttctcagtttgagacgctttccaaagtagtaagcagagtcttattctccagggagccagggttgttgcatttattcatttaataaa

SEQ ID NO: 25151 - DNA, 1033 bp, Homo sapiens
ttctagattcgaatcccagttctgccacttgctgactgtgtgcctgtggatgagtgtgcaatggtttactcatctgtaaaattggtctgcattctccaggtgttactagattgagtaaaaatctgcaaagctcctagaacagtgtccaacacatatataagctacgtgtttgttaaatacaagattaaaataaataatatatgcattaatgtcatatcttagttgctcagtggtcctatggaatccagaaagtctgttttctttttaccaactaaaatatcctacaagactttgccaacaagtagctggtcagagagaaaggagccttcaatcaacaacctgagaaccccaaaatatatccatgacatttggaaatgcattcattttccttatttgattagacttacctcagtcctttggttttgcagttggtgatgtatattggccaagtggccaaggatgtcttgaagtggccccgtccctcctcccctccagttgtaaaactggaaaagagactgatcgctgaatatggaatgccatccacccacgccatggcggccactgccattgccttcaccctccttatctctactatggacagataccaggtaaggtggcctggttcttcttcctacccacctactgaggcagcaaatagaggctgcacttctgaattttctcttaaagctgctttgagggaccttaaggtttatgaaataaagattaagagaaactgaaacctattaaacagatgacaattgcatcataaataaagtgactatataatttagcatttaaatcaggttatgcctgtgtgtgaacatcagcaccatattaataatgacaccaggacaactagcataatatgggccatcccaggagaccagcatgtattatcaccctgggctgcctgatgagacagtgcttgaattagtgctctcatcctctgtttgcaagaggagtttatgtcctagtaaatgattctccagggctgagatgattccaccaaatccctctgccagactccccaggg

SEQ ID NO: 25152 - DNA, 1049 bp, Homo sapiens
ctcattttctgacacttgtattgactccttaatttcagctgctattaatttcaaagaactttttcttatttttattccttctgttaatatatagcattgcattcttgtttcatagatggcaatagcctctcttatgcctttgagaatattacatagacatattttaaaatttcccacatttcctacattgtctgtttccactgaggcactttttgtctgctgtttgtctctttctttgatagtgatggtttttcacaaatatctggtgattaagaactttatcttctgtctggattttgaatttttaaatggttttcctgtttctagtttctttttccacaaataaattctcaacatttggcaccaggtttaatattatgaaacagatccgagtatgtcatccccctgctaataaaagttagaagacttttaagagatctggataatgtttcaaccacttagggcagcaaacattcacagtggcagtgaggcatttgtcttctagggccactgcaacaaatcaccacagactgggaggcttagaacaacagaaatttattctattaatgttaatagagaccagaagttcaaatcagtgttactgggttgaaatcaaagtatcagcagagctttgaaggctccagggaagaacctgttccttgcctctttcagttctagtggctgctggcattccctattatcagtccaatctttcaggccagcatcttcaaatctctctgctccatcttcacgtcaccatctccttcatgtgtgtccaatctccttctgcctctctatttataaggacatttgtgagggcatttagggaccactgggtaatctagggtctttttccaaataaggtaacatttgtagatcctagggattagggcctgataaccttgaggtcctttattcagcttactacaactacttagagtcttctgaaatttctcttttcttgtacagttcccttcgcgtttacaaataattgttattattgcctgcagttattgtctgcttgaacaaaaatacatgcatcaactcag

SEQ ID NO: 25153 - DNA, 1026 bp, Homo sapiens
gaagtgactaggtaaacccattgtaacacagtactcctctacaaatttcttttagtagttaatgggttatgggaactccaaactttgaattcttagctaagaatgcatcaagagagtttagcagatttacaataaaattgaaattgcaaagataattatgacatattaaatgatagattttaaataggtagacatttatagaaatgactgtaattactgttgaggatcagctaggtttgtgtaggtgaagaagtggttttggagcttcagtgcatttatgtgtgctcagtagggtacttaggatatttgaggagggaaaaggccgtcagaaactgatgtgggagggtggtgcacaggaagaagtactatggtacagtgacaaagataactttgtcataattttgcctaaaaagagaaataagactcgtagtcatgttatataggttaactgtgcgatgaagtaaagggaatgtcatgaactacttgggaaacccagtgtcttgaatcccgaaacttagaactcaaccttttcacgtttgggaattgcttatgttcagaagtcccatgatttaagagataatgtaaaaatggaagttaattcacatttgtacgtgtcctttgtgtgattgtcggattgaaacattttaaacttcttaagaaatgtagcgaagcaaatttggatttgtatgtgaaagtgacctagatgagaagtatggaaggagacggagacagcagcaagtttgctcctcccttggtttcagaggaaaatggtttttaagagctgggccagatgtttctcatagctacttaaggtggattccttttttctgtgtcttctgtttttaagtgtaatctggtttttgagcacttgcagaaaagctgcagaggccagggaatgacacagcagagaatggaggtgagagggaagacaactggtgatcttagttgctttgattttgaaatatgttgttcaggaatagcttttcttagtggtaaaataattgggaatttgtaggaagaagaaaa

SEQ ID NO: 25154 - DNA, 1024 bp, Homo sapiens
cctcagcctcccaagtagctgggattacaggtgcgtaccaccacacctggctaatttttatattttttaatagagacggggtttctccatgttggccaggctgaccttgaactcctggcctcaagtgatctgcccacttcagcctcccaaagtgttgggattacaggcgtgagccattgtacctggccgaaaagaggtatatttaaaagtgaatttgttacttcaactaacacaaccttcacttaaaaattaggctgtctgttcactctccttagtacaggttcatgtaatgccaaatgtagtacgtagctggattgagttggaattatgaagatcctcaaatattcatgagccaggttgatgtcattaagtaatccaatagttcatgttctcctgaaatacttatatagctggctttctcattaatcattttgtaggaaatgattggaataaataaggagtagtactgaaaagagtaaagaatcctattcagtattgtcttaatcagttttgggaaccctaggcatcagtagaatatagtcttaaaatcgatctagttgaactgcatcaatattaatggtgaacaaattaagatttagtgacctgctcaagatctcttagtaattggcagcagagctcagtctagtctagtgtatgtgtttatgcacatatgcatgtgtgtatatgtatttaaaatccctgttgtgtatctaactgaaaaagatatatattcctttgcctgatttctgtttcctgttgatttttatctagaagagggataaaagctgttttttaaagaaatagtgggtcttgatcagttttggggaaattgaggggactgtatttatagtttagggagagtactcaagagtcctactgttatttccgctatcatactaataggactgaaacaattttaaaattacactggataactgaaacttaaaaagttggctttgttaaactgctttttcatgtagatatattcatgggaaagacttgctataataaatgttcctccctc

SEQ ID NO: 25155 - DNA, 1185 bp, Homo sapiens
acaggaaatgggtaaatttttggtcttcccccaaccctctttctgacttgctccctttttactactgggaaatgtttgtggatacttaaggttttggttggaacagccgcctgtttacagtatgatgtggaaacttttcttgtaattccgttgttaatagatattgtacaaatgagtctcttagaaatatcaagacattgtaggggaccagtgtggtagctgctgcctgatagaaaaaaaaaaatcttcatttgccgatgtaacttttctttaaattattttaaaatgattttgaactaacgcctttctttttcttcctcctagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggtaagatgatctttcattgcctttgaattctttcgaataaaatatcctgttagaaatgaagtaaagggcaagcacagcctgcctccattagaattcgctgttgaaggagaagcagtgtaggaagggggctagactaccttctaatttcttcctgtacttaccagcactgatatgttctgagttttcagaaggacatcgcaacccagtggtgtggagctcttccccagtgtctaccagggtttggaatgtctagggcagttttgagtatgaaaccatactccctgtctctagagcagctgggtgctggaaatggctccaggttttggggtgggacctgctgtgttaaatgtggcttagatgtgggttgcagtgagtgcttcatgtctttgtactttggctgtggcagttgcatggttcttaaaacatttcttttcagaaatatg

SEQ ID NO: 25156 - DNA, 1093 bp, Homo sapiens
ttacagacatgagccactggcccagcagtaactcattcttatatagggatttgttctattaattgcatgacttaatacttctgtcagtttatcaatatgatatttaagatgttgcagaatctttcaaataatttgtctcttgtatttataattttatacaacaaatggaagatgttgggttttagagtttaatttttttctcagaatagaagtttgaaaacataaatacttatggtttagcaactgagattttgtgcctactgttaaattgataaactttgttcattcatagtgtctgccttttttcctttgggaagttctaattggattaaaataagatgactgtttagaaactagtagtttcaaattttcatgtgttgtatttaactcaactattaactcaattattattttattaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattggtaagtcatctaatatttttttgaaaatgaatgtttctgaaatagtttacacaagaagcacaatatatttagaggaggcgctgaataatataaatctttatgtaatcttagtttgggttgttgcatcactcctggaatataaaatattacggactgtggaatttatgaggcctgacatgttatgagttctcaaagatggttcagcagcagtggtattttaaattactcttagataaccttcagtcattgtttcctgcctgtgtttctgacatctagagattagtggatggagctctcacagtctgaactgcacccttgccttgccctgcccaggagaatagaggaaagccaggcagctcaagtactatgactcatatgggttgaaaaataccttattctgcttctccttttaggttctttttttttaaaagttaatggcatttcagttagccgtgtgtggtgtctttgtcgggcacctgtaa

SEQ ID NO: 25157 - DNA, 1972 bp, Homo sapiens
agctgatgttcttctggcttttgccagtgttgttgcacctgacctctcacttttcccttaggactcggctcaagcagctgagcatagtgactcaggcctgtaatcccagctactcgggaggctgaggtgggagtatcacaggagcccaggaggccgtgattgtgccactgcactccagtatgagcaacagagtgagaccctgtctcaaaatctcaaaaccaaccaaccatccaaccctcagctcaggcctcacttgcaagaattttttccaaatccccaggttggagagtcttaacacttagcgctaccattgtagtaccaatgtattgaagtaatacgtttttgcattatgcatgtctccagataggttgtgaacttgcagatggcattgaatatcttcttcacctgcctggtactaatggataccagaaataaacctgttcagaagaacatacttgaagccctgctaatggagtccattaagtagaagttaattgtttttctttctttctttttttgagatgtagtcttgctctgtcgcccaggctggagtgcagtggcaccatctcagctcactgcaacctctgtctcctgggttcacgcaattctcctgcctcagcctcctgagtagctgggattacaggtgtgcaccaccacgcccagctagttttcgtatttttagtagagtcggggtttcaccatgttggccaggctggtctcgaactcctgacctcaagtgatgtgcccgcctcggcctcccgaagtgctgggattacagacatgagccactggacctggcctgtttttcttttaaaagcatgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccagcctgggcgacagagcgagactccgtctcaaaaaaaaaaaaaaaaaaaaaaaagcatgtatttagcagtacaaaaattagggcctaattttaatatgtgcttttaatttcagcataaccattaatgcttaattttgcaaagttttaaataatttgatagcaaattacttagagaatggccagtatttatatatgtattaaatgttactaatattattactcattgttttcccctctccacctttctttgttttgcagatcgtaaaaaggaccttgtaaaactacaggcaggggaatatgtttctcttgggaaagtagaggcagctttgaagaatcttccactagtagataacatttgtgcatatgcaaacaggtaagaacgtggaattcatactacttttacttaaaatatttgatgtccatagacatttcctacctgtatggaccttctttgtaaaaatgttccgagaactcttcctatctgttacttgtgggaatggcctccttctcattgcagccattagctgactcttttccttgtaaggcttcccctgatctttctctctgtccctgttttctgctttacgtctcactgcagtgtcccatggagggaggtgaagaaaataaaaccttccttcctgctgccttggtacccctacctacctgtccctcagcaggggaagcttcacagaactactccagaggaatggggagtaaagaagtggcagtgaggagtgtgctgcttacttactcctgctctacacttgagcctgctcggcactccaggcaggtcttggggctcctatgtaagctgtgttaagctgcagcctaaacacacagcctccccacctcatgatgatgaagaggcagctggggacctgtctacgacagtt

SEQ ID NO: 25158 - DNA, 1026 bp, Homo sapiens
ttccattttgttaactattttctgtatatcttgtagcttttcctctcttgctgccttcttttgttttgttgattttttgtgtgtataattacattctttgattcccttgtcttttatctttgtgtatgttctatagacattttctttgtggttgtcaatacagttacataaaacatcttaaaattattaacagtatattttagtttgatagcagcttaatcttccgtctcatataaaaacttgactcctttgtaactctgctcctccctcaaaaaagacctttttattgtgtagtcattaatatagattcataattactttttatgtctttgttttttaaattctatacagatttaaatgtgacttatacacctatatcaaattactttcagaattctgtatttgcctatgtatttacctttaccaaggagtattgtagtttcttatggttttgtgttactgtttgttttcattttgctttaacttgaagtactcctatcattattttttgtaggactggtctagtggtgataaaccccctctactgttgtttatcaaggagtcttaatttttcccttattttcgaaggacaggtttaggttacagtattcttggttgacaattttttttctttcagtattttgaatactactattttctaacctgccagttttctgctgataaatgatagttcaatgagagcttctttgtatgtgatgagtcatttttctcttgctgctttcaagattttttgtgacttttgacagcttgattacgagtgtgttttggtgtagttctcttcctagtggagtgttttgagctgcttgaatttatactcccatttctcttctcagatacaggaaggttttggccatgatttcttcaaataggctttctgctcctttctgtcttctttttctgaactcctataatgagcatttttccacttgatggtgtcccattcattccttaggttctcttcatttttacatttttcctctcttagtaatttcagaagtcctgtct

SEQ ID NO: 25159 - DNA, 1094 bp, Homo sapiens
ttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatctcaaagtctccttttagtctagataatcattatttcattttaaaattagtgtttttcctagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtctcttcatttattactgcttgtctgttgttatatctggattatcaaaagcaatagtgcaccaattaagatgtgctcaaatca

SEQ ID NO: 25160 - DNA, 1048 bp, Homo sapiens
aggagacagctgccatgtctgggtgagagatggtggtgaccaggcccaaagggaatgacagtggaagtgaagagaagtggtcagatttaggatatctttggagccagtagagttgatggtagattgaatgaaaatttgagaggcagagaggggtcacggatgactttgaggttatttccctgagcaattgggcagatggaatggcaattaactgagataatttggaagggcaggtttttgggggaaagatcaggaactcagtttgggatatgctgagtgcgggatgcctttcagatgtccaaatggagatgttcagatctatgaaactagaattcaggggcagggtccagtcagatataaatctgggagtagcaggtctgaagatgatatttaaaggcatagactggagtgacaatgggtagacaagagataaagcccaacactagtgcgctccaatgtttagagtttggggaggtgtggaggagccagcagaggtaactgaagagggtggaccagtgaggtcggagaaaactcatggccgaagaatgtggtgtcctggaagccaagtaggtaaaaggctgaggaggagggagaggtctacatgtcagcacggccaatgtttggggctggataatcctttgctgtcaaaggctgccctgtgcattataggatgtttagcagcatttttgtcttcttcccactggataccagtagcacttccctccctactgtgtcaactaaaagtgtctccagacgctgagtgccacagatccccaaaggacaaaatcttttctgattgagagcactgttctaactcaagaagtggagaactaaattctagcacaggaagctctctcttaacccagggcagaggaagctactggagaggctgacatgttttgagttgaacttggaaggttgggtagtgtattgacagagagtagctggggttgagtgcggaaggcagctcagcctgggaaaagttcctgatgcttgacaatgtccctgcacagagaaccagcatcactttttgaagccatggaaatag

SEQ ID NO: 25161 - DNA, 1010 bp, Homo sapiens
aaatcctgcattcacagctgttatttacatttaaatgtggcctctgtgtgatgtcagggacacggtgccctaggctactgaggggaaattagggtgacctggtgacaatttacagcagattgcaccatttctcatacactttataacaagagtttgaatgaggaaggaatgcatcaggctaaaagcctgggaatcattcctccagtttccagttttcatgacatgctatgtgaagagcctggtaatttcacaggagaggatcctgattccatttagtcccaatcccttttgccagacagaacatgctggaaacagcgtgacaaagaaggttataatacacattttcagagtttctagactgaacagtgggagcttcaggaggtggtccctgggataaaatgagttatggagagaggggacatttgttctggggttcaatccactgacctgctgggatatccgtgtgggataggcttcaaacaaagtctctgagtcaaaacaccagggttcatgacagcaagttaattaacctctcatcatgccagcatcagttttgtaatcagcaaactagggataataatatcatctatagaatttagggaggattaaatgagttaatgcttgcaaagcccgaatgcctggcacgtggaacatgactttatggtactcatctatattagggtttcccaactcagcatcattgacacctgggcctggataattccctgttgtgggagccatcctgtgcattgcaggatgtcaggcagcatccttaggcgccactgattaatccctacctcccgggtgtgacaaccaaacatgtctccaggccgggcatggtggctcacaccttgtcacctcatccctttgggaggctgaggtgggcagatcacctgaggtcaggagttcaagaccagcctggctaacatgatgaaaccttgtctctactaaaaatacacaaattagccaggcgaggtggcaggcacctgtaatcccagctgcttgggagg

SEQ ID NO: 25162 - DNA, 1079 bp, Homo sapiens
aattcaactcgtagcatgaatacatttatataaatgtggggactacaaactcacatgcccacagcagcaggtaatatagtaacaagacgtgataaattacagcaggtagataatataaaaacaatacctgatctgggagaaggctgggttggcctggaagcttgggcctaggcaattgctgtcaggaggaattgtagcttcattgacggcagacctgatctttcaagagaaccctcctaatccaggctttcaggggaaacttctcaaattaaaaatgccaaagaactcaaccatttttaactcaagttaatttaaaaacagttcaaagacccctcccaccccaacctacacatctacaagtagtatctggcctgtggacagccagcatgaaagcataagaatcattaaattaatgaagaacagagttcaggaacatattaatttttaccactgaggaagaatggggattagttaaatccccaagctttgagtgaccatgtaatgtagtgttcaaggtggaacattactgataatgaaaggaaatgctatgaataattacatgtagactagactcataccatgcaactgggatatataatcatgctatctacattgcatcttaatagagataaacttatttcaacctggatgatctcagtggttgaggaggggcaatggggtggtatggaggggcctcaagggctgtggggcagccactccataccaccacgctctaccaattactctctagtaaatggggtaccaactactctctagtaaatgcagtatcactgtgttgcccaggctggtcttgaactcctggtctcaagtgatctacccacctcggcctcccaaagagctgggattacatgtgttagctactacacctggccttgttcctttcaagtagggcctcttcactggtgttggtcccaaagtcaagtctttgttgatactggcctcattgcccttttctactcctctgcagaccacatctcactgatcacaggagtccttccctaacctatagcatctttggataattatctatcttgcctgtggcactgatgatcaatctc

SEQ ID NO: 25163 - DNA, 1083 bp, Homo sapiens
tggtgggactctgagtgtagactagcttgagaattaagaactcttttctgcagacaaaccagaccagaatttcattttaaggacagagccttgggagccgattattttgattaaaatccctgctcatctataaaatggttaataataatacctaatttataaagtttagaggattgaatagggtaatcatgtaaagtttgagagcagttctactacagattaactagtaatgtggttgtatgtcactttggctcgtggtttggctttttgtgttttagaataactatcaatcagtagcaaaatgggatttctttttcagtcattaaaaaatagctgtgatttattgagtgattactgtatgcctggcattattctaagaatctcaatgttttagatcatttagtttgtataagaactttaggatcagatttagctattattatgactccatcttacatggtgggaaactgagacttagattaagtgacgtgggcagggccacatagctcttaatgctaaagccagtcagtaggaccaatttaggttccagattgtatgctcttaaactccaaggtataaggaaaacacaccatttggaagagatgatgaagattccctggtgacatcctactggcaccggtggagcgagcatatgtgcaggaagcatttgggaggttagtgagcactggcatgggcagggagcttgtcaggagggagtcaggttgggagctggctttgaggattgggaaggaattgaatgggttggtggaggcaggtgtgtgtctcaggctaaggtgtgatggtagcattgccctcaggctccacctacatccccttgcccttagggggcattccagcaggcttctagcctccagaccctgcatttctttgatgaagtgctttctctggccccggatgtcctctttgccttctatgacaacacagcaacgacagagagtcaaggcagactcccttgccctgtgggcataacactgaatcatatctatgcctatatctatatctatataatctgtatctatatctatatatctatatcatctgtatctatatctatatatctat

SEQ ID NO: 25164 - DNA, 1046 bp, Homo sapiens
tactcttgaagatgtcgaacataaatatttctgttagaatgagaagtagcatttgcctcatgggagtttgtcttgaagcgagtatgtcttatatatgtactaattcttaattgatggtttttcacatgcattttgtgttttaggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggtaagggagacaaaattttgaggttgcatgcataaaggaagcaagggaggtgtggctgctgtcattttatgaagtgtgggtccctatcaaattctgagtggttaagggctgctgaggctttgcgtcttgaagaggaggctggagcatgcagggactagtttttgccattctacattatgctgcattattcactcttagtctgcactaggacctgctggaaggtggttttgtagaagacatagtattggaaatatgcaccagctccttatggtagggtcacagaaagacccacagatgtatttgtaatagggagttctcaaaaaagatgactgtgcttgtgaagtaggctcagtgtgctgtctctgattaccaacttgtct

SEQ ID NO: 25165 - DNA, 1042 bp, Homo sapiens
ccctctgaattaatatctcctttcctcattagcacataaggactcattcatgttcagccccatggtgggcactgaggatacagtaacaagacaatcaccatttggcatcttttcttattttgaggataattattatacctaaaataatgttatgccttactcgcttgtctttgcttatacaaaacaggaagtataaaacaacagtccatagctgtgttctagaaccttttccttgtgcctttaggcagctctggatatcaggattattatccgcatggcaggccagatcactatgaagaagcacccaggaactatgacacgtacacagcaggactgagtgaagaagaacagctcgagagagcattacaagccagcctctgggaccgaggtaggagtcttgcgcccttcagttattttaaagcatacctcatgtggtaaggtagtctgaaaaagagctatttgtagcaaattaaattttaaacagttcagaaaaaggatatgtagatgaaaactgtgtgcagattgtgattacaaagaatggggtgtgatgccatattcccagcaacctaagctaataaggtgccagactgtgtatgtattgttaaagtggttctttttatagtcctgctgtacttgatgctttggcattaaagtcaagaaacttaaaattcttagatgcatgataaaaaaaagagagattttctttggaattcatatttgtaaagaaggctcagtgtcactaagtatcaaaatattgcccataaacctccgacaaatctccctcagcatcacataggctaagaattcaagctcagatttgacttctgctgaaccaatctgtctgggggtagagcctagaaatttgtgttttgaacaggctttccaggagattcttttataaaccgatatctgaaaaaacactgtatatattttgccatgtttgttctaggtttggattatgagtttgggtattactgtttttattgtttgagtagcgactaaaaatcaactgttcatttaaagggcatttgttaaagtttta

SEQ ID NO: 25166 - DNA, 1020 bp, Homo sapiens
cccctattttaaattattttatattttttcttcttacccttaaaacatttcagttaagaaatgaataatttttactttaaaaaaaagatttttacacatcagatgctataagactcgcttggtgagaagagtatttctgggattattttgaagccaagggttttgtttctacctctgtctaactagttgcttggtttgaaaaaatctagcttctactttgtgagtatggagttacgttctaaaactcctcacagtagaagattgctaagactaaatgatccagagtttgtgctgaattacttttgctatctgaccttttattttaacaaaatcataggtttttttcttccctttttttccttcctcctacacatgtattttcagaatttaaaacagtctcttctttccattcatgaaaaatcacaaaagtatgtagaacttgtttgtctctcaaatggccacttggtacatcttaaacagagtggccttggttaggattttgaattacggtgaatgaaatataaaaataaataattttaaaaagaaaagaaatcataaaagttaatagttaattgatgatttttgaatataggactttctaaacagaaaagtaatgaaaaaattgtggaagatagaccattgaaaactttgacaaagaattaatataatcagcatgtaaactcatgcaatgaagtaattaatactaactcctattaggaaaatagaaaataattttaacatataatccaaagacttataagtgaccagtgtgcatctaaaaataatttgctgtatattagcaaagagttagtttgttcatctcactacatttattttttttaatttttaatttttgtggatacatagcaggtgtatatatttatggggtacatgagaattttaatacaggcatgcagtgtataatacatcagggtaaatggagtatccatcacctcaagcatttgtcctttctttgtgttacaaacaatccagttctactcttttagttatttttaaatg

SEQ ID NO: 25167 - DNA, 1038 bp, Homo sapiens
ataaatgaattcagtaaagtcttaggttataaaactaatgtatacaaatcagtagcactgctacacaccaacagccactaagctgagaatcaaatccaaaactcaaccccttttatgatagctgcaaacaaacaaaacaaaaaacaaaacaaaacaaaacaaactggggataaacttaacaaaggaggtctctacaaggaaaactataaaatactactcaaataaatcatagatgatacaaacaaacaaatgtatgtcccatgttcaggtattggaagaatcaatatcatgaaaatgaccataatgcctaaagcaatctgcatattcaatgcaattcctatcaagatactaacactgtttttcacagaaatgtaaaaaataacccaaaaattcatatggaaccaaaaaagagcctgaatgccaaagcagtccgaagcaaaaagaacaatccagaggcatcacattacctgacttcaaattacactacaaggatgtagtaactaaaacagcatggtactgctgtaaaagtcgatacaaagaccaatggaacagaatagagaacccagaaataaagccaaatacttaaaaccagctgatcttcaacaaaacttaaacattaattgaggaatggacaccctattcaataaatggtgctgggaaaacagccacatgcagaatatgaaactatccctatctctcaccatataaaaaattaaaatcaattagagacttaaatcttaagacctgaaaccataagaattctagaagaaaacctaggaaaaacttccctggacattggcctaggcaaagaatttatgactaagaccccaaaagcaaatgcaacaaaaacaaaaataaataaatgggagccagttaaattaagtttctgcatggcaaaagaaataattatcagagtaaaatacaacccacagaatgggaggaaatatttgcaaattatgtatctgacaaaggactaatatccagaatctacaatgaattcgaacaaatcaacaagaaaaaaaaataaacctgtcaaaa

SEQ ID NO: 25168 - DNA, 1033 bp, Homo sapiens
attgttgggattcgatcaggctggtgcaatacctcaggcagtaccattcaggacgtagttatgggcaaagatttcatgatgaagatgccaaaagcagttgcaacaaaagtgacgcttgaaaaaaggatctaaaagagcttctgcacaccaaaagaaactatctaattgtacgcatcaaacatgtctgtaacattttaaaaggctttgtcttaatatttatatcttcaattatgaattgtctcttttggtatttataaagagccacgttgttaaaaatattaggtgtataactgccatttaagtcttgggaagggatatattactaagatcatttgcttaatttatttgcttgtgtgtgtgtgtgtatctcatgacatgattatatgcccacaattatatatgattattataattcattaaaaattttaattaaaaagtaattcaaattgtttctaaagtagatagatgatggagagtgagataggcagtactgttttcaaatagaactgtaatatgctagcactgaaagcaaacttagaggtcatcatatctgacacgttggtttcagatcaggaaacagagaaaacaagaggcttaattctctgtcacagtatactggcccattaactgtgaccaggattactattgacagtgtcctgccctaggaatacagatgtgaagtaggttggttccctaggttggtctgtgggcagcctgggagtcagaacctctctggaaagtgctagattagactcacattttctttttccttttttttttttttgagatggaatctcgctctattgcccaggctggagtgcagtggcatgatctcggctcactgcaacctccacctctcaggttcaagcaatcctcctgcctcagcccgcctagtagctgggattacaggcatgcaccaccatgcccagcaaagcttttttgttgttgtttgtttgtttgtttgtttttagtagagatggggtttctgttggccaggctggtctcaaactcccgatctcaggtgatccacccg

SEQ ID NO: 25169 - DNA, 1061 bp, Homo sapiens
aacatcctttgttgtataaatcaatgtttaaagtctaagttttggacaatctgggtattgatgccaaatttgaattagtgagttcctggccatggtctattgatggatttttgtttccccttgaatgtgatgagaccttagtgaaggattttcatagaggagcgaggggagcaaagaaaatagataaaagcccaggaatagggagacagtctgttggaggaactaggttggttgtggttacaatgtatttttcatggggagatttgtggggaggattgcaatttatcagagggcagagataagtaggaatcaagttgtgaagggctcagtatgatgtgtttgaaggttttgtgtttaatcctgaggacagtggaaacaagatcaaatctgattattattattattattattattattattatactttaagttctgggatacatgtgcagaatgtgcaggtttgttacataggtatacatgtgccatggtgctttgctgcacccatcaacctgtcattctcattaggtatttctcctaatggtatccctcccctagcctcccacgccctgacaggcccgggtgtgtgatgttcccctccttatgtccatgtgttctcattgctcaactcccacttatgagtgagaacatatggtgtttggtttcctgttcctgtgttagtttgctgaaaatgatggtttccagcttcatccatgtccctgcaacagacatgaactcatccttttttatggctacatagtattccatggtttatatgtgccacattttctttatccagcctatcgttgatgggcctttgggttggttccaagtctttgctattgtgagtagtgccgcggtaaacatacgtctgcatgtgtctatagtagaatgatttataatcctttgggtatatacccagtactgggattgctgagtccaatggtatttctggttctagatccttgaggaatcaccacactgtcttccacaatggttgaactaatttacactcccaccaacagtgtaaaagtgttcctgtttctccacatcctctccagcat

SEQ ID NO: 25170 - DNA, 1032 bp, Homo sapiens
gacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgcctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattgagaaaattcacaatataaacagaaatacaaataaatacatacacaattttaaagtcacctgtagccctacccttagaggtacccagggttaacattttggtggtattgtcttatcaatttttccgttgatacattcagcaaatttggagcacattgaccatggagttttgtgtccaaatccaatctgaatttacctggaagaggccttgacacctgcatggaaatgagctaagaaaaccactggagccttgggagctctttggcctcctggctggcccagtaatatctgagctcctttggttaatttataactgatataaaactacatcttctttataatataaatt

SEQ ID NO: 25171 - DNA, 1059 bp, Homo sapiens
taatttgacaagcattgtaattttctaagttatgtacaggaaaaattgaaaacacatcacaaaacggaaaataattggaaaaaggaatggggcaagggaaatatattgaaaaccaacacaccacaccttgcctttcattttaaactagaaatcaaattatcactagcatccagacaggtaagaggtttagtattacattggccaagtaaattccaaaaaggtctctctttttcttgtctgaaaatggtgacaacatatttatagcagacagaagtgctccatatagtgcctggtacagaatgcatatccagcgtttttagtctagtgattattattattattattattattttgagatggagtcttgctctgtcacccaggttggagtgcagtggcgcaatctcggctcactgcaagctccacctcccaggttcaagtgatcctcctgcctcagcctcccgagtagctgggattacaggcacctgccactatgcccgcctaatttttgtatttttagaagagacggggtctcaccatgttggtcaggctggtcttgaactcctgacccgaagtgatccgctcaccttggcctcccaaagtgttgggattataggcgtgagcccctgcacccggcctagcgactattattttattatcattactattcaaggccagacgctaagatagaagacataggcgctgggctaggtgctgggactcattggtaaacaaaatagtctgaatccccagccatgatggagttagaaggcagcagcccagtgaagagacaaatgtgtaacatcagattgtggtgctgcaggagaggatggggtgtggtgatggagaaggagactttttaacatttggtagaggtggtcagggaagcagactgaggctggacatggtgacaaccttgtgaagcactgagggatgtggtccaggacagggcctctcagaagtggagagaggccacacactaccaattttaccacttctgggttgtcaaagaataaaaccaggccaggcacagtggctcagccctgtaatcccagcactttg

SEQ ID NO: 25172 - DNA, 1036 bp, Homo sapiens
gaaggagtggagctgatacaaactgatacagaaatgctctttttctcttctcagcagttttaactatttgcaaaagctttattgtccgggatttttacagtgacttttggagtatgagcagggaccttgaaactcagaggaggtacagaaatagaaaacaatgtcatggtaatgaggttgcttgaaaatgacagttttcataacatatcatgagttgcataaggatacctacattacactttttctgtaaagttctaaactttcgtctctgactcattagagtgtttaccttttgagagaggaaaaagagttggatcagggatggtccacagggactcatcaagtataactgtagtgtgttctttttaacgaaaacaaaactaagaaaaaagagcaaaatttgataaactactgggcatgtgccctgccactgatcatatttttctctatatgatgttgtatattatactacttcataattttgaaaattaatcaaaataaagcagactgcagaactataagtatactataatttcactattaaaaaaatagatacagaaatggataaatattatatgtacctgaatatgcatggaaagatatacctcaaactgttaatagtagatatctcttacagttagaatggggcaaaaagatattttagagctctgacattaaggaagacctccttccccctgccaggcccctaagtaaaaaaaacaaaacaaacaaacaaacaaacaaaaaaacaggctcctttaataagccgatgagaggaaaactacaaagctctaattccagaagaattttaggatagttttttctgtttctgtgaaaaatggcattggtatcttgataggaattgcactgaatctgtagattgctttgggtagtatggtcattttaactagattagttcttctgatccatgagcatgggatgtctttccatttgtttgtgtgctcttcaatttctttcaccagtgttttatagtttttcttgcagggatctttcaccttgttggttaaatgtattc

SEQ ID NO: 25173 - DNA, 1064 bp, Homo sapiens
atacacaagaatcgtcaatagttaggaattaatctggaaagagcaaaatcagttggcatatataaaatctgacctgattttggaggagaagagtaaaggcattgagtggtttcagaaatggaactatctccaagccatgccagctttatacagaagccatcaaatggcatcctccacaggatgccaaattctacagcagttatatccaaagtgtacagccagagctggaggagtagaagaaatatctagctagatccacccttaacacagattatacttagaaagcagcagccttagaatctgaaggatgacacaaaagccatgaatgtctagcagaaggccctagacctgtaattctaccgtaaagaagtagcagatggttattggtgcccagttcaattgatatgacaacgctaaggatgtgaagcaaaaaaccatagctatatgacatatcctaaaacaaatgcagaagggctcccagggactcagtgaatatttaaaagggtcctgtggaagcttagaaaatcaagaacttcatgaatatgggtctgatcacactttggtgatggtttcttgagctctttttccttcctcatcacttctggaaagaggagctgggactgcaatgagcagaatggagcaaaagtctggagagaagaggaaaagctgaattgtatatatgtttacacattcatgcatggaaaattcagagatggacacttgcgttctttgtacagctacagttttatggccctcttagcacaagcatggtctcgtcactcctgacaaattgggctatgtgtccttcccaaaacccgcagtcactggcttaactgttctccccatgattcgtgattttaaattttggacaatgcacatgttggggagggaagatatttatcccaactgttcagtctacattgataatttgtacctttcccccttctgcataaaagtcccacagaaaatgggggtgagtatagaggaaaaacacgaaggctctgagtagattcctgaagaagaggtgggctttgaacagattgagagaatcagccatcaaaaaa

SEQ ID NO: 25174 - DNA, 1102 bp, Homo sapiens
ttattctttcagatgtaatacacattggatgacatttagcctgatgttagttttgccttgacgttgagaatgttgagccctcattccactgtcgtagtctgtatgtcagttaaatacctcacaatagataatcatactgtaatgttaaacagctccctgaaaatactgacacagatcttaagagtttaggttagaaccataagaattggttcattcagctttcagaaagcactggcaggggagtcaaatgaaattgtgaatctcagcccacacatgaaagaacgattaagattattgtcactaagaagcccagaaatggttatcagccattgataatttaagaagtgtccttgccttcttttgctgtattcacagatttgggaatatttttatgctttagtcatttaactagagaacatatgcttactataattaaacaatcaaaatgctttgttaccattttctaagactaattcatccttaaatcagtgtcatttattcgtcataaacttcaacttcattggctttacgaagtgtttgaaatggtgtttttatggaatcacacttttgattcatgtgtttaaactttgacatctgtatgtgagaattccctgtcctactcttctaatcatccataagtcgacagcagtgttgtttcttagaagttggtttattgaattggaatataaacacgaagtaaagaatgctgcttctccatgggaggggttgaacacattcattgctgtagttctcttccctctctacagttctttcatattcagtttatttattttgatgtttagggttacaaagttataagtgctgccttgtagctagtttttggaaacaattcaaaatatttattctttgactgttttcttgtggggagagtgaagggtgggaaaggggcaagaacactaagaaaattaagataaagactgctcagctgaagttttataaaaatctgacttgagtgtttttctcttcatttgctgtgcttgtgtaaacagtgtgacaccatcgccacaacaggctcgggtctgtcctccccatatgttacctgaagatggagctaatctttcctctgctcgtggcattttgt

SEQ ID NO: 25175 - DNA, 1075 bp, Homo sapiens
acttaggatctcagtgttgagcaagattttatcagaattttaagtgccaaatcagtttttatttcctttgtgagaagtatctggcatgacttttcagatataagaaataggaatgtgaaatttggataatgttctacttgcatgattataaaataatactgcttataaaattttaagtgcttctatgttccttgctctgtagatcattttttcttttctattttattactcttggctattatgctaatgcaataccttatctttggtcatatgccatcacattaggtgtagttaatttaaactagaactatttggcagaaaaagaaaaaagctttctgcttgctttatcactatgaagtaatgcagattcacaattccttgacataagaactgtgttcagtttacattttaaaggacgctgtcaaaaggtttgtgtaccatatatttttttcttacaagaatgtagatgatctaaaccaaactcaacgtgaaaaccaagttaaatcctaggtacatgttagaaaagtttatttacacaggtgagtgttacgcatttggagaactgatacactgaaaatttaccaaagcaccaggtgtgtcatttgctcaggtgcagcagaaattaaaatactattatgatttggtccttaactggttagaaaatgccggtctctccctgtatctgttagagctatgtatctcattttacaatgtaaaatattcgcatcttcaaaaagaaacttagttcctgtgtaagaaccttatttaaatattgatagatgagtcatgcttagctctcatttttacgaggggcttgattatttttatgcagtttttccttaacagattgtaccagctttgagtgcatagaataagaaaccaatgtatgaataatttatatttttggcaagtatccctataaatatacagcttggaagacctagaaatccagagttgcagtggatacagcgtttgttatttataatttttctctttaaaaaagtgtataattcctgatccccaattaaactttattttctgtagcagattacatttttatagcaaagaaacacat

SEQ ID NO: 25176 - DNA, 1034 bp, Homo sapiens
tttagattttgtccactacttttttttttttttttttttttgagacagagtctcgctgttgcccaggttggagtgcaggggcgcgatctctgctcactgcaagctctgcctcccgggttcacgccattttcctgcctcagcctcccacgtagctgggactacaggcgcccgccaccttgccccgctaattttttgtatttttagtaaagacggggtttcaccatgtcagccaggatggtctcgatctcctgacctcgtgatctgcccgcttcggcctcccaaagtgctgagattacaggcgtgagccaccgcacccagccttgtccactacttttaactagaatgccttaattaggtttaagtcataacttgaatattattttttagatgcttgctctaagtgttacaaggaccttatggtgtagtatttgtggctttcccagaaactcagaataacaatagggatttatatcatgcttattattatatatagaaagctaaatatattcagttttttaatgttggactctggatagacgaatattttggactagccaacatatacggtgtcttggcatcaatagtttgtagatttgataacctactaaaggcaccttccttccatctgttctagattttaaatgtataattttatgctatgaaacatatgtaatatttttagtaaataactaggatgggctagatctaaatgtcaactttattactttctgccagtattattggcaactacataaacttccacaggttattaaaaatatttttaccagcttctcccacagcaggagaaaaacaattaataaaactaactaaataagctttcctacttactcatccagcacagattgttatttgaattgaacaaatggttatttgcaagattgtttgaggcctagttaagagcagcacactgatggacatatggaatgagccacaccatctggttacagtcatacctgggtggtggtcattaaaactaaatctcctggggatctgcagatgtcttaattatacta

SEQ ID NO: 25177 - DNA, 1085 bp, Homo sapiens
atgtgggaaacatctgtgtatggtcttctgcatatataatttaattctgtcttaatacttgcattgtagttgaacatcctattgccaaagaaagtcatgctccaagcccagaatcagagtgagaggggctaccaagttacagggcaaagggcatggatacaatcacacaactgatggcaatacgaattgtattttagtcatcaataaagtatatctgtattggtagctgtggtaagcaaataatgttattactatttatagatatgcatagagaccatacttacagagtagatcattagtttctacagatgtggtttacaaatttcttgactattactttagtgtttatagacttctacagtgtgtttggtggaggagatatgtatatcattaagttacagcacataatatgccagatgctagtaaaatatttcgcattggagcactttgtatttatttgctgaagtaatttttgtcatttttttcagaaccagaatatttcacaaaaagtttccatgtatttcttttgtatcatacagttactttaaaaaaaaacctgtagtgatcttggcactgtagctcccctgtaatcccagcactttgggaggtggaggtgggaggatcccttgaggccaggaattcgagatcaacctaggcaacaaagcgagatcccatctctccaaaaatttaaaaattagccaggcgtggtggtacacatctgtagtcccggctacccaggaggctgaggtgggagcattgcttgagccctggagttcaaggctgcagtaagtcatgatcatgcaactgcacaccagcctcggtgaccaagcgagatactgtctcaaaaaaaaaaaaaaaaaaatctatagtgattttctgtatgtcctcatttgtgatgtcatgggcaaattatggttttctagttaaaggaagttggattaacttctgattataaagttaacggaaggtggactggtgaacactgctgtaagtagataattcaatggagaagaaaatttagaaataattttattttgaaatatgtatagtttatgttttctagttgtaagttaaccttcctaata

SEQ ID NO: 25178 - DNA, 1445 bp, Homo sapiens
gaccccaactctcttttttcacctcttgcgtttgagtgctggtaaaaagagttggtgggagagccaataaatagagtaaaacttgtgtaatttatgaatatattctggttttatctccattttaggattattgaaatgtaatgcaaaattactgataaccaccaaattcttttgtaaatttgcaacttatttcttgttccctttgtttttctctctttaaatgcagtttgtgagtcttcacaggtaatgttggacttttctttgtagccctattggccaaaaatggttagacaagtcactgcaactctacagactaatttgtaccatggttgcactaatactttcaacagctcccttaaaatgcactttgaaaacaatagccatcatttaattgtaggatatgcagtaaaggaaaagaatcttatattttgatcagattgatagaaagtggttaatcttaactgttttgttccttgtctgaagaaagaatgaaatagctacatgtaggctgtgagtcaggctgcctgagaggagttgttttttagtctgaagttcttaattacaaatgactgctcagattaccttttttttctttactttatttgacttttggtttcattacaggagaataaaatgtatatgcctgttacaagaagaaactactgaattactcatttatttttccttctactatggttgataccatcttttgacgttttgccttggagtagtttttagttaaatactaggtcatggtttaactgaaatgtctttttccagagcctttccaagcattcagaatccttagttttccatatatagttcagaaagtcattgattgccaatttcttctcatcctgatattcttgttaattttaaaaaaaattaggtgaaaattttatcctgaacagtttgatacgactgatggaaccattaatggcaaatgataattattcacatatgccagtctggttcattagcattgttttgtagggaaactttttcttttgtagataatttagtgtgacttaaaagccagaagcctttagtcttcatgtgagcattcaggctgaggtatagtatttgtggatgtgtgttgctgggtggggtcattattgggttcagaaaaagtcatcttctacagaaagacgcatgaagctagaaataaaattcacctactgaatttggttattttgcctgatgataaacatcatatcccaaaacctgtgcactgtaaactgtaattgatttttgtcacattctatactgtaggatctaaacccaactgccttgcaactcaggtaacacaaatgagtagtataatgttgtgtttaaagaactatggtgccctttttaaaggggatgttctaatctgttaccacatggaaataggggtttaggatactagatatattgattttttttttttaataagagaagctaga

SEQ ID NO: 25179 - DNA, 1060 bp, Homo sapiens
ttttacaaaattggaaaacgtcacttgtagtcaaaagccattgccagtcattgattttaatgttgtaagattgcttataggacatttaatttaggaagaaatgatcatacagtctatgagagggtactaggaaaagcttagaaatttcaagtgctctgtttattctgttacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtatcaagctttaagcaaaacaaatacaaatttgtgttaaacagtgctcttaatttggttgtatttattaaaatctgaacatgctacacttttctcagttgttgtatagaaattttgtctgcactgtcattttgagtaaaatgttcacttgacacattttagacctgaaatatcaactacaaaactgaagacatagggactgatttgtaaactttcagtcttactagttgagaaaaattttattttgtcctagaaggcgtgctttacttttctttggctataaagagccaagaaaccccattggcagagctgaatggaggattatttggtggtttctgtaatatatttacttcgaacaattttccgttaacatcttggtgggttttttatatttaaaaaaaaaaattcatgaattttacagtatagtcttgtatccagttttatcttaaggctagtagcctctacaaatgcatgtggcactggtgaatagcaggtgtgtgttgctaaatggaattctccattctgatctctgggcctgttttcctcctctccaaaatgaggataattctaagcattaaactcatggagttgtgttctaagtattattgcatgttaaggcatatagaacagtgcctagcacatagtaagtcctcaataaatgtttcccgttattacca

SEQ ID NO: 25180 - DNA, 1938 bp, Homo sapiens
gcattgatacatgctacaacatggatgaaccttgaaaacattctgctgagcagaagaaactcgtcacaaaaggccacatatttgtggtggccatttgtatgaaatgtccagaattggaaagaaaaagtagatcaatgattgccagggggtagggttttagtagtggtggggcagcatgggaagtgacagctgataggtatcacatttcttttgagggggatgaaaatattctaaaattagattctgatggtggttgtacatccctgtgaatatatttaaagaatcattgaattctgtaagtgaatgaattgtgtgtagtatgtgaactatatttcagaaagctgtaaaaagtctaaaaaaagtttagagcagttcaggaccagagcttggggggcatctttgttgcagactgaggtatagtgattaatattggttaacagtcactgttggctaaaagtcagtttttgccagtgcgttttgtgaaacatgtctcctgtaatgttgttagcaaaattctgtggaaaagtgttctatgtctaaatacatatgagaaatgctggaataaacacagtttaatcaatgtcattaatgcaagactgctctgagcctgtaaagtgctttaagataaagtagataaggccgggtgcagtggctcacgcctgtaatcccagcactttgggaggccgaggcaggcggatcacgaggtcaggagatcgagaccatcctggctaacacggtgaaaccccgtctctactaaaaatacaaaaaattagctgggcatggtggtgggcacctgtagtcccagctacttgggaggctgaggcaggagaatggcgtgaacccgggaggtggagcttgcagtgagccgagatcacaccactgcactccatcctgggcgacagagcgagactccgtctcaaaaagaaaaaaaagaaagtagataaatataagggccacattaatttttcacaggcccttctccctcagttaacctttttttttttgtatttggaacacagtgacacttttttaagttagcaagaaagttacattcattgagtatttattgcaaagcactctaattcgttgttacatttattcttcacagcagctttgtgaagtatagatactattgtctctatccctccacctcatttgcaaatgaggaaactgaagcttataaaataaagtaacatcatgcagccagaaaatgacagaaccacaactcagaaccattcaattttttaatcattcttatgccaatttaaaaagtattctaattttaaatccatggaaatatattttagacacaatcttcagattgttaaaccgaacaaacaaaaggtactagtatttaacaatttaagtttactttctattaactttatatgtaacctgtctgtcctcaaacatgccaggtgagtaagatctgtacaagatgcctttttcttttttctctcttcttttcagccattgtattttaacctgtaaataccgcttacctttctcttgaactagaatatttaataatttttcccttgtaatacttaattagttcatttgagttatttgtgtatttctagttaatgtgctgatttgtaaataaaacaatctagcattgttcatgcactctctcccaagacttggttttgatcctaaatgtagatgctggataatctcatatgatcctatgaatagcgtatttagatgtagcttatgatgcctacaaagcattttttaatgactgtaaaaaagttgatgcctatttgtttaaaaaattgatttcatcactgtttcttaatttgttatttattattctaatctcccctttattttaaacagtataaatattacaggtcatgaagatggttgaaattaaaagtcttattttgtgaatgtgtttttgttatgtattatgctacccccttagcaacagta

SEQ ID NO: 25181 - DNA, 1038 bp, Homo sapiens
aagggtctccagactctttgagaaccactatactttaaatttgtgtatttctagaacagtatttacttgcagggcaaacataactattccctgggttttttttgtttgctagtgagaactgaaattgcagactttttaacactacttcaaggtaataatagcagtggtattatgggctgtgtatgagatagtcatttgtaaaacaattttcatatttcatctcttacaatccctgcagtggacctatacttttaggatgaaagaagcaaagcatagagaggttaagctagtggcagctttttgctctggggaacagatttggattaaatgctatcacatttatatatgaatgcattctttcttaatattttgaaattctgaacaagttaacgttcttgtcttgtatatctaaaaaaactttaatcacttgaattcctttcataatttgatgaaatcagtacagtttattcttggtttttttttttaactttagaagtaaattaatatggtaactagtggagcgtgctttagattgaagactcatctgaagtatcacagactcctattttgtaaagcattccacctttattgatacagtttgtggcctatacacttttaaaatttattttttaaaaggtgatattaaaatttgtatttaacctgttgtattcatcctcattagttaagtttttctttttatgttttaaaacttagtgacattaaacttttcacgtggttgtttgtgaacagatgaatatataaccacgatgtaatccagtgttgtgctgctgaatgtttaacaaccatctttcatgaaagaaaaaaggccctgttttgtagcatttactaatatttatggtataaatactgtcttcatggtgattttacctgccaatctgatgtcattaaatgcagtttgatgaaagagatagccaaccagtggctttcccaagccttggcaaaccagcttcagcacagcaaaggacatacaattccacaactcattaattaaatgtattggtcatttgatgattatat

SEQ ID NO: 25182 - DNA, 1058 bp, Homo sapiens
agaaaaagaggcactgatttaggctctgtctatgttacgtaaatcatttttgtatatagcttttaatttgttatactaaaatcactctggagaatcttaaaaaggagattgagaaaaaaattctgtgaaagtacatttgaattaagttccttgtggtgtgtgtgtagttttatacatgtgttgctaggagtcaggagttcgtgcagtgagtgatttatttatttaaaaagtagagaaatatgctggtatcagcgtcacacaggtaaagtcattaggcgatgccgtgcaatgaagataaatgcaaaggcagtagacttcctctggaagatattgtggaagaggaaaattggaagagcacaggttttgctatcaccatgaagtcagtcactggaagaggaaggaagctctgcagatgacaaaagcacctgaggacacccgaaatatctcttggtgctggtgcacatttgagcagtagctcagaggagtggcatcattgaggaggaggatacatgtgttaagcaccctgctggccaaggtatggcccggatgttggaaactggctgtagagccgcagtggttcctgatattaaagaaatgttgtttaaagctgtttttcttacaccctatttgcctttgaaattttaaaagcattcactttacacatctgttttgcctttttacaaaactttttttaaagagagccctctgccaccaaaatatgcttgacctcatcatcctgagatcactgctatcaaaatatttggtgtatattttttccctagctaatttgtgtgtgtatatacattctatataattgttttattgtgtacaatttgtgtaactattatctgctttaaaggtttaacagtacctttttctgtcattaaatagtgtgcaaaagcatgtgtagtaactgcactatatgactgtctctggtcagagcataaatttcttcactggtctcctgtacagcggtctgcaaacttttaagtggctagctaatacatatttttagactttgctggtgatatggtctctgtcctaactactggactctg

SEQ ID NO: 25183 - DNA, 1035 bp, Homo sapiens
tttcatgtttcttgaattactagtgaggttggtcatcttttcatgctttgtgaattaccttttcatgagatttactcttccctagtatactcatgtttaaaaaattgtttttagaccttgtaggaaaaccatgttatgtatttttcatgtttcaatttactgttttgatttttacataagttttatatttgtgtaaagtcacagctgtccatcttttctataattttttttcatttatttggtaccaaaggcaatcttttctgtaatttgcaagtttgatcatgcttaagaaaccctttactaaaccactgttatgaaaatagaaacctgtgtgttctcatagtatttctgtggtttagttttgtatcaatattggaggttgatacaattttttaacttttggggaaagttattaggagtaatactagagagaaagtccagtgtttataggataatacacatttctcatggaaatttagaagtcaaggatatgaagcttgtatcaaaagcctaaacgggctgggcatggtggcacatgactgtagtcccagctacttgggaggctgaggtgggagggtcgcttgagcccaggaggctgaggttgcggtgagccgaaatcacaccactgcactccagcctgggtgacagagtgagaccctgtcttcaaaaaaaaggtgggggtgctaaacaacagtggtatgatctcttgcagcataggatgatttcagcttcaaaatttcaaaaattcacaaaagacaaaggacaactagaaggaagttagatgggtatatgtattttaaaagggacaggggagctcttataatgaagaggtggtgatagaggggtagtaggatgggtggaagatagactgagtggggggcgggcggggtgggggaagggataggccaagagtagcctatttgtgggcagacaagacaccaaaaatgccagtattctagaatgcttatactgtccaaacagcctctcctggagaagcactttgttattgctaatctgaaatttagtcatctatgt

SEQ ID NO: 25184 - DNA, 1678 bp, Homo sapiens
tgcagggggcggggggtattgggctaaagaggtattttggggccagatccttgaatgctgtagaggagctatttgagcagcattctaagagaaacttagagctcatttctcagtgactcatgagcccggaaatgtaggctaggggatattaaaggcgctcttgtgaaaggagagaggaggaggcccagtcaggagttgacattctgtgccttgaatgtaatgcagtttcagatcgattttgacagcttcccagataatcaagtaaatccatgcccaggctaagcaaagtacctttgcagaaagcttcattagatatcaggctcttaagaggtaatggaaaggtgtctataaaataagctcatctgcacacagaaggtgtttctatttgtgcgttcgctacagtgcataaaaacttcttgcactttgtattaggcgtatgtactttggaattactaagctaaacctacattctttgaggtggcatttgtgtaaaataacataaattgatgatttttaaaaaatggttagtaatattctgctgtagaaagccagacgtagaccttttacagaaaggtaaaactttgtttttatattttattttattatgaaatctttatagtagagccagaagtgaaagtgtttagctttattttgtagtttgttcaaattgttaggaagtaattagcagctgtattcgaaatctagaatatacgatctgtgaaagcagcttagggcctaagttttgtaagcttgcacttgtttgcgtgtatgacaagtgaatgccacctttttgcagtttaaaaattttctgcttttcaaaataatacatgatctttgtcaaagcttccaaaattcagggagtgctagaaaatctttaaaacattttctataatcttaccacttagatttggttactgctaacatttttgcgtattttctttccagtctttttctgtgtattttttctttgcataatgaaatatattgtatgcatatgtatacacacacacatctcttattaagcttttcttgtcattaaatatcttcatataaaaaatttttactcaacaatggaagtcttctaagcatgttatgttttcctgacaaggttgtattatttacctcagatgaaatgcagtagttaggcttaataactactagtgtggacagaactttttctgaaagtttcttgtttgaagtatgtttctttctctgtaagacttggatcctcttgcttgttgaataaagtttttcttggcaggatgtgtgttgtcatgaggtgtggaagaggaagaaagcacacagatctctgctataggagtgaatggacttttaaagggatgttgtcaaaagattactgtcatggctggtataccatcccccacagacggcgatgcagtgtcccttcccactccccacttcgctcctgaaaaatagtctctacactagggccatccatataggttaactattttttgaacatgacatcacgaagactcaggctggatataagcatagaatatttcatgaaatggtttgctactataacaaatgggtggtatttgcctttttggttttgttttgttttttgagacaggttctcactcggtcgctcaggccggagtgcagtggtgcgaacatggctcactgcaacctcaacctcctgggctcaagccat

SEQ ID NO: 25185 - DNA, 1070 bp, Homo sapiens
agtggagacggtgtttcactgtgttagccaggatggtctcaatctcctgacctcgtgatccacccacctcggcctcccaaagtgctgggattactggcgtgagccaccgcgcccggccgaaattatctcttaacaggagaactcagtttcaggtttatcagtcagttttaagaccccttacttgggttttaggaaacatcttctacctcatctttgtttaaaactaatgtgtgcctacagacataatctgttattttcagttgtatcccaccttgtgaggagtacatgaagatggcccttgctgtctagggtcatgtatgtaaatgcatttattgttaattttcaaatataggggtgcatgaatcagggtaaaatcgctcaaagattcagtagggagaaaaaactcgtgtttagattcttgccgctgggggaatgagatcagttagatcagcctgttctgattattcagcaatgagagcaggatgggataaatgatgatgataatgaagtgtgtgcctgtaggagaaatggcaactagttgcccacctggcctgggtcagtgtggttagtgggaggttgaaaagttatttatttcatgacataggcataatccccaataaatcttgagaattgtagatatttactgatttgaagtattaaatactgccaagagagacttctttacgttatcactgacaattaaaaaaaattttaaatatggaatttttttcaaccaggactaacaaatatttatgtgcaggttaccctgttgcaccctactttaagtagagggtgctctgtctttgctagattgagaaatggacatgcacaggaaagttgactagtcataggggagtcaaaatagtcacagattagtaggggtggccaagtgtcctgacttcccagacagcacacatttatgcctgttgtcctgatgtatttattcatcgtgccccccttcattctccaatttgccctagtttggatgataaattgtcatctgaccattcagcagttgcaagactagctgttttttgaccccctcctctcatttttttggtgttaaagat

SEQ ID NO: 25186 - DNA, 1105 bp, Homo sapiens
aatcgtgaactgaatatacatggaagagttgagtaaagtttgctgtgacaaccaagtttagtgatggagtgaacaatggatccattcactgggaaggggaacattgaaaaagaagcaggacttagatgaaatttggattgcctggaggacatctatagggagcagcagttggaaaggtaggccattggtcgggctagaaatggatttcagattgttgaaaccatagatgagatcacccagagggaatatagggtgaggtgacagccaagagtggaaccttgaaggacatcaacattggagtagagtcattgaattaaatgcagaaaggaaaataaataaataaatagatgcaggaaaggaaagggcattgggagagagaagaaaacaactagcggagagcagtgcatgaatgcgaaagggggaagctaaatgtccatgcggattcagcttgcagtgttgtaactgttcattttatatgaaagtaatatgttaacagccccccacataccaccactttgggattcaagtatacaccaataattaccatcagaaggaagcctgtccccatagcaggtacggattgccacaacccactttagaatcctgtcactgtctggctttgtcccagtcacattaatacttttggcttagcccaaggaatcctgctgaggtttattataaaccattttttggccagacgtggtggctcacacctgtaatcccagcactttgggaggctgaggtgggtagatcacgaggtcaggagttcaagaccagcctggccaacatggtgaaaccccgtctctacaacaaaaattagccaggcatggtggtacgtgcctctagtcccagctactggggaggctgaggcagaattgcttgaacccaggaggtggaggttatagcaagctgagatcgcaccactgcactccatcctgagtgacagagcaagactccatctcaaaaaaaaaaaaaaaagaaaagaaaaaaccattttttaatggacaagggaattgtatttgaaagccaaatgaattattttattaaaatatctatttctgttcattttcttcgtgaacttcagttatgtccaaaacatagttaa

SEQ ID NO: 25187 - DNA, 1005 bp, Homo sapiens
gccagataattcaagtctgaatagtgtgtctgtctgtcttccaataacaaaagcagttagttgaacttatagctgaaataatcacacaagggcttttctttaagataaccattctataaggagccaaaggtactttatatgtacatgccatttgttaactccaagtgttaaaaatattgtatgtatattcaaaggtcaagatttaataaaattaaatttttactgcttcaggaacattcctaagttggacctttttttttccttttttgagacggagtctcgctctgtcgccaggctggagtgcagtggcgcagtcttggctcactgcagcctctgcctcctgggttcaagagattgtcctgcctcagcctcccaagtagctgggactacaggcgtgcaccaccatactcagctaattttttttgtatttttagtagagaacagggtttcaccatgttggccaggatggtctcgatctcctgacctcgtgatccacccgccttggcctcccaatggactgactttttttaactgagtgcacggtgatgaagactgcaataactgctattaaagtttggcgtcactgcctttgttcatgcttggttcatgatggtgtcagcaccatcagtataaatagcaatacagagggaggaagcacatgtcttatgaaaacagccttgaccttacagacgctttgaaagggtcttgaggacctcaagggtccgcactttgaaaggtactatgatagttaaaaggctgtgtatgagagtggctgcaggtagggagaatgtcctaatttaggtaggttatgtagggaaagtcttgttgagaaggtgacattgaaaatgagtcttgaatgatagaaggcaagtttagtctctgatgcaatccatatcatctgcttgactaaatgagtgattttcaaccaggggcaattttgccctgaaggggacacttgtaatgtcaggagacattacaggttgtaacactaggggaatactacta

SEQ ID NO: 25188 - DNA, 1710 bp, Homo sapiens
actcctgccctgagcaatgaggcccatgactttatgatcttgtctcctaatactcttcaccacattggtctcctttcctcatgcactccagtcatactcctgcctgttggagacctttgcatttggctttttcctttgcctggaaggttctttccctagtgctctatttggcttacctcctatatttttcaagtctttgctcaagtgccatttttcacccaatcctctatttaaaatgcaaccctaccgtgtggcattcctcttcccccttatcttgctctagtttcctgtgcactatacgtaatgatatatgcttgctattttccccttgttagaccatcagcctttcaaagatagagctcaacaaatagttgtatttattgaaaatggaatcaaaaacagagttactaataacatgaaacacagtcatcttgttctcttctgaattcttaatcttatctgaattagttaaaacagatattgctaagacttataagagtttatatattgaatttgtgactgaggagagagtaccatagctaggtatgttctctggattctgtgatggtggccaactactgtattatatttcttttcagtgctactgcccacagtagtagtaagataaatgtcctttctcaagagatatttactggtggtcctggtattgtccatacaggtttatgttcatcatcttccctgtagttaagggtgatcaggggacatttttccctattagataaataatcataactgatggatgtgatgattgagtcactgtgagcttgttggcagggttttggtgatctaggacagttctcaagtctaagctgacattcattgtgattaagttatatgaagagaattaaagggtttaattagccaagtttgtgaaagacaaaaattggaggagaatagcacattctatgggtgactaaattaggcaccaaaaacgggtcaattaggtggaggtggtgggtcagtggttagagggaatggttaatattaattgacaaaacacagtacaaataaaagtatgactctgtatgtaaaaaaacagaccatgtgtcaaaaagaaaccagaatcattaaaaacacttgattaatttaaaaaggcagaaaagggatgaagggaattaaataacagatgtggtatagaaaacaaatagtaagatgatagactcagatgtactgtatcagtaatcacattgaatataaatggtctgaataaccatttaaaaaacagagattgtcagattggatgaaagaatccctactatatggtgcctattaaaaaatgtactttacagttagcaacttaaaataggttaaaagtaagaagaatggaaaaagataaactttgttaacactcataaaaagaaagctggaggggctgtactaatagcagacaaaatagacttcagagcaaagaatattaccaagggtaaagaaagtcattttatgataaagtaggggtgaaatgttccaacagatataataattctaaacatttatgcacttagtaacagagtttcaaattaaagcaaaataaaacctgatagaactgcaagaagtagtcaaatacacaattaatagttggagatttcagtaccccactatcaataattgatagaacaagcaagcagaaaatcagcaaggattttctaggtagaccagaatggtactgtcaaccaacttgacctgattgac

SEQ ID NO: 25189 - DNA, 1018 bp, Homo sapiens
tacaggtacctggctgattttcatatttttaatagagatggggtttcaccatgttggccaggctggtcttgaactcctgacctcaagtgatcgccaccttgaccacctcccaaagtgctgggattacaggtgtgagccaccacccctggccctcaattatttttaaagcctgccgtggttcttccattttatgggtacgtaatgattaaactagttcagtgggataacttttacttctaattctttgctgttgtaagtaacactgcatgtacttacctttgtgtacttgtctgtttccatagggtaaattcctgaaagtataattcacaggaagttgcagaaatgagtcagaggccttgcaccttttaaaactcttcaataacattttgccaaattgccctccagtaaagttgtaccaatttattttcctaccagtggcgtatctaaaagcctttgcctctgataagaaggaagaatattttatccttttaagattgttactattactatgaaatagaatcttttgtaaggtttttaatgtctgacttagccatttgtatacttcagcatgttactatgtttgtctttaagtgtgctttctatattgaggttagaattgctactaactactaaaaattggggacagtgaagagggcagcccagtcttgtatctcaccaagtaaagtcctgtcccttcatgtggaagtagccttcttgtcaccttgtttcctaacgtaaggccggtttggatctactgagtgcttgagtccagaggaggagtgttggtaagggctgtgagtacttcaaggacattgcatagaagcactaatgggtatgtgagctgtcttctcgagtcttctgaaattgtacttttgtatcactactttttatcagcaattgcctctagtgacagtaaaatagtgcactgataggtaccgtgggaatattggatttaagtcaagagagttaatacgaaacctcctgaggttttggtgatctctgaaaaggccatttgtac

SEQ ID NO: 25190 - DNA, 1044 bp, Homo sapiens
atatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgc

SEQ ID NO: 25191 - DNA, 1061 bp, Homo sapiens
gggcagcccttcaagccctccagccccttcctcttaagtagataatgaagaaagtggctgtattgtgtgtctcctggagtattggcgttggttggggggcggagggtcccagcaaggagacctgtcacctgtgatgctgccaatgtcacattcacctgccagcctggcctgcctgggcgagcgcgcctgccctaaccctcctcccttagggtgcaatccatttttttgttgaggctgtgattgttctgatttttgtttcaacccctttgctgaccaggcctccaatagaaagaagggaattcacacacattttctataccctaatgagtgcatgcattttttttttttttagatgaagtctctctttgttgcccaggctggagtgcaatgatgcgatctctgctcactgcaacctctgcctcccagtctcaagcaattcttctgcctcagcctcccaagtagctaggactacaggcgtctgccaccacacccagctaatttttgtttttttggtagagacggggtttcgccatattgaccaggctagtctcgaactcctgacctcaagtgatccacccactttggcctcccaaagtgctgggattacaggcatgaactaccacgccctgtccctcctaagctttttgtagacacattgctgttgcctgagcctgaagagccttttctcctccctcctcctcacctggccaatcccatttgtgcattcagaactggacttcctcctccgggaagcctcccttgaccttccctgctcccacttgcaagttcactggcgaaatcccagaaccctttatccctttgctctctgagctcttaccacatgatttcgttcccttgtgaacatgattttgttcccttgtgggtttaaacaccatctgcagtcccatttcctgataccctgcctggcatgcagacagagtgaatgaatcctcccttccttttaaataaacactaatacttttgagattttaacactttgcaagggaattgttctctatgttaagcgctttcctacttttataaaaacatactgaacaaaa

SEQ ID NO: 25192 - DNA, 1075 bp, Homo sapiens
caggactgtttttcaaaggatctgctacagttgctggaaaagtttttggaaatctttggaactgccttttaaacttgtggcacatttcaagtcatttccccattaccctacagagacaatttagacatagttcttactctcaggttgctaatagtttcattaatgcaaagaagtccgatatactactatgtgataattgctataataggccttttaaaatatcttcagtaatggcaaatgtttgttttttgaaagtgaagcagcagctatttgtagccagttcttttgaataagcagcttaatcgggtagagtaataaaattttgatcaaaatggagtaacaagatagaaactttaaaaataaattaaataagagacagggtcccattgtggtgctcaggctggcgttgaactcctgggctcatgtgatcctcctgcctcagcctgccgagtagctgggactgtgggtgagcactaccacacctggcagatagaaatgttttgaataatgtcaactggattggaattaatgtgtagttctccggtgtaaatattatgggagaacagtattcaaatgcataagttctagcatttcaaaatttgcttattgctttatagtcatcccataagtatatatgattataaatataggcattgccctttctgatagtttagcccaatttacaagataatcagttattttatttcctcaacagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcggtaggtagatgatgttattttagaaattattgttgatagggaatcagcaaagcaagttattcaaactgaaactttcataggcagtgaaaagaaaatctagtttagaaatagcaggtgatcttttgccaaatattttattttcatatttatgtat

SEQ ID NO: 25193 - DNA, 1050 bp, Homo sapiens
aattagaataaaaacttgtatgttaagtacagtgtaccaaatcaatggaatctatgttttttccttagatcgttagacacggtggcagtctgggccttggtttggcagccatgggaactgcacgtcaagatgtttatgatttgctaaaaacaaacctttatcaggatgatgcagtaacaggtaagcatttctttctaaagctaacaagcttaagtattaattaatgtaaatgtaattacattagtttctacctatattttgtagcctcttaaaattccgatggatttctctagttgaagaggaagtgaattttgctccatttgtcaaagttatcttttaaaacaagttttgtgatatataggctttctaaaatggtatatcctgtgtgtccactttcataactgacttttgcaaacaggaatttattagggtgatctgcttactccatactgcttggcgataatatagaaaaaatgttatctaaatgtctcctttgaaatcactgtaggatttgatggtacattctgtcaaagtttaaaaggaaaacaaccctaaatatgaatgtgcgaaccctaaatgtatgaatgtgcttccacataaagtatcctttttaccaggtggtttaaaaaaatgctatcagaagctaatgatttttttgatagtttatgcaaaaagagtgctactttcagttggatgttttactgactttaaaaacataactctctgttaacattttactcgttacttgccaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggtgagatcacatacgtccctcactgtccatttatctccagcatgtaaaaaacacttaacttcactggaaattaactctgttcccatcagaacatgtaggta

SEQ ID NO: 25194 - DNA, 1031 bp, Homo sapiens
cctgattgtttcttaagttacacttttcatagaagtgtccagtgttcttcgaggcctcttctgagatctggcaaaacctatgtgtattaagctattctgcattttgtcaaaagatctgccacagactccacactttgaacttcttgaaccctatctcttcttttctcttttaaaatattggaatacttcatcatttacattctttttgtactttgcagttttctgtttttcttccaaaatttggtttcataattacatacacaaatttgttctatttctaggaggtgattcatttagctttgtgactggaactcatctaaggcaactagactctttatctgttttgtgtttgatcagtctttctgtctaaaaattattctccttgagagaaaagatggaagcaaaataaaatttaattacttctatttccttcctgttatcttagcatatcatgtagccaagctgtgaccctaacctttccctattcttgctgtagagattagacacaattaaaaaatgagaaaatggtctgtcatggccatccagagtgggttctttgtgtgaattatcagagaactagataattttagtatggaaagtatattcttccaggtatacccttagtatctcttgggttgtgtaaagcatcctactcatgtttgactcttaagttgttttgtttcctgtcagttaatgttttgtattgtcagtgactttatattttataacaatataaatcagtggcttggtgtttatattctgccacataggaagttgacggtcatttaaaactgtttttcttccatttttaatctgatggtgctttgctctctagttaacaaaattcatgtctgcccttttatttcctgtagctaacacaggttaagttcccagtttcagcagcagatgtctcccgtgagctgcttaggttttgctgagttttccactacatagtatagtcaaataagttatttatgtgcttgctacttctaagggaccattcttggttctcttttcataaaacgaatctt

SEQ ID NO: 25195 - DNA, 1107 bp, Homo sapiens
ctcatagtgaaccagttaccactaacactaacactaacttcatgatcatctttacatctccattcacaattctatatcaatttgatacatattctctgtatactgttctctgtttttgccccagtatctttgtgtttctgtctgggtgcttgacttttccttactttttgtcattttcattttttttttctacatctttgttttcttctctccattaattggcagtaacatggaataaaaaggtttttttttttttttcaaaattattctaaatagttataatctgttccttttcttctaagataagactattaactggagttcttttgttacgtaagggtgtttaactgctgagatttgctttcaaattatacatctctttaaagtattcataaaatggaaataccagttctgcatcgaagtggtaagagtttgtggcttggttgtacttttcagaaatagtcaatagtggagttatgtttcactttctagaatattctggaaatagtagaaaggtctctcattaactatagaaagatctctgggttaattgtaagcaagagctagacatggtgactcacacctgtaatcccagcactttgggaggccaaggcaggcagatagcttggggccaggagtggagaccaggctgaccaacacagcgaaaccccatctgtactgaaaatacaaaagttagccaggtgtgggggcgggcacctgtaatgccagctactcaggaggctgaggcatgagaatcacttgaagtcaggaggcggaggttgcagtgagccaagattgcgccactgcactccagcctgggtaacagagtgagaatctgtctcaaaaaaagaaaaaaaaaattgtaagcaaggaaatttttcttaagggtttgacatgaaacagtttataggtgttgtggctaattctgtaggtgtgcgtatatttaagcacacaaatttggaggcagtacaaagcatgtgagaagatagttcttttgatctagattgttatctatgggtagagttttggcaatgtgattgcctgccaactctggtgtatagatttcctgaaacaattatgtatgccttcagatgcataaaatacaga

SEQ ID NO: 25196 - DNA, 2638 bp, Homo sapiens
attgtatccttataactttatgcttgttggtgcattataattcctgggacccacaatgcaggatttgtcgaagcattcatcagtgaagatttgacaaacagaacctaagtgagcaaatctgtttttaaacggagattggttagtaatttcagatttataatgaaagctcccctaaagctatagtatatccatgatacagtggagaatgtcttcatttattctacatttctcataatctatttttgttttttaagctatctcagattaaggaagagaaattcagaagagaacctgcttttttcttattatccagtgtagttgatctagaggcacttcagagtacatttattcaatatctttactcagttttgtctttgaggttacagtttcatttaacagtttttccttttgatatgtgtgaatgtcttttaatcctttccatctaacttcttagggaaaactaaagttcattaaaaagtgctacttaaaatttgagtgtgtgtgaatcatgatgttgaaagattatgagttcttaatctttcttcttctgtagaagcctgggcacagtggcgctcatgcctgtaattccagcactttgggaggccaagtgggggtggattacttgaggtcaggagtttgagacaagcctggccaacatggcgaaaccccatctctactaaaaatatgaaaattagccaggcatggtggcacgcgcctgtactcccagctactcaggaggctaaggtgggagaatcacttgaacccaggaggccgaggttgcagtgagccgagatcacaccactgccctccacgctcagcgacaaagtaagactctgtctcaaaaaaaaagttcttttatgacctgggaaagaaatatacctcatgttagttttctgatctttaaataccatgaagtatttaaatatgatgtttcttagtgaagtagcttattagaaagacaaataatacaggggttaacctgaatctttttcctttgaaacagcagatattttttaaatgtctgaattaattgatctttagaaacctctggaatccttgtgttgttttgtgaatccaagagcacccctcatctacacaccctttttatggtagctaaagagccattgacaagaatatgttcctcaaaccctttctaacagaggtcattactttctctacttttcctcatgtacaccaccagaaagaggattctgtatacttgttctacaccaggggtcattatactacagtttgaggaccattggcccacattctatttttgtaaaagttttattggcatactgccactcccatttgttagtaacatattgtctgtggctgcttttgttctactgcagcagaatggaggagctgtgacagaaaccatatacgccctgcaagcccaaaatatttgctgtcttaccctttatagaaaaagtttgctgacccctgctttaccctgttactttcagatcaccattccactgtttatttctcccccaaaacacttgccttttgaagtttattttatctacttaatactttcttctccatcttgcttttctgttaacctccatgacatttgttcatcttcatcaatggcttcagtacctgctatagtcttctctccactgttccagtgccagcattttctacttcatcccattcgtgacccttctaagaccttaattttatatttcttgaactctttgactctaattattattatttgcactaaagccatctacaagtctacttagaacaatccctaagattatgaactctaatacttcccttccttgtcctgctacccctcactcctagagaacttctgtttcctgttatttttatctctagttcattcattcatctcagttttcacattctattaactcattctattaatgagacttcattcatctcagtttttacattctgttaatatcaggactcacactactttcctatccagcttgttggtcaataactgtaaaagttttcactggtactttttatgcccttaccctgttatattattatactttctgttgccaggtattacctagaataactgtaaatccaaaagaagagagtgagctctcttcagcattttgtagaatttcagaactgagcttattgtcatctgcattttcattttttcaaagttattaatttgtgatcggttctacaagacaaagtgcaatgaagtgaaagagcgttgattttggccttggtgctgaaaagctgtaagagttcttaagccaactgattaaaacctctaggtttcttttttcttacctacaaaaggaagaagtggatttctaaatctatatatcatgagtcttccttttaatcttttttctcctgcatcactcatcactttgtgttagtgtaatttgtttatatgtccgcctttcttgaatgcaaagattctttttcttgatcatctgtgtattcttagtacctagcacattataaacactcaataaaaatgtggtcaatttataaattgatggtatccagccttaatctagatgccatttataccagcaggctgcttaccttattagcttgatcacatttcacagtttcaaatattttaattattcttaaggatccatttcttcaactttttttc

SEQ ID NO: 25197 - DNA, 1034 bp, Homo sapiens
ataattttcaaatatacatttatctcagaaattctaatgcttctgtctttatcttccagaaaagaaagacatagttcagttcaaattattgtttaaaagtttctgttttgttttttacttttttcactacatttgagcatatgagttatcctggggttcagtgtctaatatgatagtgttttaaatgttttaagcattttaatgcttacagaattttttcctggtttttaaaatttccactttacaaaaagaagtgcctttaattcattgcttttctcctccatttcagaattgggtaggctaacattttactgcataaatgaataactgccatttttctcttactgctatacatttgtttcatctctgattagacttgcatctcaactaaatcatatttaatttgcatgcagtactctaccagttactattagtgcttataagatgctgggccctgcttgacaaggtgattgagctctgaaataataagtgattgaactctgaaataataagtgacttgcctgatccaacacgggagaaccaggattcagaccctgggatgtcttgcttcaaacagccatctttcagccattttatatactctttcagctataccacggatactgtttgaacttatagatcatgaggcatcaattgaaacttaagttatagccaggtttggtggctcatgtctgtaatcccaacactttgggaggccgaggcaggtggatcacctgaggtcaggagttcaagaccagcctggccaaagtggcaaaaccccatctctactaaaaatacaaaacttagccaggtgtggtggcctgcgcctgtagtcccagctactcgggaggctgaggcaggagaatcgtttgaacctgtgggtggaggttgcagtgaactgagatcatgccactgccctgcagtctgggcaacagaacgagactccgtctcaaaaaaaaaaaaaaaaaaaaaacttataaataaaccaataacacccaatggatggccagatgccatatcttcccgtgttactt

SEQ ID NO: 25198 - DNA, 1024 bp, Homo sapiens
acaggtgacatgataattgccacctcctttctccagaattctttgaactagtgcatgctgaatcatgatgctgtcattgtcccaggtggactcacacagctctgtggtcaaacggcactgagccggtgctccttcctccatctccagccttctctgtcgctgcagctgcagctggcaggcgtggacagtcaccttatggtataatggggtctgtggtggcttccttcagctccatatcagcctggtgtgcttctagcaatggggcaagtggcagctctatctcctaggcccaggattgactgggtcagtgtgtgtgggctcccagccactccaggatgtggagccatgctgtcagcaaccttccatgcctgtgaggtttgttcctgggaggcctggctagacttggtctggatagcttttgtcagttgcacgctgtgggtcagcaggtccaaagggtgacttcagtatatttacgtgtccaagagttctctggccccaagtctttgttctgtgcctgattctttccatttcaaagaccttaaatgttttgtgtgttctttatagtgcccagattagatattgcaaaggtgtgggaaaccagggttggtgtgcaggaatcgcaggctcaggagcttgaatcctgtgggatctctatttttctatcctttaccactgaaaaggagtatatgggagatctgtggtgttgagtgggttgtgagaattttgggtgttgaaatttacaacgaggtatgtagtctgatgtcttctccacagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggtgggtttacctggtgatgcgggtgggtctgagtggtgtgttaaggaacagtgtttgctgtcattgtccacatgggcat

SEQ ID NO: 25199 - DNA, 1051 bp, Homo sapiens
agatttgatgtagcctggttcatggacgatgatgtctgaacaaggacagtagcagtggatatggaaaaagaggggttcctatcgaagaggcttgaagacagtattggagactgaacaacaacaacaacaaaatcaacgatgactccagagtttctagcctgagtgattaggaagttaaaggtaactttaattaagcaatgaaatgcgcaggagtaagctttgggagggagtgacgaatttggttttagactcagtggtagctgtcacctgggcatgcagatggagatgtctgtcacttggaaacatacatcctggagcacaggagagctgcgaggacgggaacacccactctccccatttgccagattgttctgaggtgtggtgtttgatatagagttgtgcagtatttgaaaacttgcaaataactggtttttttcctccccttaaagatacagccgtatgtgaatggagctctgtacagcatcctttctgttccatccattcgtgaggaagcaagagcaatggtaagaaagcgtgcctgagaaacatgtgagcttcctttagtgccacagttcagagcttttagagcaagacctccttgattgggctccatagaaaggctcagatccgttccaaactccttgaaattgtatgtaaaatgtatatttgccatttcctggggagagagtctgtagcttttatcagatcctcaaggggatccctaactcctaaatggttaaaaattaaagtgttagaaagttcccagcaggctgacttttgcaaagttatagacattctgatggcaaccaaatggaaaagattataaaactgtctaggacttggtttggttggtaaatagtaaactcagtgtttaatgtgtacgttaacgcttgtatgtgaagtaaaaagcaaacctcaggtgattagtatattattttgaaaggacaagtgtttctagatctaatcaggaaaacaactagagttttgtcttttttctttctaccatgtgaaaccagattaacagtgtattaaatgctgtggtgaaaggatt

SEQ ID NO: 25200 - DNA, 1016 bp, Homo sapiens
tatgataaaatgttaaatattaaaatattaaataacttaaaatggcaatagtaaatccattacattaatataaataagatattcttatgaaaaagaattatttttcaaaacaaaattttatgaaaaagtgtagcattgtgggtttgtttttttttttttttttttttttttgccaatctctttaatgtctggatcagaaaaacacagtttgatctgggctgtatctgttgtcatatgttgttttgattgaaggacataaagaaaatctagcctcacacacctgtgtacttggaaaggggtgaagtattttcaaagccttttcagatagatatttttgctcaatattactttaaaaccagacaggtaatagtttattaaaagttagttgcaatgtggaattagaaaccaattttaaatatcatttttattggctgggtgcagtggctcacgcctgtaatctcagcactttcggagccccaggtgggtggatcacctgaggtcaggagttttgagaccagcctggccaacatggtgaaaccctgtctctaccaaaaatacaaaaattagctgggcatcgtggtgtgcgcctgtaatctcagctactctggaggctgaggtgggagaatcgcctgaacccgggatgcggagattgcagtgagccaagatcacaccactgcactccagcctgggtgacggagcgagactccgtctcaaaaaaataaataaataagtaaatagtcatttttatcttgttaattaaaatctattgatctattttgcattttgttaatttgattttctgattgttccctaacaatcagatgtgctaatgtatagaaatacaattgattttagaatattgaacttgtatcctacaaccttactgaatttattagctcaaagagttttttgtttgttgtgggttttgggtttgtttgggttgttttgttttgttttgttttgttttgaattccttaggattttctgtataacaagattgtgtcatctgtgaatag

SEQ ID NO: 25201 - DNA, 1077 bp, Homo sapiens
cctgggttcaagcgattctcctgcctcagcttcctgagtggctgggattacaggcgcctgccaccatgcctggctgatttttatatttttagtcgaggcagggtttcaccatgctggccagactggtctcgaacacccgacctgaggcaatcctcctgccttggcctcccaaagtgctaggattacaggtgtgagccactgcacccggcctggaacttcttggatctataagttacagtgttttttttgtgtgtgtttgttttggggtttttttttttttaaaccaaatttgagtagtgtataaccattatttactcaagtgttattttctgcccctttcctctcctcctgaaaatccagttgcacacatgttagaatgctgatattgtctaacagatttctgaggatttcttcatttttatccaatgtttgttctcttctttgagctggatactttctgttgatcgtccttccagttaactgattcttttacccttttgtatctgctgttgagctcatctattgaattcttcatttcagttattgtacttttcagctctagaattcccatttggttcctttttatagtgtctatttttctgttgagatttcccgtttttcactgattttcagtattttttttaaaacttctgagcacattttcctttaattctttgagcatatttataatagctgctttgaagtgtttttctactaaatctaacatctgggcccactcaaagttagtttctcttgtctatttttcccccaaggacaggtcacgctttgtttctgctgtatctagtaatgcatttggttgacaaccagacgttatagataacgtgttgtcgtgattctagattacgttttgctctcctgagggctgttgctttcatttgtttggtaagcagttaacttgcctgctcttaaactgagaaatgtgtctcccctgtagaaggcagccatgagtgtgtctatcattttctccaatcccagggtctcccctccataatttaactgttgattgggatggaaattgtgctcagatgcctgaagccagtaaggtttccaccttct

SEQ ID NO: 25202 - DNA, 1043 bp, Homo sapiens
ggaagaggcagaaaatggaagagacgcccctgctaacgggaatgctgtgagtgtctgctttgctcctgagccctggcagctaccgccccacaaaatttttcctgttctactttaaacatacctatatatgtgtgtgtatgtgtatatgtatagctttgcacagtggcagtatcgtagccaatgagctttacccgaggcgcgattattgctagttaaatatttataaaaacctttcgagcagcgcctgaacaagaataggttcagaggagactccggtagtctgagtttgggcttggcccagggtggggaaaagcccttgtcctggggcagttaatgtgcaggtttcatgatggagcctggagggtgttgactggagaagggtctctggggtgggcttggcttggctgggctgtagatgcagccgccagcctctggtgggaggccgggcatcaggagcaacgctctgtccagcctggggccagctggtaatgacatggcctgttttctgtcgaggagaatgaggaaaatggggagcaggaggctgacaatgaggtagacgaagaagaggaagaaggtggggaggaagaggaggaggaagaagaaggtgatggtgagtagccttgtctatcttccccttttcaggtactttttcctggccttgtctggcagaaggggaaggaaggaattggggctcctgggagtgggacaatggtacttggggccagtggaccacatggccctgggcacccacctgtagagtcagggaaggtctccctgacatggagttgtgcccatgcccactcacactcactcgcacacctgaaagtttctttcgtgcagctctgaaagccactgatctattgggctggccttttggggtgcagctgcttgggcctctctcctctggagagtcccacctgtgtagtgggcgtgggtgccctgattgggcccagttgcaggcagtagaggcagggcagggaccttgcagtccactacatgttcctcgggatttccccaggagccacagtaggagggaagtgtgg

SEQ ID NO: 25203 - DNA, 1292 bp, Homo sapiens
ggtcctgaatcttaagaacaggaaggaaacagggctgggctcaacttcccagaggccttgggctgtggagctgggggtccctggttcttgctctgccagcaggagctgaggcagtgggctggatagggctcctggggttggaggggcctttgacagtctttctctgcttaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacaaagctgtctcaagcctggtttttctgtttcagtttcttcagaccttccagggcacaaggataggagggggaggatcctggggacagtgggttgacattttgggaggcagttggatgtgtcctgtgatgggcagcagagtctggtgggtgggcagggactgagctgcagttggctgggggggctgctcactggggcagtcagtgattgccccaagaagccttaactggggaggaggacttcatcactgggtgccacatggggaccctggtgccctgggggtgggggtttgcagtcctagacactggaaacgggccacacgggactgccattatgtggagcgcagggtgctggtggtataggccaagagggaacttgccaagcctcc

SEQ ID NO: 25204 - DNA, 1057 bp, Homo sapiens
aaaaattagctcggcgtggtggtgggcgcctgtaatcccagccactccggaggctgaggcagcagaattgcttgaacctgggagatagagactgtagtaagctgagattgcaccgctgtactccagcctgggcaacagagcgagactctgtcaaacaaacaaataaataaataaatgtcactcatatgttgctcagacatttggatgctggacttttttgtgccccttatgtttgtgttttgtattacataggtacaactatgtatacagttttatgtcttgcttgtttcttcccacttacaaacatttatccatattttaagtctttttaatatttttaatatttcataatctacttagctcattttctgttgcagggcatttgggtcattttaaattataatctgaagtattaggttgaggtatttgtatgtccaaacactaacttaccttctacccaaagcatttttttctggctttcctacccttttttaatggtatgactgtagcctgatactcagggccttcgctgcgatatccctgacttcttctttctccctggtcacttctactttgtgctgctgtcagactggacagtttgccagttcctggtacaccacatttttttctgaccttccctttgttccagggaatgtgttctgtttttctgtccttgcttactaaagaggcagcattgcacagactctgttagcagactgcctgtagccagtctggctccacttctactagttgtgtgttcgttgacaaatgaagtaaccttatgcagctcaatttcctcgtctgtaaagtgggagtaacaatacaagcccattattccttacctacactcctcgaagttagatgtttcagaatttagaatttttgggactttaaaaaggtaatatgatgcgcatgcctttttatgtaacactcccagaggaatgtggaaacaagtgggataaaaagcctgtctccgtacaggttagaaattcccaccaggtgaatttcagcaccatgcttaagaaaaaatcagtttggatatagttttttggaatcc

SEQ ID NO: 25205 - DNA, 1049 bp, Homo sapiens
gctggaagtggatttctgcattggccgtgacatccgaaagaaggatatcaataatattgtcaagaccctgcatgaatggtgaggctaaaaggaggagggggatatctagcatgtcttttgtgcctctccttgcaaaaatgtgattccctggtgtcagctgagggtttggggtgggcctgtagctacctgggagctggggcttagtgagccggagagtggagctacatttgtgatcacagctgtgtgataacaggagtcatttcaggcctcctggtgccttggttgtaaaatagttctttccttaaatgcaactgggagctatttaaaagtgggctataaaatgcccagggttagcaggtggagcctatgtgtcctagctgtgtgaggctagtcctgccctttccaaactcacgctcaaagtttgaccaaactcaggaaggctagtgtttgtaagattctttctttgtttttattattttttctatccctgttgaagttaacatgtttataagattcttcggataaaagaacttacgttcaaaatcagtaacatattgggctaatgtttgtaaaacaccgtgagggacatggaagacaaggagtgggtcattttaacttggaatacagactcatacaaagaatatctgataactatactctggtatataaaaagcattgggacatttgtgttttctctgttttaatggaatttgatatttgtaagagctgtctcacattctacgaggattcactgtggagtgatttaaattatttggggcttataaagccagatggactgattggagaagttttagctcagttttgaaggaaggccagggttagagtatacctggaggtgaggagagtgtgttcccaggcaggcacgtggcatgttggaagccatgaagcagacccggtgagctttgtacacaggttcgggagggagagagaatctctgctcatccccgagagaagcatatccagagaggagcagtgccactttgactccttggggcctgatgtcccctgagtttccctcacttcagcta

SEQ ID NO: 25206 - DNA, 1047 bp, Homo sapiens
aataaagctggataaggccaggcgcagtggctcacacctgtaatcccagcactttgggaggctgaggcgggcagatcacaaggtcaccagatcaagactatcctggctaacatggtgaaaccccgtctctactaaaaatataaaaaattagctgggcgtggtggctggcgggcacctgtagtcccagctacttgggaggctgaggcaggagaatggtgtgaaccggggaggcggagcttgcagtgagccgagattgcgccactgcactccagcctgggcgacagagcaagactctatctcaaaaaaaaaaaaaaaaaaaaaaaaaagtaaagaaaagaaagtaaagctggataaggggctagagaaatgatagcaaggtggggctatttcagttactgtgatcagggaagtgtctctgacaggcagatatttgagcagagacttcaacaaaacaagagggcaggccctatgaatagccaggcagagagctttccagatagaaggatagcaagtgaaaaagccctaagatggaaggttgtagtattctaggaacagcaagaaagtctctggagttggagggtcatttgcaaaagaagaaactgtagaacatgaggatagaaaaatgtcttgataaggccttgtagcacggcaatggaaggaggttggaaagctgttgggagaatgacatgatctgatttgtgttttaaaagaaacgctctaactttattggtccaaaatggaaataaagagaccaattattgcattaattcagcgtggcaataaaggttgtttgggtttatgtagtaacagtggaaatggcaagaagatccatttaaaggaaaggccactgggctcttctgatggattgaatgtggggaatgagagggagagggtcaagggtagtgctgcggtttagggctggaggaactagatggaaggtgatgttatctgctgagagagtgtgctgggtgaggagcaggttctagtggggatcaagggttctcttgtttgagatgtcatctgggcaattgaatataagtctgaaga

SEQ ID NO: 25207 - DNA, 1096 bp, Homo sapiens
cgagagactttaacaccccactgacaatattagattattgagacagaaaattaacaaagatattcaggacctgaactcagctctggatcaagtggacctgatagatagatatctgcagaactctccaccccaaaacaacagaatatacattattcttattgccacatggcacttattctaaaattgatcacgtaatcggaagtaaaacactcctcagcaaatgcaaaagaactgaaatcataacaaatggtctgtcggaccacagtgcagtccaatagaactcaagattaagaaattcacttaaaattatgcaaccacatggaaattaaacaacctgctcctgaatgacttttgggtaaataatgaaattaaggcagaaatcaggaagttctttgaaactaatgagaacaaagatacaatgatccagtatctctgggatgcaactaacgcagtgttaagagggaaatttatagcaataaacgcccacatcaaaaagctagaaagatctcaggttaacaacctatcatcacgactaaaagaactacagaacgaagagcagacaaaccccaaagctagcagaagagaagaaataaccaagatcagagctgaactgaaggagacagaggcatgaaaaacccttcaaaaaattaagaagtccaggagctggttttttgaaaaaaattaataaaatagatagaccaccagctagactaatagaaggagagaagattcaaataaatacaatcagaaatgataaggggtaggctgggcgcagtggctcacgcctgtaatcccagccctttgggagcctgaggtgggtagatcacttgatgcaggagtttgagaccagcctggccaacatggtgaaaccccgtctctactaaaaatacaaaaattagctgggcatggtggtgcatgcctgtaatcccagctattcaggaggctgaatcaggagaatcacttaaatccaggaggtgtaggatacagtgagccgaggtctcgccactgcactccagcctgggcaggcgacagagcgagactccatctcaaaaagaaatgataaggggaatattatcaccacagaaatacaaataac

SEQ ID NO: 25208 - DNA, 1070 bp, Homo sapiens
ttttttttttttggagacagtctcactctgtcaccaggttggagtgcactggcatgatctcggctcaccgcaacctctgactctctggttcaagggattctcctgcttcagtctcctgagtagctgggattataggcacgcatcaccacgcccagctaatttttgtatttttgatagagacggggtttcaccatgttggccaggatggtctcgatctcctgaccttgtgatccgcctgcctcagcctcccaaagtgctaggattacaggcgtgagccactgcacctggtccaaaatattttctaattctttttttatttcttctttaacctatgggttgttggatttccacatatttggggattttccagattgctttctgttaatttttctctcatatttttgctgtctggctttttgatgtgttttatgggagagaccacccatttgtggagaaagtactcttctgagtccacatcatatgggaggagcccacaggtcagtctgcaggctgccgagatcataggctggtgggcgggtgcacaagtagactgggctggtctctcttgactagtgtgagaaatggggccagccctgctgccatcactgctgcattccagtggcaaggctgaagattggaatttgttaaaagtctgcttatgaggcaaccacctcccctattcctctttaccactgtgcacataagaactccagcagccaagcatctacccttatttaggaaacagaacctttttcatagaaatcgaatagcctgagagaatgtcctgatgccatagctaaatttcttgcagaaagtgctgagggcggactcttggagcaccctggtagataagtagacttgtacaacagaggagatggccatttttggtctccgcaataccctctacaaaggcagccaaggcccataacacatttcctgttggctgcctgtattcaacgcacaaatttagacttgtgatctgtatgtggcatgacaatgcttatgagaatagagagctgtcaatttggtaaggagtgagatctgccttctgaaaggtggaaccctgttca

SEQ ID NO: 25209 - DNA, 1025 bp, Homo sapiens
caagggagggtggcaggtgccagaagaatcccattatgaaagtgtcttgggaatattgattgatttttaggaagctacacctactgcctgctggggttctctctctagcctcttcctcatcagtcaggtggcagtacccagaagccactctgtttgagggcttccatgtaaaataagcatgaggtttgcaggaagctgtgcaccatcatgggtcccctgacaggtggttaggtgatgtgagcagttccttctgggtcactgactttgggaattcagaggaagttgaagtagtggtggagaaaacctgatgttaccatcttcccaggcaaattactctcaactccaggagcttcacaactgcatcttgtataaatcctacttggtgcaattttgaaacccaaactgcaggcagtttctttgagtggacttgattgtaaagatagccttgttaatggaaattatttttaaataccctgggacccaagctgcagtggaatgctgttatgtatgaccttgacctgttccagcctttaaggcagggattgacggatattttctgtaaaggaccagatagtaaatggtttaggctttgtgggctgtgcagtctctgtctctgctactcaactctgctgttgtagtgtgaaaacaccagcgttgctttaaatggataaatgtggctgtgtttcaacaaaactttaagaacactgagatttgaattttatatagttttcacacatcacaaaatattgttcttcctttgattatttttcagccatttaaaaatgcataaaccagtcttagctcatgggtcatacaaaagcaggtttggcctgtggtccatactttgctgacctctgcttaaacagccagctagcaattcagccctgctatccagtgagcttttagcagctcatcatcacttcacagggaagccaggctgggtaatggagaacagtcgtgctaagttaactctcaggatggcttcatgcaattaggtaaattattcctttgattagtaccatgct

SEQ ID NO: 25210 - DNA, 1051 bp, Homo sapiens
taggaagtctttgtccttttttacatagtcttcatggtacactgtataatcaagtgtgcatcctgctttatctcatctgtccaacctatttttcctgggttagtaaaaattctccctaagccatgtaacaactacctgctattccatgtgtgactatagcatagtttgtttaaccttttgccactgctggactttttagtctttccaataaataacactggggggaacagttttgcaaataaaacttttcttcctacatttctgatgatttttctaagctataaattcataacttaaatcactgagtcaaatcatatgaaaatttctaagcaatgcagactcaaaatggacagaatgaatatagacctgacctcagctgcaaagagagaggtaaagagaaaagggttgtaactaatagatgcttttaaaattatgttttacttcacaaaggagagggctgggaagattcaagtggtgctctgtagggcaaacatgcctttgacttgaagttctggcttcatgatggtcgagaagggcttgtttctgcttttgtgttttcatctgggtcagttagaggacaaaccattcctgtgagttcctttcccactaaggaagagaaaaatcgtccagtatctaatgatgcagatcattagctgtgttcgcagccttgtagttaaaaaaaaaattataataatgtatcctcctaatgtgcagttaattttagttaaaatctccctagtgctttaaaaacccagtgaatttataaacatagtagttggcttgcatttggaatgttaaagctgtcataaccaactggctctagcagggcatgctgcacctccttgagctctgttggaagttcagcactcacctgagcactgccctctggaatccagaaagaaaccaagactttcccagagttcctgttcctgatcttccataactgaagaaagctaatgagtgtctcaaagttaacatgtccaaagtcaaacctttgactccctatcagtccccaaattcagtctttctctcagcagtggatcagccacct

SEQ ID NO: 25211 - DNA, 1042 bp, Homo sapiens
tcctcaaggagacaccgtgggggagggagggagaggtagacaccaccaacctcattccatgaccagggcctggcgatgctcagaagccagtgagtgtgtccctgccctgaagggtcagtgctggccccctggacctagggggaagatggtgcaggcagtggcccagcctgaggaaggagctgaagctctcaagagtttgcagccaccctcctggggagagactgacgcctccccagttcctgttaggaaggacctcaggaaagaactggaattacacagcctggggtggcagcctcctggtccctgaggaggatgtcaggccgcagaagggaggaacgggcatgaagcttgggaagcgggcgccagaggaggcgaggcctctgcagaagcagcaccagaggccactgcagcggctccaccacccagcagcgccgccaggaggcaggaagtgggaggccaggcaggaggggctgtgattgcccaggtgccaggaggaagggctgagaggggacagtgcagatgtccagagaggcctgacagggacaggctgcgaaagtcacgggtggggatgggcttccgccagagttgtgtgtggcctgaggacagtgcagcaaggaggccccatggtgagcacatgcagccgaagtgacaggttgggctcctttgtgggacaagagcctctccaggccactgcagggtgttcagagaacaaggcctacaaggatctgctgtgcctgcagctgggcagtagaacactgagcatgcagggccggggtgggaagcaggaaagccacatggacgagagagccgggcctgcccagcagtgccttttgggagcgcaggcaggatgggatgtgcagctgtgacctgcccggcatagaactccgtctggctggggagaggaggtctcttctagccagaatggaccaggaggtcccgggaggacctgggaggaagtggattgagttgggccttagaaggagagccaggaacaggccaggtcaggggagctggagcctggctaggtatggagagagcaggg

SEQ ID NO: 25212 - DNA, 1025 bp, Homo sapiens
aactgaagttgaaaaaaatgtattcatgctaatagcacaggaatgatccacaattggattccaaggcttcttgtacattcagcatagggtgtatgaaagagtccactattctagcaacagataaaattcctactgacacgcaacctcaggttcccactcgtttagaaggctgcgtatggtcttctacttaaagcctcaagtagcagtcatggcagtgacaaatcctcattgcctccatagaacctctaggctcatgtgtgagcccaggctgggctggggcccctgggagcccagggtgaggggccagtccctgggcagctccgtgagccaggagcagctgtgccacctggggaagggctgcacggtcgatgggtcttttctgcagaagagtgtgccccagcccttgctgggcacagatcaaagaggtgttcatgggtcgaaatcacagatttcaagggctgataggagtcagagtgggggggctgggagggctgaggcaggttaaagatttgagaggggctgctgtgtccacagctgcatcacactgctctgctgtcccctccatgttccccggcactgccgcctaccctggggtcttctggaagtaactgaaggccccctcaacctggctcatcatcaaagcagactgttgactagctgcaggcaaatatgaagaggctatttcctgtcacaaaaaggccatgctgtatctttctgaagctatggagctgacgcaggctgagtaggctcacctttcactggaattgcaaaggcctagccacatgaaaccgcgcctcctcatccaggagacacggaaaagggcccagcagaacgcagacaaggatggggctgcccatcttcaggcctctcacagcccctctgctgaagatgcagaagcacagccctccacagaggaacgcctgcctgagactcggggcatatgtgacagggatccagacacacgactgtttttccttcagcaacagagccgtgtattggaagcaaagccccaaaacacgataaga

SEQ ID NO: 25213 - DNA, 1053 bp, Homo sapiens
cagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaaccaggtcgtggacttgtcaatacaagggaaccgggggtactgttactcattctaccctacagtgtataagtcccaatcttaactgcattccaaaacaaaatatgtggaatagtccaggcaatgtcaatctcaatgacacaaatttattgtgaaaatattctctaattgatattaatcattgccacaactcagtttacatttttattatcaaaatatagttggtaacgctcctt

SEQ ID NO: 25214 - DNA, 1052 bp, Homo sapiens
cactgcagtgagtgaataagccgagtgtttggggcacaaggagagctgggagtttatcggacaaaagtggctatgagtggtttgattggatgatgaaaactttgggtcaaagcttttgtatctctgagtcccctggccctttttcagagcctgcccaccctcagtctgcatgcagctagagcattgggagtgactgtttcccagcccgcagctggttgggcaggaaggaggagcaggtgatttgacagctggggaggacccacccaaccagagaaaactagaaactcagagaaccttgcaggcagggatgtagggagagggactacagtcctgtgaccttagggagtctccgaggctcatctagataggcacagctggggacacccatagggtaaccccaggagggcccctgggaagaccacctgccggtgggtgtagtctgtgctgcccttctctgccttgaacgtgcccaggggctgtggtgtggggggcttgtgaacatgcaggctctgattcagcaggtctaggggtctcggtagaacttgagactgcatttgtaacactcctgggtgaccgtgatgctctggtctggggacctcactttgtggggccagcgcctggctgttgaaaaaggcaatgcgtgatttctattccaagcctttctgtgtgaagagaagaaggtactcttgtgtcctggtgtccctgagatgcaggcaaccccctcccatcactaaggcgtgttctggggcactgctaccctcctgagaacaccctatctgagagatccctggggagtttccaacagctgaacctctggtggacaaaggctggccagcttctttttccatgaatggcaggataattcctgggagggaagttagaaaaccaagaaagcctggggctctctgcacagtggaagccaagagaataagtgactgactcatggacctgaaaccgggaggacgccggagaccagccattgtcccttgctgctgtcctcttgctagctggccctgggtggggttggggtcggagtcacctcgggccctttg

SEQ ID NO: 25215 - DNA, 1041 bp, Homo sapiens
caagtccctataatggggttttgaatgaaaaccccaaataatgacttccctgaaaccccatggtggtcttcatttgacagcttcataagaatcacttaggacttttgttaaaaaatatagttttcagtcccactgtagaactactgagactttctagatgttagggaacctagtttataaatacaccaggtgatctactcttttaaccaggtttggaagccattttctgcaaagtatatttatgatgaaagattgtacttttaaagtttcctaagaggttgctgggtgatttatattaatatttttattatttacagcgttaaaaggatctgaacaaagtctgctcaaatctcctgctgtgaaccagcagaatttttgaacaggtaagtgtggaagggaagcacaaagcctgagggcttttgcaaataggtaatttctgcttttaggttttagttatttttgccctattatttctcctgaggttttgggtagtgagaagaaacttcttccctggtgcctgtcagatcctttatgaacagtaagagtaacataccctttctgcattgaccctggtgtgaatttgtgtcttaaactgtcataataattttttgttggcaagaaacaaggaggaatgctttggaggcaggagtactgtaaagaaccaaagagcagttgacttcatgagggacatgaaccagaaactgggaagctttcaggagccatagtacttgtagatagcacttttttaccagctggccagtgtcctctcttgtctctttttgtcctgctttaattgtatttgtgcagtctggccttttctgctttaacaaacacaaactcatggtagcaaatggccacttaattcttggagccacatatgaacttaggctctagtgccagtagccaattgatgctagcacagtgttcacatttcatattcttgggagggggaaatttggctggttgaacttggttcggttctttgtcattgatcacattagttatggacatagggttggagtctagaagtgcaagcacagt

SEQ ID NO: 25216 - DNA, 1030 bp, Homo sapiens
actcctgacctcacgcgatccactcaccttagcctcccacagtgctgggattataggcatgagccaccgcacctgactagttcctttttttaaactgctgagtaatatttcattatatgagtatactgcagattggtttgcctgttgatgtacatttacattgatggacataatacccaaatgtcagtttttgacaattataaataaagctactatgaatctcttgtcttttggtagaaatataacttcagtttccttggatgtatgtgtagcagtttgttatgggatcacagggtaggcatacagtttagatttaatggatattgccaattctttttgaagtagttgaactaatttgcactaataaagttattaatcttgtgttatcttaatccagatctggctaaactaaaaattgctggctgctgtggtggggacagaactactgattcgtttagtatatgtggagagtgctagaggagttggtcttttttctgcttttggaaaaacgtaggtaggcagtgggaatgggggcagattcaggttccttggtattcattctgtgttagttttgtggcagactatacatagtactggctggactccatcccaaattttgccatattttttctgggtaagttttgcatagctaggaaatagagatttgtagtagcacttttttttttttttgagacggagtctcgctttgttgcccaggctggagcacagtggcgtgatctcggctcactgcaaactctgccttcgagcaattcttctgcctcagcctcccgagtagatgggattacaggtgagagccaccgtgccggccacataatttttataacaaagatccagggggttttcaaagatgtgtatgttttgagttcttagtggaatagtggtggtagctaatctgtcttcaagacttctggaaagcagtattcgggaacactgtcaaagttaagtatcagacactgtgctggaatctgactcagcacctactttggcttctccttgctgattttaccca

SEQ ID NO: 25217 - DNA, 1030 bp, Homo sapiens
ctttgatattggatgactaatacagtagtaaagtatttgacaggtgctaggtggtttataaatgtgcatgtttttgaaacttttgctttatgtgcctcgctgaaaacaatgtgttagttcaggaataaattatatttggtaaatgagtgtattctatacttaattaaaattttttttctttgtctggttatatatgtaatgatggcgggagtcccacccgccctagaaaattattttctttttatttgagtcgttgtctaggtgcacatacaattttatgtaagtataattataacatttttatgtctgtatgttttctgctacattgttttatcattgctgttcatagattgatttgagaaatagttttcattgaagtattatttgaaagatgggctaggcaggtagttcagtattatactggctgttaacagtagcctatctaggattcagttagcattggacataataacgattaattgacctttgagtctcttacagatgtgtttggaccccgaatatggaattctcatggaattttgagatccatcacattgtagtgtggcttccccccctcccctccttcctttttccccaaagttggtgattgaagatcctctcttcagtggcatcaataataataattactttttctattcaaacctcgggcaacccctttggtaatatcagaagtagtatctaaaatagataaattggatttgtgtcttaaactcttggttgttcaggtgggagtggttcaataaatgatgcagacttcctgtagtaactctatttgaggagtcttattaacttatcctattagaaatatttctttttattaatatatgtaatctcgaagttttcttaacctttatagccagcatttggagactgaggagaaatcactatttgaagttctaagaaccgatggaactcctgtattttgagagtttatttagaacatgttaacctaagtaatgctgtacttgttttagttattcctttatatttttaaaatgattttcttagt

SEQ ID NO: 25218 - DNA, 1045 bp, Homo sapiens
ggacatggctgtagccaaaggtcttcctggcagaggggtaaaaactgagccctaggaattagggtaaaaaagaatcctgcaattcaactaatattttaatcctttccatgccagctgctccctttcccagaggccgcaagtgttagcaatttcttatgtatttttccaagtaaatatggaaatatattttccgccttttaatacaagtgatacggttctgtacttccaacatcaagtatttttattgaaagacttccctgaagatttggaaaaattttttcccatcgtttttgtttgcatttctttgcctgtagcagtaaacagttgtttttcagatgtttattcatcatttatatttctgttaatttttttcttgcctttgccaatttttcttttgggatattcatcttttccttgttgatttatgctatttatatgagctctgtgtgtgtgtgtgtgtgtgtgtgtgtgtatgtttgtgtgtgtgtgtattttttgtttacttatttagattttctattttgagctaggttctcactctgtcatccaggctggagtatagtgagggtctcactctgtcacccaggctgtagtacagcggcatgatcatagctcactacaaccttgaacttctgggctcaagggattctcctgtctcagcctcctgcatagctgggagtacaggtgcatgccactgcatttggctagtttcgttttttgtagagacaggatctcgctctgttatctaggctggtgttgaactcctggcctcaagcgattctcctacctcagcctctcaaagtgctgggcttacaggcatgatccaccatgcctggtctggctcctcatattttaaagtcattgaccatagctgtgcccagtaagttttctaaatgttaaaattgcatttatgattttatttatttctttttctttgtctctttgagactgagtcttgctcagtcactcaggctgtagtgcagtgtcacagtctcggctcactgcaacatctgcctcctgggttcaagggattcttgtgtttcag

SEQ ID NO: 25219 - DNA, 1035 bp, Homo sapiens
acataaagtatgaagctaaaagtgcatacggtcttctgcctccagacctaacaattggatatatagccttcttgaccctaacggtgcagctatatcatttatataaatggaataatttttatatgcatcattcttcagtatgttcttgttattgaacagaataatgtccgtgcttaatctgctgtggcatcatagtgttctactgtattttatcagaatttatgtagctaatcctttattgattagatttctagtttttttttttaattacagtgaacatcttcatatatatttgcatttttgtacaactatttctattaggataaatcctaagtagaattgttgaatcaaatgtcaatagatctaaccaaattgccttcagtaaaggccagtttatgcttgaaccaccagagagagcctctcaatccctatgcccagacactctaccagctttgttggttcaagtttagtcctgatacatttctttttaacttcaagatttgggtgtagagtaaactgtacctttggttactctgtaatataccctgtatggcattcatgaggtttgatggttttagaattgatgctattaagttatcctttctctgggattagataaattattttaacttttatgcttgactttttaactttagcccctgtcttcttaaactctctaaaccaagatttcttccatttttatgaaaataaaacaataaaatatttaatctacggtagtgttttattgaacttcttagaatttcactattcaactgttcgttaaagaacttaaagttgatactttcttgttcaggactgggtctattgcattatattatgttagtttttttaacttgtttctttcagcctcttgtggtccagctacttcaatgccattgttggtctcataagtcaagatcatcaggcctcgttcagtatttaaatgtagatgtcctgccttgtatagagatagaactttagatattaatttatggtggtgaatgtgtgccacatgttgacatctgactatcattt

SEQ ID NO: 25220 - DNA, 1030 bp, Homo sapiens
ggagtggaacagttaggacatgggatcagaatcaaggtgaatcgagaccaaatctaatcaaatggggcattttaacagcagaaatgaaaagtcttacataaggaaattacagaatttaaggagtggctgcatgtaaaagcagccttctgtggaaaggatacaaccctctcagtgactctgggcttcatgttcatcagcggtgtgctgatgtcctctcagccatgggcagtatttactaaagtgtcctcagtgagtcaggtgataggcccattgtcttttatgttgtcacaggcaagcctaagcattgtgttcacttctgggaccaccccttgaaagggtccacacatttgagtaggagggctggggcatttgaagccttgcgatgggaactgtgtgaaggaaatggagctgtttagataggagacaagattgtggacagggcagagtggggaggagggcttatagggtcactctctatcaatacctgcctactaatcatgatcatgtgaggtgaggacttagacttgatctgtatgtttctaaagggcagaaaagggctaactgttggaaggttcaagggggcaggtattggacacaatcttaaaagatctaattattagaattgtctgaaaatggcttgggttgccttgggaaagtagtgagttgatagaacaatagcctggttttaactgttcacacatattcacactttggtggtttggaatagtcaagtttagtcgttgttatttgtggttttcatattttaactatattaatccaatgagggtaattttcttagccaccctctattaaaggtaaaggttcttttatttacatcccattggtatatctttgaaaaggcaggttccataaaactaaactaacatgaagtatctcagaatattaaggatactaacttctagttagtatctactattatataactgctagtatactaaaatatcatggtaatttccacatacatacatattctaatatgtcatagtcactttgattgaatgctttttga

SEQ ID NO: 25221 - DNA, 1393 bp, Homo sapiens
actataccctttccaaacacctgtagttttgttttgttttgtttttgtttttgttttttttaagaacaaagacaaaattacctgtgataaaagcctctagcatgaggcctaggagcatttgtatggcaagtaaggcgattgcacttggacagtcaccactggggaacatggtaccataaccaattgtgagttgtgtctccagggagaaggagaatgcagctgtgaaactggtgatatacttgacacagatagtgtggttttcaggtggggcatcatgatctagttccagatcaccattcatctcagccagaacataccagagcactgcaaagacaagccagtggacaacaaaagaagcagaaaagaccaacatcatccaacgccagcgcatgtccattaggattccccaagcatctcgaagatatgcaagacctctttgagcgccatccatttgaagtgtgctgtggccatccttggtgaccatcctccggtatctttgacttaggagaggagcaataactttgcaattactgctgtccatctcaggctgtatttctctaaaatcaagagtaaattagtaagctcttaactgttttatagttaatgtttgtgaatttggagagctcatggactttctgctttcttgggaatgcttctctaaccacaactttgccaactctctcgcttttctcttcacgttagatggcatttactaagtcattcatttgggagctaattgtgtgttaccttaaaatatctcttctattgtttctttgaatgacagttaaaacattgtttaacacttaaacattttctaagtatattttagaattcctgtaggtagagattatatacccctgtgtcttccttgcacaagtccgggtgtcaagcatttattgatttgaccaaatattgtgtataaagactagcatttcatagttaatttataattatgcattattcataattaaaaggggtatgtttaaatatgtaagtgttcttctgtgtaaataattagaagtcatttggaagcttattattaaactgtctgcaaatcctttgaagccagatttagtataggacaaggcttacatttgtggtaagcttttagaggtttgtagttctaatgtatgctttataattagcctattcagagtttgatttattgatttgtatttttagagacagggtcttgctctgtctcctaggctggagtgcagtggcacaatcatagctcactgcaacctcagcaaatttttagaattttaatttttgttggtactgggctcaatatattgcctaggctggtctcagactcctgttctcaagccatcttcccacttcagccttccaaagcgctgggattacaggggtgagccaccatacctggtct

SEQ ID NO: 25222 - DNA, 1035 bp, Homo sapiens
aagattttaaaagtaagtcaactgaaatacagtatttggttagtcaactttgtcatggtgctgacgttacagaaggaggaagcctttgattttgaatgctgagaagggccatgtaactgtctctcactcattttagtctccgttgctatgaattgttggaatttttagacgtgaagggaacttagatgtcatcttctaaactgcccatgaatgactttaatatttattatttatttatgtttattttattattattatttttggagacggagtcttgctgtgttgcccaggctggagtgcagtggcacaatctcggctcactgcaacctccacctcccgggttcaagtgattctcctgcctcagcctcctgagtagctgggactacaggcgcacactaccaggccaggctaatttttagtacttttagtagaaacggggttttgtcatgttggccaggctggtctcgaactcctgacctcaggtgatctgcccgcctcggcctctgaaagtgctgggattataggcatgagccaacatgcctgacctgttatttattttaaattatatcaggaatacacacacacacacacacacacacacacacacacaacttataaagataatggtctccttggcactcccacccacccacccatccaaatttacacaagtaaatctgtaatcaatttggttagaagggatttattttaatatttttggggattgcttagatgcagtataatttttagttatattagtagtaattggaaatgtgtatttttgtgactgaagtcaccttctaaataatttctagaataaaatttttatattgaagaagttggtcttaaccatttttttttcaggagcatgcattttgaaatcattctgtgggaagatgaaaacaaatttagttctatgtctcccctttttagagatgttgacactttccttaaatgtaccatgcatgatttgtctaccacccttttagcttgttatacttaaatcccagatctctgtcttcccatttcagtttc

SEQ ID NO: 25223 - DNA, 1039 bp, Homo sapiens
caggcgtgagccaccatgcctggccagtagtactatttctttgggaaaatatttagtagtagtcaacaaagttgagcatactgtgacctggcagttttgatgctaagtatatacccaacagaaatgcaaacatatacttaccaaaactcatgtccaagaatattcgtagaagcacaattcttatgatagcaaaaaggtagaaaacaacctaaatgtttctaagcagtagcataagagtaataccgtgtggtttgtttatacagtgagatcctgtacagccatgtaaaagaccaaaatattccctgtaacaatgagaatgaatctcctgtgcttgcttcggcagcacatacactaaaattggaacgatacagagattagcatggcccctgtgcaaggagaatgaatcttcgtaatgttcagcaaaagaagccagatataaatgaatattccattttataaaaaagtttaaaagcaggcaaagctaatatttggggctagaaattaggatagtgtttatcttgggaagggctgattgggaggacgcatgaagatttttgaggctccttaaaatctttttttaaaaatctaggtggtagttaaattatatgtatttgctttatgaaaactgtcagttgtacatttgtgattagtgtacttttaaaaaatgttttcttaaagaggtggggagatgagtgaagtccattttaaaagttcttgaggtcttttcacccttatgaaaatgagcacggcctctggaggcagaacttatatggcttgatgaaaaatgtggctgtactaacaaaagagagacaaatttaaaacaaccttgtgattctcaaactgttggaaaacctgtagctcataaagtttgaatgaccaattctgcatgctttgttccaaaaaggatttgaggcagaaaatttgaagataaagaggaaagcaacaccaaagaaagaatgatgagatttggagtcattagacctggtttcagattctggttccaattattttttgttttgtttattatttttcttatttt

SEQ ID NO: 25224 - DNA, 1035 bp, Homo sapiens
ctcaggtgatctacccaccttggcctcctaaaatgctggaattagaggcgtgaactgctgtgctcagcctgtatttttattttcattccgttgtgtgtattttaatttcccttgagactccctcttttacccatggattattttgaagtatatttttgggtttctaagtatttggaagatttctgttatttttcttttattgatttctagcttgattcttggtggtcaaagaaacatactatatgtgatttttttttatttccataggtttttggggaacaggtgatatttggttatatgagtaagttatttagtggtgatctgtgagattttggtacacccatcactcgagcagtatacactgaatatgattttaatttttaaaaatctttttatgtttgttttattgccccaaatgtggtctgttattgctgtatgttctgtgggtagttgaaaagaatatgtatttttctatatttggaatgttctgtaaagtcacttcacttctgttggttgatggttttgttgaattctgtaatcttgcagattttctgctagttggtctatcacgtggtggttacgtcttcaatttgtggatttgtctgtttctttttttcagttctgtcagatcctgttttgtatattttggagctttgttgtttggtgcatacatattacaattcctgcatcttctatgtgtattgacccttctttattacatctgtctgtctctgataattttctttgctctgaagtcaactttatcaaacatgaatataacttactttaagttaatatttgcatgatatatctttttctctcctcagtctgcctactttgttatattttgtgtgactttcttgtagatagcatactattaggtcatgtgttctggttgctggcttcttcatctccaaatctgtgatatatgcgataaaaagaaaaaacagggaattcacgatcatgtcatcactgagacccctagttagcctgcctttttctctccacctttcagtgttatttgttttatatatt

SEQ ID NO: 25225 - DNA, 1842 bp, Homo sapiens
tattcatggtatgaacatttgttataagtaacaagaatgtgagaaaatatccactacattgtttatgagactcctgatatgtggcatgagttctcccattgaatctttgtagtggtatttgtttatatttcttagtatcctcagacgtagcagccaaaaagcccgacattaacattagattgtgtgttccattcacattttttggaagagctaaatcttgaattttggttttagtacttgccagaaaagaatgtctacatcaatacctagtgtcattgtaatgatttctaggttctcaggcgtacaagagagtgttgttgctgttttatacttaatgcattcttatcccctgaggtcgtgacagtctccttagagttcccagaatgtggaaaggttcatacaacattgctgttaaaacgttatagccacactgttaaatgttcaatcagaaagttatttgtagggatgagtaaagaagtaccatccaagagcattctgatgttactctcatgggtggtataatggtaacgtggagtgtggaggcaagtacaggtgggaggaaagtgcattcaattgagacagtcataaaattcttctaattactgtgatatgtcacagcttagagctcttacagggtgttgatgttgtagcgtatgtcagaatttccttccttttaaaggttgaatagtattaatattccattgtatgtatataacatattttgtttatctattgatctgttggatcacctggttgcagtgcagtacggtacaagcagctgattgaatgaacgaatactactggtcagtgctttcggagtgttcctgtgcttggtttcaagtttctaagagtactcttgtgtaatcacagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggtatgtatctgggaactctgaccataggattagtgcttgatgagggctttcaggctgctttctttcatcatttcacagatactcctgaagtccacaggattggggttagaaccttagaagactcactcacctttggaaagaatctctgtttttcaccaacacccactgtagggatattcttcagtcctagtaaaccactagaattgatattctttgcatatttcctagagttttataaaccagttagatttcagaagttctgtccttgcatctaaaaacaatgagaaagtaactttgatgtgcagcattaaatgtcaaattttaaaagttacatgggctttaaaaaaattgtgctaacatatacataacataaaatttaccattttaagtgtactttcagtggtgttaagtatattcattcatattgctgtgcaaccctcacaaacatgtctgtagaacttctccaactttgcaaactgaaactgcatatccattaaacaaggagccccactccctccatccatagctcctagtaaccaccattcttctttctgtgtctgtgaatttaaactaactcaatttcttatgtaagtagaattatacagtatttgtctttttgtgttgggcttatttcacttaaggtttattcatattgtagcatatatctgaatttcctttcttaaaaaggttgaataatattccattgtgtgtttatccattcctattttgtttatccattcctctgttgatggacatttagatgacttccacgttttagctattgtgaataatgctgctgtgaacacgggt

SEQ ID NO: 25226 - DNA, 1042 bp, Homo sapiens
aggatcgcttcagcctgggaggtggaagttgcagtgagccaagatcacaccactgcactccagcctgggcgacagagtgagaccttgtctttaaaaatacatatatatgtatatatatataaacactaaggctgtcactattttcaagggggaagaaaaagacttgtgggttattggaacacagttgatggggtcaaactcaggatggggtttggaatcctagcctctccctatatttggtcttgtaagcagttggtaccacagcttttttggttaataaataggcatgtttatttttttgaatcatgatatttttgagtcagttaattaaggtattttatgtaaggcatttttgtttattactgttacatttcaaatgtgtatttatttgaaaacttgaacatgaaaaaacaagaggctgcagaaaacccagctaatattaacagaactgcttttagaataaggacattgcctgtttactttttggtattcaaataactaaaacagtttgggattttattcaaggtagaagaactggaacatttttggggagtcactcagtttaaagaggcattgttcatcatttttatcaacctccaattatagaagttttggaaaaattacatacatgtgaccattgggcattcggcattaggttttctttttttctttttctttcttttttttttttttttttttttttgagacaaggtctcactctgttgcccaggctggagtgcagtgatgttatctcagctcactaaaatctctgcctcctgggttcaagcaattcttgtgcctcagcttcccgagtagctgggattacaggcgtgcagcgccacgcccagctaatgttttgtattttgagtagcgacaggtttttgccatgttggccagtctggtctctaactcctggcctcaagtaatccacccacctcggcctccagtgtgcccagccagcattaggttttcagctgtcagttgtgtttgtgagtactgcttattgccttcaatgggtatgctagtactgctttttctaagc

SEQ ID NO: 25227 - DNA, 1542 bp, Homo sapiens
tggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattctatctgagtgcacctcttgtactcacctttatggaggctgagttctgcactaaactgttcctcttggtaccatggaaaagctccaagcacccaagacatggaggcagccatggcttctttctctgccagaccacgtagcactggctggttctgtatttgagaatgtagaggtcaaggcagatgtcggtaagtttgac

SEQ ID NO: 25228 - DNA, 1064 bp, Homo sapiens
cctgtggtggaggtggtagggccaggatagctgagcgcatggcccttgggaaaagggaaatgagtttgtgagcaaaactgttgctgaccagggagaagcctggcagacaagataaatggggactctgaatcctgagaccttggagctggggtagcgtgtgcttgggtttccttaatatgtggaaaggggtctagaggcttggaaaggcagggcgcttgctcaggcttttgctcaggaaatgtcagagctggtgaaatatatacggtttccagcctccttttaaatcccctttaccaatctaagcatcgaaagtttctcttccttcacatcgtgtttttcctagtcattaataggatgaatttcaccttaggtgtttcctctcctaatggattatcctgtaaaccatggggatgggcctggctaaaagatgttgtaacagacacaaagtgttaagcactcagccaggtccgtctggctctggcacagggctctggcgaggtactattcgtcctctgatgtcatgcttccagaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggtgggctatcaatccacagttagtggtttccatccttagtagagtagaacctaggtctttgaaaagaaagagataaacctggcagttactacaggaggtttaccagggaattctttcagtgtttcaaggagaaaagctaattctgaacaatataaattaaaccagagttagaaaaaggaaatacaccacaattagaattcttccccataattttgtgaagctttttgtatccatataaaaattctgatcttgctaatgcacaagaagactataatccaacct

SEQ ID NO: 25229 - DNA, 1094 bp, Homo sapiens
gcagtcctcacaccttggcctcccagtgtgctgggattgcaggcgtgagtcactgtgcctgacctgtttctttttcctttgctgtcttatcgctttgagtgttcctggccggatctcagggtggtctgacactctgactctggaggtaaggatgctgtggatactttgccagcataggcagggcctggcgccctgaggctcaccctggctgtgttctctctcctagcacacactcacgggacacagtgggaaagtgctgtctgctaagttcctgctggacaatgcgcggattgtctcaggaagtcacgaccggactctcaaactctgggatctacgcagcaaagtctgtgaggaaattcagtctctctgtctgtgtatatgcttagatgttagcgtggaggtgtgtgtttgcacgtcagagcctgcatttatgtaatatagtttgaatttcagatctggcttcatgtttagaggggcactgaggatagtgatagtttttcttgtttaaagcttcatttaagtgagtaactctgacaagtcagtggttagagggtggcagcattatgtaaacagccacgttggtgcctctgcttgattaatgatgtttgcatttctttcaggcataaagacagtgtttgcaggatccagttgcaatgatattgtctgcacagagcaatgtgtaatgagtggacattttgacaagaaaattcgtttctgggacattcggtatgatacccaagctcctgactggaggcacataagagtctccacagtaatggttctgtacatgggttgtgcttttaagatctcaggacatggcagaaatgagtttcggtacacgtatagtgttagcttattaacacttggctgttctttcccatgaagtagactgtggagcttagcaatcatttattgagcatgcagtgagtgctaggcccttcaccagctggcaggtaagaaaaggcaaacaggatactctttctacctttaggtaatttaaactgtagtagggaaggcagaacgcaaaagtcagtgactagtgtgttgaagtggaggcagctacgtttgttccagtgtgttaaagaatgcctctc

SEQ ID NO: 25230 - DNA, 1123 bp, Homo sapiens
actcggggcagagacctgccctggggaggcaggagtggtttcctttaaggtgagatcttgagggataaagaattcaccaggctaagtgggtaagaaatggccttctacatatttgaaccttgcgtctagagctttaggcacaactgcgaaatgatcagaagttgggccagaggtggatcacgttgattagacttattagttggaagggttggttagggctgaatttcgaaggggtggtcctttgaggggtttgctttttggccttgggcaagaggtggccacagaggattgttcaaagtatgggggtgatggatcagatgtgcttttgggaagatctccacatagccctaaatgatactgataggagttgctttctcctgttgcccaggcaaggtactgaccagtgtggggtagatcatgtgatttacaaggttgattaagatcaagattgtgttgagagagatttgattcctgggagattccagtgtttagaattttgttggttaggaggtgtttttgctttccttcttttttctcctaaaacaatagctgctataccagctgttctggttgaggaggagtgatgggtagactgttaaaaatacaccccgaggacttagagtttctgaatacagtcacatctgctgtacagatagcttaaggctgatttttcttctgagttgttaagagattgtcagaatgtgggaatgcgaggttgactgtatgtaatagctccattttttttttttccagcagataagccattcacaaaattcctctggtatctatggtacataatagaaacatcaaaaatggtatggggtagcagtctgagtctaaaaagaaaaacagaactcaccttaagtatttggaacagaaggaatgtaatctaggggagtggtcacacaggtgatgtgagaactgagaatgcaggctgcaatgaggcaagccggagatgaggcaacaagcaggaaactgctgccacccctaagttggagggtgaaggaaggagatggcatttcagactccagggacagctgtcacccaccaaaaactggggtcacaaggggtccatctggcagtggctggagccttgcaagggcacagctgctgctgcggatgt

SEQ ID NO: 25231 - DNA, 1035 bp, Homo sapiens
ctgggctcaagtgatcctcctgcttcaggcttctgagtagctgggagcgtaggctcaagccactgtgcctggctaattaaagattttgagagtaaatcatcgtgaacttaggagaaactctaaatccagtgttggtttctttataagaggaaggggagggagatttggacagaaagacatgttgggaaaaaggttatgggaaaatagagccggagattagagttcgttgatgcaaaccaaggaatgcctggggccaccagaagctggaagagataacagatggaatctcccctagagcctttagagggagtgcggccttctgatcccttgatctccgacttccagcccccagagcagtgagacagtcaagttttttttttttttttttttttccaagttttgttttaagccttgaagttttatggcagccctagggcagccctggggaaagaacactgggccctgaacaaaacatgggagccaagaggctgagccctgtgagactgtctgagtgccttagcagggctgaggtgccaggttctgccaaagggcaacagtcctgggtgacaccctcccctcacaatttggattgggatccaaagaagccacttccaaggaatgcgcaggagccagaagtattggaaggactgcagccctgcttcaaatcacctcagtcctctgaaattaaagtaatcccagtgtactagtgtctctagattcccaacagaagcaaactttaatcctctctagagggagatatctccctctaatcctcccagttatcaatggaggcctctaatgactttcacgagtctgtttgtacgttcatgattgtgcatacagtaaaaaaatagacatcaagggaggcgaggcacttgagctaaaaccagtcgaaactacaggctgtagacagacccacagggcttccagactccagacccagactttataacaactgtgctcgttgtgttggaggagacacgagatcagatggagagttttggcagagaactagaaactatggaaaagaaccag

SEQ ID NO: 25232 - DNA, 1043 bp, Homo sapiens
gatgcaagaaaaaatactccagcatctgtcctttaaagataacttataacttttctgggttttgggttgttggttttgtcttttttttttttcccatttagggaagagatggaagtgattgctttccccacaaaggtaaggaagatgaatggggggccaggagagacgtcttcacagtgaggcctttgaggtcaacagagaaagggtctcgtggtatatgtttcaggcttccatggatggcattgttctgtgcagatgtatttgaaatgagtttcatccatgtgtacttggatgtgaaaaggatgtttggaaacaaataccatttcccagtccttcacactgaagactggtttatatcctcgctaccagaatcggggtgggactttctgtctgccttggatcacccttggtctgttttggacgggacctcagatgctaactgtatgctggggatccccgctgtctctaggggagggggtgggggtggggaggtcacttctggcaaacaagcgtcatcagaatgcttgatcgttggataatgttgggctcctctctttttccttcctggcactctttaattactggggagagggtgggtgccttcttcagaagtgtgaggtgaatgtataagccaagaatgagtcagtagattcttcagcagctctgccctgcgctgatcctctagagttggaaagggctgctgttgtgccactgggtcagtgccaaaagcagagttcaccatgattggcacatgctggtgagcaagaagctcttggaagtggtcgtgagtgcagccagttccccccaacccaggaagggcacagtgaggatggctggttgcgggataaggagaagagacccctaggcagtttgcattggcctgtgctgtccgggtgtggtcctggtgtccgtccacatgttgatggcgtgtcgggctgggggctttctgcagccttccctgttccactgtctctcctgttgtgaatgccggtggatggaacaggcagcgcagtgttctgcgcttgcattctggcataggtggg

SEQ ID NO: 25233 - DNA, 1032 bp, Homo sapiens
tgagaggactccagaggggaccagggtggctggggggggggccagagcgagaggacaccagaggggaccagggtggctgaggggggcagcagagtgagaggactccagaggggaccagggtggctggcagaggccagagtgagaggactccagaggggaccagggtggctggcagaggccagagtgagaggacaccagaggggagcagggtggctggcggggggccagagcgaggcgagaggacaccagaggggaccagggtggctggggggggggggcagagtgagaggacaccagaggggaccagagtggctggcagaggccagagtgagaggactccagaggggaccagggcagagcttgggacttactcctcaggacttgggctgctgttgaatagttttatttggtgaaattctcagatttgcaggtgtcagaaagttctactctggctgtagggtggagggtgaactggaaggggagggaggtttgtaggattgttaggagagagtggagtggagagtgcggaggtgtctagggggcagtgggcaggctagtgatcaggtcagaagggggtggagtagatgaaggtgtcagggcttctgctgagtacagcagcaggctggttaagtgagctcaggagtccagaagaggggctgtggggtggtgggggaggcttctttatcttccatgtctgtcacattctttagccttattttatttaatttgttggtttttttcctagttctagttatcaaagtttttatattgtttgttactacatttacttgcaacctcccctcccagctcccaccccccacccccgattttggcatactttgtatttatcctggcttattcttgtttgaaaggtaaaatttttttttttttgagatggagtctcgctctgttgcccaggctggagtgcagtggtgcgatcttggcttactgcaagctccgcctcccgggttcacgccattctcctgcctcagcctcctgagtggctgggagtacaggtgccgccaccacgcc

SEQ ID NO: 25234 - DNA, 1046 bp, Homo sapiens
gtcaggcagcctggggctccagggtgaccagaacaagggccagggcggaagccagactgtggcccagggccggggagtgccaagactgagggtgcagggtgatgcaggcagcccagagggcatgctgggaaggctggcaggggccacatgtggatggggcagggacagtgacgcagggtgggctcacatggttaggggccacggcaggctgtgcccgtgagcctggcaggggatgcagttttggcccaccactttgcctgtgatgtctgcagagcgtgcagtggctcaccaagctgagtggtcttgtcgctgggtggggcgtggctggtgggagcagttggctggaccccagtgctgctgtcgtccctttgacaaagtggaccctgagtggaggcggctggtgtcacgtggcagggcctgtgcgtgctctgcctctggtgcaggtcagccatgaggagcacaggtggcccctcagccccgtactgacaagcctgtcatttgtcctgtggaatggatgtcatttcacggcctttctcttttctctgcagcttacggttattccagaagtttgacacattccggattctggtttgtggcggggatggaagtgttggctgggtcctctccgaaatcgacagcctcaaccttcataaacaggtaccaggacaggagggagcccagccaggagcagagagggtgcggaggttagagggaaatcatgcagtctcagctcctgttcatctcggagcacctgttctcaggccagaaaccattggtggttttggggagtgtgcagtttggtggccagggcagagaggggagagcctgggccaccccctggcattgtggaggcccgggggctctggccatgatgtatgagggggacctgaagggagctacgaaaagaattgcccacaaaggacccacatggggagcagggctgggtggggctgttgctttactgggtaatttttgtcttgaggcctcttgcttgtgagaaggggacggcagtatacttgagtttctcaagtcagagtcatggttca

SEQ ID NO: 25235 - DNA, 1050 bp, Homo sapiens
cagcatcttatctcaagggcagtcatgtttctgtctcattgccaaggaaaatgccatctgtcccctccagtgggctctgcctgtaatgtgtaagctgcgtggttttaggtcacgtccccacattgctaacgtaaccctcacggtgggggacaaggagggctgcgggctgggaagtggcccctgcccccaggtgtttgcctgcgcatcgtcccccatgtttccttagtgtcagctgggagtgctgccgctcggcacagggaacgacttggcccgagtactgggctggggctcagcctgcgatgacgacacccagctcccccagatcttggagaagttggagagagccagcaccaagatgctggacaggtgagtggggatgtgctccggtgccgtatgaggagactttgagagacaggtccctttgaccaggtgttcttaacctggggtctgtggaaaacatgggccctctgaaattatttgtaaagatttgacctgagtatatattcggatagtctttgatatttggtcagattatgacaaggataaaaacaaaacaggttaagaaccagccatgccctaggatgatccagtcttcccagaaggccaagcctgagtgtgtcagggccgtggagaaggcagctgtgccatctttggctgcttcagcccgagatctaatacccatcggaagaatgctccttgtcgtttacttgaacagtttcattttctcatattctgttcccagaagaagttttgggaaattatcctctagtgcctaaagccactgtgacaccttccctgagtaaggtactgttgtcccgagtgacacacttggcactcactgaccacatgcctgtggcacatggggtgctgatgagatgcctcctagccttcctagttgctcccagaagcctggagttctgagcacagttgtggttttgcaatgcccccaccatttcaggcctcctctgtgtgccttggggcctgtgaaatgctcatctcactgggccagctggctgagccatttgcagctctcttgaggagggtaaatcc

SEQ ID NO: 25236 - DNA, 1050 bp, Homo sapiens
ctagcacaggccgtgctgggatcgcagactgaaggagattcatttgcagtttgcctgcagcttgacgaagcttttaaaatctctcacctagcactaggtgagtcccagattagcgttagaagtgagttgaggcttggctgggtcagacagtgtctgttaggagagactcatctttcccagcttgtgctggcaaggaagtggctgacagagtcactgggactgtcatggagcttgctgtcacagagaccaacagtcctggccatttggggtgattgcaggtacagcagattctcttctatgaagactcggttgcagcccacctttctaaaatcctcacctcggaccagcactcggtggtcatctcctcggccaagtgagtgcctggtggccctggggagggcatggtgccctggcccccagcctggagctgcctctctagaagggtctttctgtttttctccccacagagtgctctgtgagacggtgaaggacttcgtggcacgggtggggaaggcctatgagaagacgaccgagagctcggaggagtcagaggtcatggccaagaaggtctgttcccgtgccctgggtgggaggggcattgaggcagcgagaagcttgctctgtcaccagcagagggccgtgactgcaggttgtccaggttcttggtgatttgaacaaagaattagacaaaacgcacagtaaaggaagacaagaatgaagcaacaaagaacgaaggcagggatttattgaaaatgaaagtacactccacactgtgggagctgcccgagcagcggctcaagggtccagacacagaatcttcttgggtccaaataccccctagaagtatcccattggccacttcatgctcacctcatgtaaatgaagtggtagcttgcattcagtctgattggtggcagaaagcagccaaccagaggctgaagtggttacaaaggtcacactcctgtgcaaacatctgattggttgcaaaaagcaaccaatcagaggctaaggtgaagttacaaagttgcatttctatgcagactaagactc

SEQ ID NO: 25237 - DNA, 1026 bp, Homo sapiens
caaagagttgctgcacagaacctacaagaacctggagcaaaaggtcttgctggaggtgagtgggagggtccttgtcacctgcaggctggcctccatccatcagcagactgccaggcctattgcttctcctgttgaccatttcctccatgcacagggacttgcctggggatgccctggccacggctgtgctcctgagcccctggcggtgggaagctggtagagaaggaggggctgactcatacctttctcttttcttttgttctgtgtctctgctgctcagtgtgacgggcgacccatcccactccccagtcttcagggaattgctgtccttaacattcccagctatgccggaggaaccaacttctgggggggtaccaaggaagatgatgtatgtatggggtgtgagcgggtgggcctgagctcagtggggaagagctgtctgagagcaggggggtgttctgctgtggctggggtggatccagctcttctgttgtgccagcagtggggttgccgtggagaacaagatagacagggtcccccacccagctcatcgtctagagggctgagcagagcagttgtgtcagtgaaggtggtcagtgagggtctgtggtcagcagatgtggtcagcgggtgtgacgtggaaggagggtcagggaaggtgtctgggaggccaagacctgaaggatgagttggagttggctaagttaggtgggcagaggagagggggaggctgttccaggcagagagaattgcacagatgaaggctcagagtcaagacagggcaggcacatggaggatgggagagaggtgccccgactgcagtgggcagcaggggcgtggagagacaggagagggctgcagggcctgggtcacactgggctgtgtgagctggggaagaagtttggaatttgtgttaagaactgtgggaaggtgttgataggtttaaacctggtttaaaccttcctttgtacgtaatagcgaatagaagtattcagcgcttcctgcacacgtggtgtgtgctggccc

SEQ ID NO: 25238 - DNA, 1045 bp, Homo sapiens
ctgtcctgtaagctctaccacaccagcacaacaccggggttccagctggcttacaggggctgggctgacatttgcccaagggacaggtggacggacagcttgtgttctctgggattgtctagaaatcagctgatttgcataagaatgtttccccatagctgagagcttaatgttcatcactgacccattggtgagtttgttgaaatagagatggttccgggtagaatatacttgcctcctagcacctgaaggactattacttgggataaccaggcttcccagagtgctctctgggccctcctgctgcccagctcccctctgagctctgcaggtgccatccggcctgcagtgtgtgtctgtctgccgtgggcctccactctgcaaaggcagttgtcccctccacttccaaggaacaaaactcagaggctcgctccagtatggtgggatggttgaaaggaccaaagtgtcactgaatgagccagagataagaggatcttaaaggagagtttgggagaggggccgtggtgtggtgtgcctgggaccctggaggacggagctcctaggtcattgtgtctaagagtgctttggggattcagctccttccgttggcctccattatttcttggcttctctgttgtgtctcttctctctctccttggcctctttctgcatctgtgtctgctctttgctagccggcctgcctttggtggtaactgttctctggggtcttgcccttgactcttgcctccttcccatatccttgatctggatctctctatggatctctccccaaatgtctattccagatctaatcaagatttacctctcactgccagagccatgtgtttgctcctcacgtgggtaccctatgttggcatgtccaggagaaaaccctctaccttcctttttctccatgctgcccacattcagcctattttggagatcccagctaagagcgtctttgtggtttccgctcgccacctccatgtcacccccaggaccttcctcttgctcctgggaaagtgtgttagtctctcctctcctc

SEQ ID NO: 25239 - DNA, 1050 bp, Homo sapiens
ctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaaggtgagggccgggccgccttggggcctcgggaaggcacggacgcccgcggcgcggcgggggtgtgcgctgtgtgcgtgcgggtgtccacacacgccggccggggcacgcggctgctccgccgagggagcactgcggcgctgcttgtcttgcaaggccgggcgagcgtcgcctgcgccccgccgcgccgcgagctccgccaggaagatagatcgtcagcgttaatttgatcgtggacaatagagtctctcctgcgggaaagtggctcggtgcctccgcgtcctgggctgccggagcgtcccggcccagcagacgcctgggggcagccggcggggtcggcgccacccgacccctgacaggttaccaggccaggcctgggcgtcttgctggacgttgaagacgtgttctgagaagtgctgccgctgggggcgaggcccgggccggcgtgtttgggcggtgcagggctgccctcc

SEQ ID NO: 25240 - DNA, 1472 bp, Homo sapiens
agactggagaggagacctagagccagcaaacaaaagacagagggtttattaggggaatttatttacagagtggtcccatggcggcctgggcaggagaagcgctgctgcttgctttcagaaagcgtgcagtttatatagcattttcgcttaacaccctcccccaaacaaccaccacccagcaaccttaacaccaatcaaagagcctcaataccctgtatggcctgctttccatgggacaggctgggggtttagatgttcctcatagataaggaatgaatctctgggttggccactcccggattccttagctcagaaccccgaacatacattcaggtgcacctgccatgtggggccattctcagttattgctgtcaggggcatctgtcagtgggctgcgtttctgcgacacggtggcatgtcggatggacattgccaagagaatctggttaggaggtagaggcagctgatgtccatttccttctagactcattctgtggttttgcggattttccttcttgtctttcggagattgttgctttttaatgtagtcttatgtatatttagattgggttcttcagtattcacttattatatgataatttggcagatgacacattttgttaccaatatttccaagctgaaagcgcgtttctgtaaaagacaggagctagatgttactagtagcttaaaagagctgttggaggagcctgaaggaagtgactcataagggagagaagcagtgggggcagctgcaggaaccttcaaaacaaaacctgcagccctgttgctaccacctcttgttttttgcctaaaccaggcgttttattttgttaagacgaaaatcccttattttgcatccgtttttccccctgtataccctgcaggtgtttatagtttgtgagtctcactctggcttgttttaaccactgatttcgtttcgtcttatgtttctctacactctagcaaacctgtgtccccctccccgcccccatcccaatcctccagccttcacgtccttagcttaagtgattgagtctggcaaagcggatgaggcttagctatttttaaaatccagggtttgaggttctgatctggtgcttagctacataattccttccctttgttaagtacctttctccgagaaacaaaatgcactctacagatgttaatctctaatctttgcagcatctgttatttttattcaggggtacaagtgctttgtgtgtgctgcggtgagccctggccttctggaagctctgtgcttctgaggggctgagggggatttgggggtcccttttcatagtgtgggctgtctttcccaagatgcagtgatgacccatcagaggcagggttggtattgtccgtggggtccagtccctctatcttccagggcttttctggtcacaagagaccatggccagaagtgggtatcgtgcttgtgtctggggcctggggagggaaggaaaacaaat

SEQ ID NO: 25241 - DNA, 1056 bp, Homo sapiens
accctctttatttactaatcgtaaaaataacaagttttggtttagtagactccgtttaaaattgactaattagttttagatcattgtgaactctctggattaaatgtacatggtgcattgcggtgaaagctgttatggatgctccagtgatcccatcttctgcgtgtggaagcatttcaggaagccttctgtgttctcttgacatgacattgaccacttcctggatttctgatgtcacaggaaagataaagatggacagatgccccaggctcatgtggtacattggtcatctctctagcagtcacggttctcagggacacgaacataattcctcatttgctttgggcttccccatacaattctcagaagacagctccagcagagcttccaacagtgtgaccaccagaatgagttcaacgtgctgcaaattgcttttcctctttagggtgtatctcactttcggtgataaactccagttattgtgttttaaatcacatggaattggtcttctctgtgactcttctatcctggtggaggtgtacttagatacatttctttattttcaatttttagggaaatagttatataactagttaacatatttgtgtggaaccaatgtcacatcatcaaaataaattctaagagtcctggctttgattcttaaagataaattcaaagactctctctttgtcactttttcaccttgtcgtcttctcttcacctataactattttttaataagtattgtttatacttgtctcttttaaatataagcaaatacatgcgaatgggtacttatataacctcctgcttggatacaggtagcttcccatgcactgtttttcgtttgcctttttaacttaggaacatgttctggaaaccactccatagtgtgggctccagaacaggcctcattgtgaaactgttcccaatttattaacaggtctcttattaatagacgttgggatcgatccagtttcttgtttttgtttgttatatatatgtgtgtgtgtgtgtgtgtgtgtgtgtgtgtgtgtgtgttgctattgaaaaata

SEQ ID NO: 25242 - DNA, 1029 bp, Homo sapiens
ccaagagaaaacctgatggcaggtaacacatcacccctctcttttagggacctcgtccctttcttttagggaactcattggcttgtcttggacccaaacataattagtgggggtaggggtgaggagagaaactcttcagtgaacagatgtcttcttgggccgattgttggatattgctcaccagctagttattaaattctagaaaaactaattctttgtgcagattctaggtaaaatgtctctgttgcaaaataggatttttcaattaagaaaagctttaaaatatatcatgtgttcctccttagtctgcagaatctgaatgtcaccttaaaatgtcagggttaaatttcttacggttagtacatgaggcaggcgtgaaatttacaacagaaaattgagattgattactttcatttactttctcttttttggggcagtaactgtttaatgttaaatttgtattgtatgtcggtgcctcttttgaaactggagatattgatatgatcttaagcaaatgtctccaatacgagaaaaagaggactgatttataaagtggaggactgacacataatgtggaggactgatacataatgtggaggactgatacataatgtggaggactgatacataatgtggaggactaatacataatgtggaggactgatacataatgtggaggactgatttataaagtagaggactgacacataatgtggaggactgatttataaagtagaggactgatacataatgtggaggactgatacataacgtggaggactgatacataacgtggaggactgatacataatgtggaggactgatacataatgtggaggactgatttataaagtagaggactgatttataaagtagaggactgatttataaagtagaggactgacacataatgtggaggactgatttataaagtagaggactgatttataaagtagaggactgacacataatgtggaggactgatttataaagtagaggactgatgcataatgtggaggactgatacat

SEQ ID NO: 25243 - DNA, 1071 bp, Homo sapiens
agcttggagctggggttgtacgagaattgggctgggcaaaggcagtgtccaccttgttgggtgatgaggatgggattcaacaactacctgtcctctggagattgaaaggttaaaataaggcttgttggagcctttgccatctgaagcttctgtatggttttggggtcaaagtaggtttggggaggcaaaaatgagcccccagacactaagaagagaaggcacaggacaggccaccatccatcccctgctgtcccaaaactgacaagtctcgtacctctgacagtaaaactccccgtaggactacaagacgtgggtcttggagctgcagttggcctcaaatgcaggttcacgaactgaccagagccagctgctgcagaggctgagctcattcgcagtcttggtgtatctgaactcatgattgaaagattttgatgtacagtcgacttgccatatgcctaatgtgatatcccgttagactgtgcttccgctttagataggtagtagttacaagggctttcacgggagcccttgtgccttagtccctgtgtccgtttcccattgcagctgtacaaggttaccccagatgcagtggcttcaaacaacacacatttattctgttatagttctggaggtcagatcctaatatcaaggtgttggcagggccgcgttccttctgcaggctctagggaagaatttgtttccttgctttttccagcttctagaggctgcccacactccttggctcatggccccttcctctgtcttcaaaaccagctgtgtagcatcttccgatctcttcttccattccactccatcctgacgtccccttctccggctcctctgctttcttttttcatttgataaggacccttgtgattacgttggacccatctggataatcttgaatgatttccctgtcttaaaatccttgacttaatcacagcgacagtgcctctttatcatgtaaagtcacagttgcaggttctggggattaggacttgggcatctttggggagggtggtgtctgcccacctcagtgtccttcctctgtgtttctcctgagggctgact

SEQ ID NO: 25244 - DNA, 1096 bp, Homo sapiens
cagtggactgcgtctcgtctcccttggactggtagtgacagggctgccctgcacgccacactgctctcctgttcctgtagtgtcgctcatgtaaaatgcactgcaggctggtgctgctgaatcggctcactttctcccatttccttctcctccactttcagatttctttcagcactctccaacttaccttcagaaatgcaacaatgggccaggcgcagtggctcacacctgtaatcccagcactctgggaggtgggtggatcacctgaggtcaggagttcgaggccagcctggccaacatggtgaaaccccgtctctactaaaaatacagaattagccaggcgtggtggcatgcacctgtaatcctagctcctcgggaggctgaggcaggagaatcacttgaacccaggaggtggaggttgcagtgagccaagattgcgccattgcactccagcctgggcaaaaagtgcgaaactccgtcttcaaaaaaaaaaaaaaaatgccacgatgtatgaagacctgcagccccttatctggaattcaaaaaccccaaagcactgatttttgcagcccactcatttggcagcagaacctgagttatctgctcatgtgagagtgcacctttcattacaaaagtacccatgcgtttgactaggggtgctctgggacgtgggttagccaactcaggccactgccccgtttttgaacataaagggttattggaacacagccatagcctttcgcttatattgcctttggctgtgtttgtacctggtccttacagaaaaagcatctgtacccctgctctggagcggacctgccctgctttgcttgcaaggtggtccgagcctgggtggaaagcactgcagggcagcttgtgcagaaactgggacctgctctccttgtagagacacaaccccagggtacttggagctcatgctaatgactaaatcattcaagccttcttcttcctggattttatacctcctagttctttgaggacagtttgccacgttcagcaggattttccagaccttttatttctaaggaatacaaactagaagggcctggtttctgtaggtgacaaagctgggggg

SEQ ID NO: 25245 - DNA, 1040 bp, Homo sapiens
tagaggcccattacataccttttgtggattagaactgtaattgacttagtgtttaaggcagaaactaaggcctttgatttaaaaactgttgacagatcggagcctaagccgcttctgtttgcagaggagagccatgacttccagtcaagttgaaacatagctttctttatacccttcccagttggacttctgtcatattttacaaaattcaaggcttttcatttaacttagatttatggcttttccatggactatcttgaggtttttctccaaagcaaaccagctcataccttgacattgtcaaaatagcaaaaacacacatcttaacaaatgatggcaaaatatttgagctgagagattggggtatgtgtagtgttacacctttgcatgtaaaagattatgtcaagcaatcttctaaaggaaatcagtttttagttaacttttaaggctattcaccatgatttaaagtgattccttgattcctctgttacattaagtgtgattgaaactgtacctttattttctcatgccttgataagcagtgtagtcaaatcataacatattatgactgcaatcaagtgattatagcacgtgattatactttttgtctctgtggcgtgaggagtggaaaggtgtctttttttgcaccacttggcactaacggtggggagagatggttccccgaagccccctccctcttgtgtgttttggggcagagcgccctgttcctgaatagcacggattgcacgtgtttctgagcatggtgtgtgagactgctttcccttcctgcagtcaactcgccaaggtgcctccccagccccagcagtccggcttctctcctttccgctgccccatgctttctggtggcctggcagactcaggactatctctgagtccttcacaaaaccctcctccacatgccttcttttgtgaaaaccctcagtcctctttaagagcagggcccctggagccagacagctctggttcagtcctggctccggtcctctgcagctgggtgaccctgggcaagtcaccatggc

SEQ ID NO: 25246 - DNA, 1057 bp, Homo sapiens
tgttagcaggagttggcacttgagtcccacgtcctagcctcccggcatcacagccttatgctgcatttcctaaagtgctttctagcactgaccgactccaggaggcagcactggcaaggattttggtgagcctttgatggagtgtgttccggaatcgggaggaagcttgtaaggctgctttccactcattttatgttgttgggatttggctcggaacctgccaaggacccctgtgtgttaaagttgaaatagttccctagtaaactggccactttcagaccagctgcattttctagaataaacttcatttgtccttgactcataaagggaaaagccagaagccaggggctctggggcacctccaagtgggccagggtcaggtgtgggtcctctgcctgggttttaatgtaaactcagggttttaatgtaagaacctgttttgtttgcttttgtttttagaccaagtctcactctgttacccaggccagagtgcagcagccataaacatgtcttactgcggccttgaaccttggtcttaaatgatcctcttactcagcctctcatgtaactctggggtaactccaagtgggccagggtcaggtgcgggtcccctgcctgcgttggtctcactgccatataaccccagccatggtgatcttaccagagaaactcatttgaacctatgcggctgcttcaggccggtggttgttggcctgataggaagagagcatactcagcctcatactcagcctctcgtgtaactgggaccacaagcatgcaccaccatacctggctaatttttttttttttttttttttggtaaagatagggtctcagaggtttggtgtggtggctcatgcctgtaatcccagcactttgggaggctgaggcaggtggatcagttgaggccaggagttcgagaccagtctggctaacatggtgaaaccccatctctactaaaaatacaaaaactagctgggtgtggtggtgtgcgcctgtagtcccagctactcgggaggctgaggcagaattgcctgaactcaggaggcagaggttg

SEQ ID NO: 25247 - DNA, 1734 bp, Homo sapiens
tgaaaacatagtagtggcacagcctcctggagagtgcagatgtagctcatggtacgcttggggtttctgcagagcatgacatcaggctgtcttccagccttgcctcactaagaacttgaagcatgaccctcaataaaccacttttttttttttttttgcatggaaatctgtgaagaaagaaggccttgggaaagcctgtgtcctggcctgtcattgaacgtaataattacattaacaagtgaatgatttaagttctgcactctttgttcttataggaacaaggttaagggacgactgtgttgtgggttgaaatgtgtcccccaaaatagtatgttcaagtcctaaccttggtagctgtgtgtgtggccatacttggagatggtctttggctgatgtaattagttaagatgaggtcatactagattggagtgggtcctgatccagtgatcggtgttcatctgagaagagggaggttgtgacagcaacacgcaggaagggccatgtcacgatggaggcaaaggtcggagcaagctgtgctaggaagaggcaaggagggatcccctcccccagccttcataaggagcacggccctgcagacaccttgatttttgaacttctggcttccagaactgcgagggaatacatttctgctgtttgagccacctggtttgtggtacttgattacagcagtgctaacctccccacagttacccacaacctctgagtacctgtttgccgctcactcctccctctcccattgccacgtggtctctgcttttattcgttttctcagcggaaacttggaggccattggctattgtgtatcgtgtatcgtggctaagtcattacctttttttttttttttttttttttaaagaaaacccaaaaccaaaaaactccttttaggcgtcacccccctacccacttaggtacagtgctgctgctgctgcccccggcttcttgaaaccttctttctgactctctgagagagactcttgtggatatcttgtagctctggcctttttctttagctctggtctttccctctcttggctgtggattcatttcttatcgctgttgtaacaaattaccacacactaagtggcttaaaacagcatagatttattacagttcggaagctcagaagctccaaatgggtcttacgggcctaaaatcaaaggctgtgctccttttggaggctgtggggtagactcgatttccttgctttttccagcctcaatggctgctgcattcctggccttagctctgtatccctctggcctctgccgtggtagctgcgtggcctgctctgaccctgacctcctggaaggaccctgtgattacattggacccacctgtgtaatccagaatccttgcaaaacccccatctcaaaatctttcacctcttcacatgcacacagtggctttgccccgtggagccacatgctctcaggttccaggaatgagtctgtgggcatctctgggggccactgttcagcctgaatgtgttctgaggcttagtattttgtctctttgagttctacattcattttgatccttacatcatcatctgcaggggataggtgattctcaatctaggtttgggaagaggaacttaaggctccacagaaatttgagtccatttttacttaaatgtactttttacctttagaaaaacttgtaggtaaaaaccaacaggtgcattcaaaccaatcacacgccaacttttaccac

SEQ ID NO: 25248 - DNA, 1028 bp, Homo sapiens
catggtcttgatgcctggaaacagctcctgggcttctcaccagtattgggagctgactcttagaaaggcagccttcctggggagcacaccctcgaggggccggaaaccgtgaaactgaccagaagcacataggtccagtgggcactgaaatacattctcaggaaggaagtgtagctgaagtccagaactcagcttactctcactcctgggcctgctgctgccttaatgtgcctgctcctgtgtttttgttctgataaacacgtatagcactttcaattatgctgttacttacagctaagtaaagcagtactaggtggatttgtcagtgccacttcctacaaagtgaaggctggatttttgggggactcatttccagcagccaccagcaggtggagggagtgagatgcgtaaacaaactgtccctcatgcttggtgtttgggcagatgcattgctaaagcgtgctcactaataaatcccctgctgatatggcacaaatatttatagccgatgattgatgtgaaattaacaaaaactagcagttgacagcgatatgaggtggcaaaggctatttgggaaagtttccgttgtctttgaaaattaagaaaaattatacgtttacttgccttgctaagaactgtttaagaataaatcaacataaactagggcagcttcttaaactatgatggagaagcacaaggtcaaagtgtttcgtctcagaatgaagcagtaatgtattactttgcgtactgtgtacaggggccggcagatgtttctgatgttatgaagctatgctcctggaagtggttgtgaaaatcgcagccctgtgaattgtgtgccctaagagccagctgtgctcctaacagtgatgccgtctttccatggaaatcacccataagcacagccttcagtctaacttcatgtcaagtctaagtggcacagctatccatgaacactgtaaacattcccagctccatctaaggtgattaaacggagtcagaacccggccatggatgtgtattcactgtta

SEQ ID NO: 25249 - DNA, 1050 bp, Homo sapiens
ggacctgagagtctgtgtttctggtgagccacaggtagcaccccggctgctggtccctggtctggggaaaggcaggcagagttggagagacccttcccgggttcctggttgcaggtgctgtgtcatcgtatggctgtatttgaggggattgtgtaagaagatgttgttaaatttatttttagaataatagacttttagatagaagagaaacctcggaggtcaatcagctttcactcttcctctcttgtgccccagtcctagtgatgagaaaagcaatgatgtttcccaaggccggggctgtcgactgaattgtgtccctgcaaccccgtgtgatggtattaggaggtgggtctgtgggaggtatcaggtcatgggagtggaccccttgtggtggcacgaatgcccctcaggagcgcttgctctgtaccctatgaggacatcatgaggagatatggcttctgcaggaagaggcctcaccaggaaccaaattgaccagtaccttgaacttggacttccagctgccagaactgtgagaggtaaacgtgtgttgttgaagtgcctctgccggtggtctttgtgatagcagccccagccgactcatcacagccagattaagggagatcaaaagagttaaggttccagactccagctcctgagttcttctatgtggaaagatgccccttcaaccaccaaggccagggatgccctgtggttcagcgttgtcacccttgttgcccgcctccagggcagagctgggggcactggaggtgctcaggacgtgtggagcagaattgggagtgaatgttgtgtgctcagggccacctccactctgcaagcacagctcccagagatgaggacggggcttgctttgtcctctgccacacacagcccttcatgcaaggccttggcccctccagggccacacaccttggccacccagcaagcaccccttgcttggccagtctttccgtcacttcctttcctttttccctgtctcctgagcttcagactagttgaccctaaggggtgtctccagctgtaaataactgt

SEQ ID NO: 25250 - DNA, 1044 bp, Homo sapiens
tgctttattttctacttgtaatcgtaatctgagtgcaatttcaggactttgttttccagatggcttattgtttcacacgttttcttttctcagtgaagcccaggtaacctgctgcttgggtgtacgctgggcgggttcgcagtgctggaagagagagtggacagattttacaccagcacctttcatctcaggggtgcttgtgaattgattgcacccctcctgtggcgtggaggcggtgcctggttaaagtggggctcagatgccccttggttgcatttaatgtgtgtgcataatcagagggcaaggacagcagtaaataatttatgtcagctggagcccttggccctggtaatgagatctcaggggcagcgcctagagtgctgggcccttccagatgatctatgaattggtctttgcctttgtacttattcaaactgacaaatacttacttaatagctgattgtattcaggtgctaagggaaaagaacgtgactgtgtgggggtctccctgactccttagaacctgcaaatgcatgaaactcatgttaagaacagttgtggttcacgtgtaccaaacttgggaaatcctgaccagcgcatccagggttgcttgggcacagtggtccttttgcatggggtggccggccaggtgtgctgagtgccacctgggcttgcatgccggacgcatacctggcacctgcttccaggttggcctgccagccgatgttgtgatcttgtggagggaatgaccccacgtctctggattctggcttctgcttccagtgagactccgcccaggttatgtttgtggccttttatctctccaatgtgaggcatctctgatgatgcctaaggatgtccttctaatttggagttaacctctctttcccaggtgaggttagcaaatacgtatagattgtaacaagagaattttgcatttcagttttgttttttttttttttttgagatggagctcacgctgtcgcccaggctggatagagtgcagtggtacgatctcggctcagtgtaacctctgcctcctga

SEQ ID NO: 25251 - DNA, 1518 bp, Homo sapiens
tggcgcgggcctccctgtagaatgaggctcctcctgcagttcgaggagaggctgtaattaacagtgaattagcatatagtggcgccgtgtggcccgcagggtggccttgtccatctgctgtgtaggggacttaggtgacacctggctagtggtagtctgcaagaaccctttgttaatgggaatattgtgcatgagtcagaattcagaatctttggtatggttttttttttttcccccttttgtgtgttttggccaaatactcaaaagcactaagttttcttgcgtggtatctgttcatatattgattcaccaaatattgattgtacatctgcgaatgtgctagataccctactggtgctggtgagcagaaacaggcaaggtctttggcctcagggggtccttggagtctagaagggatggtgacattggccagagtcaccccataatcatacagttagcagtgtggccagcgtcacttaaagcggggaggtggctggtgctggagcgtgtataacaaaagtgggatccggaaagggctgctggcgagtgggagttttctagggagccgctgctcttgcttcaggtctcagatggcataggagtgtgtgtcatcccagaggagcagcagcaaacggcctgtgatgggctggatgtatttggggagggaagaaggcagttgtagctcaagggagagaaaaggcaaggagaaacatggcgaggggtgggggctttgctctttagcccgtgagcagtggaaagtcattgaatgctgtctggtgtaaaatctgttagcagtttcacttccatctggagcacccaggcctgcaggagtgtgggttggctctctacccccgttgcagattggcttgtggtttggggtgtgccaggctcaggggcagggccctttttccacacgcttagggaagatacgagactggctaactcagtattcaccgtgaattcttttgtgggaaatagaacacagcgttgggtaccaagagggtgctgtcttttcctgttttcttggcctcctagggaatcagtttgattctgtggctattaaattaatggtttagctgagatgttttctctactcagggcccaatgccgtatgtgatattttacaacaaatttggttcactggggccgacttgaaaatagtcaaagtccaagtaaacttctgcctgtgtgtggtgcgctcaaataaaggaggctgttcaaggtgagtggttttcctggcggtgtggttttttaaaatttctaataaaatgcaaatgattacagccccttccatgaagagtgcaagtacgcctgactcctccgcgcagggaatgagcagcctctgctccttcatttgattgctatgacaacccacagaggtgggtgttgtcacttccactgccagccagcttgcacggtccagggacgtccccaccctcggttgggttgtccagggtcacatggttgggagtcagaaccagacttcaaagggcatgtgactacagcatccatcctccc

SEQ ID NO: 25252 - DNA, 1046 bp, Homo sapiens
gcattggtgcattgctagaggaaagcacccagttcactgtgtatctctgtgtacctgtgtatttcatcgacacatcctttggagtcttaaacacagcagcagcactgttgtggtgataattacgcaccctgcatatggtactgtttaagcaacaaagagctgagacttcggaaggttcccaagggcatccctgagatgggactcggtcctgtcacaagcagctgtgggagctggagcttagaagctgtccatcaaaaaaccaagtttttgtgtcaaaatggagtctctcaggctgtgaagcaagcccatctctaatcagttcagccacctgtattgcagactaattgtgaccaagacactgcgaatcatcagagaaagctgagccttgtagggaatctggggacagccgtaagttcttcctccacattccattttagagaggcttgtgttccacatttttgtggctttttcctcatcagatttctctgtgttcttgctttagtttgaaactgagaacactaattttttttattttgatcaaaataaaaccatcttttcaaaatgtcaaaatgtttaattttcagagagaattgagtttacgtaccacgaaggaggctctgttttgttccggcacacgctttggctggttattggtgttaggatgtgtttgttccatgtacgagtggatggagcagacagtgcctggtccacccccacctcctcaccctcagcctcccccccgctgtagacagtggccaaccgtgtgtcctcagatctgcatggaatttcctgtggcgctttctcaattctgggaccagttttccctctgaagcgtgaatgtttcctctccagttgggaatctcctgcctcaggacctggtggtctagaggtactgtggtataagtagaaagagcagctggacttagagacaggcgtcctgagtgttgatgccagccttaccctgaccctgtgtgtggcagcagtgggtcggtcaaacctttccaagcctccgtgtcctcatctgaaaatgggaatgaggatgccta

SEQ ID NO: 25253 - DNA, 1101 bp, Homo sapiens
tggctgctctggcttgccagtggagaacaggctgaggccggaggaggagggagcagccaggaagctggttacaacccaggcggagggctggcgtgggcctcaggggtcttcagcctcagcactattgacattttgtgccggataattatttgtcctgtgcatgtcaggatgttcaggagcatctctggcctctacctactagatgccagtaacatctcttccagttgcggtgaccaaaaatgtcttcaggcaatccagatcaaatgtccactggggggcagaatcacctgctgagacccactggttaaaatagtgtcagtaggggtggagagaaggggacaaaagagtcttagagccatttgagagggagcttctagaggacttgatggatggaatttggtcaaggcaggaatgagggtggatgtggggcatggggaattggacggatgatagtggcccacaggttgagagaggggatgggttcagctttggccatgctgttgtgagtctgtggttcccagggagcagctgagtaggctgttgggtgagtggttctcaagctcagagctgagctgggggcatccatttgaaggttatgggaagatggaaagcacgccctggaggtgggtgggtgagctcacccaggaccacggtgtggcctgagaagtcggcctgcgatagaacccggggaatcccagtgtttccagggtgggcagaggaagaggaggctgggaagggaatttgtttctctggccagagctgttgctcagcgactgttggctggtgaggatgaggctcatgaacagatgtggaaacatcgtgggatgatctcatggtgggtgggacttgtcgccgtcatgcactcagcactctctggcctttattggtcaagctgcctgctgtgtttctggtgcccaaatgttctgggcacactgttgtttggggaagaatcgcagggactctccttcactcttagatagtggcagcgcttgcctcgctgcatctcgtgttctcaaaatcagcacatgccatcccacattctagaccatccagttttgcttctcaggctctgaaaaacacttttaagagcaggttaaactg

SEQ ID NO: 25254 - DNA, 2022 bp, Homo sapiens
atagaggtttttagagttgagcaatcacatttcttttttcttttctgagacaatgtcttgctctgtcacccgggccggagtgcagtggtgcagtcatagctcactgcagcctcagactcccaggctcaagcgatcctctcacctcagcctcccgagtagctgggactacaggcgcacaccaccacagccagctaatttttatactttttgtagagatggactcttgcagtgttgcctgggttggtcttgaactcctgaactcaaatgatcctcctcccttgccctcccaaaatgctgagattatgggcatgagccaccatgcctggctgaggaatcacattttaatagcctcacaaagaaatcctagtgttgacaatataggtttttaggtctggaatgaacttccattctagtctaatttcatcctgattttactgtccaggctcttggctgaccagtgtgtggagaccctggtggcagcctagggatcccctccaggtctcttccttgtccttactgtagaccatcacaccgccactaatttcccccctctggccaggtgagagcagattgtcaccatttcagagaaatttgaaccaatcagaaagagagctcaggagtactggggtgactgagatgagcacatgtggcttcttgaggaccttccaacccccaagttattcttagaaagctgcacacaagccaggcagctgtaggctggcgttgaaaagtttttagctttagctaattacattgtgggagagactgactggggggtgtccatcccgtgtgtgccatgctgcctccatctctttctccctctcttctgagaccttctggttatccccagctacctgcccctccacctcctgtgccctcagggtgggcagtttgggtttctttcctttttcttttgtctgctgttgtttaggattgtgaaagtgcagcagtgcactctgtccctgcaacaggctctgcggtgggctagctccagtgttgcattctcccttcatcagtggagaaatgcactcttggaaccatgaagagtctgcacatgacagctctgcactcactaacattcaagcaccttgattcagagtttcacgagactaaggtgaggttacctttccctctctgttgttcttcccgtggaaagagggttttctattcacactgtacattcagccacagctggaaacctcatcttcctcttccagttaagacagtcatgtggccgggcgcggtggctcatgcctgtcatcccagcactttgggaagccgaggcaggcagatcactaggtcaggagattgagaccatcctggctaacatggtgaaaccccatctctacaaaaaaaaaaaaaaaaaaaaaaaaaaacattagctgggcatggtggcatgcgcctgtagccccagctactcgggaggctgaggcagtagaatcacttgaacctgggaggcggaggttgcagtgcgccgagatcgcaccactgcactccagtctaagtgacaaagcgagactgtctcaaaaaaaaaaaaaagtcatgtaattgtgacctcagttcgcaggacttcggaagcagggacccctcccctgtacccccgccaaagccaccatggtagctcctcctaattggatcttgggggactcggaacagggtttagcctgagaatgtgacttgtgagaaccccagatgagagtagttacacttttctggaaggcttatttaaaaccccagaacattcttgcattggaattgagttgcattgctctctgggacgggcagtgggctcttggaagaggtaagtgaagtcactgagtgggacgctcctcgggggaggattttgtggggcagtgggaacatcagtctttcctaggctcaggagtgagtctagaggccatgtttatgcacaggaagcatctggaagcttattaacacagattcctgggccctgcccaagagatttcaattccgtggggccaagcaggccttgagactatgcagttttaatttattgtttta

SEQ ID NO: 25255 - DNA, 1101 bp, Homo sapiens
acttgctggcttgttttaaaaccaagcttgcttctcactggcctgtttaagtggaaatgaagtctcagtgtggggtccgatgcttcctatggctgcatggaggaaaggagtctgggcctgaatctcccgtgttcctcatgcatgggtagaactaaagcctcttcttctgtaatgtggcagttcccattctcagaggataaagtacgtgtgagtgatgccacctcaacccttagccaggtgcaggcgtaacaagggagacccacctgtgcaatatagtgagacccccatctttaccataaatgaaaaaaacgttagccaagcatggtggctcacgcctgtaatcccagcactttaggaggccaagatgggagaatcatctgaggtgaggcgttcgagaccagcctgggcaacatggcaagaccctcctctctacaaaaaaatttaaaaattagccaggggtggtgacatgtgcctgtggtcccagctattcaggaggcaggaggatcacttgagcccaggagttcaaggctgtagtgagctatgatcttgccactgcactctagcctgtctgtgtggtggtgtgttcatacacaatagacatcgccagtgttctgttggcaggaattgctatcgttggtccttaaggaaaaacacaggaaggatgcaggtgctcagaggaccttctggggtcttttttcctgccagatcaatgttcctgccctacagacagaccatacttgtccttcctccactagcagataagggtcaagtcctcatctcttttacagttccacgtttaaccttcagcttttaaaacgagagaaatagggtccccagtgagttcagctggagtgtcccaggcaaagggatgcgtgcagaattttcagttcctagaagctgagcatcatggcaaatcttagcttagaaaccattctaccatgacattctcagatgagaatttgagtcttatgctaaaaatataaaagtattaataagacgttactgtcttggtaattgcttcttcttacatgtatctgtcagtcaactggctaccagaaaatagcctttgatgtacccacggaggggctcttggtgggctcc

SEQ ID NO: 25256 - DNA, 1069 bp, Homo sapiens
tcctacagtcattttctcaggttcttgttattgtagcagcttgatggttgcataattattcatcatacctatcacaatttttaaatttttattgctcttcccactttagatagaagctcagttactcagaggctcaacaataaattgaacatgtagtcagcatgtgaaaaccccagggtgggtttttagcaagctcctgaaggcaggtgtctggagattagagaggagaggagcacaggggagccccgtgcccatacctgtggctggttggtggtgtaggcaggagatggtggcctggaccaccacgggcatcagacatcccccccccccaccccacctaggctcgcacaggagggacggggaggcaggagggaaagaactggtcgggcaggacgtccctacatgccccctcccttcccctccagcttttctcctactttggtggggtgttactgctggggcatgggaacagcggatgagctgggtcagggggatgggggtctagggcttggggagacctcctgtagatacaggcagtgtctttggttgcgttgtcttgctacagagagcctgatgtatttgtaagaagactaagaaggttttggatgatggtgatcaggtgcttgttccctttagcaggggaaattggggctgactttataacattggagctcactatatactagaagttgaattgtacttttttcccctggagttctgtgactcctttgaattctcacgggttaaatgggatcctggatactccctccctctttgtaaaacccctggagcattttgtggctgaaatttacttcttagagccatgaaatgccctccaaaaagtgaagcaccacatccaaattgcattccatgcccaaagtggttaacatccctcagagatgcaaactcagaagcatttttggttttgagagccacagtgctttacccataggatgggcaggccattccttctgctgactgcgtcagcagtccgggctccaggagaaccagcattcgcagtgggggtgtctgcactctctaccaagctgtccaggttcaggaattaaag

SEQ ID NO: 25257 - DNA, 1035 bp, Homo sapiens
cgagaggtctttctcaggcctcttctacaagggcgctaatctgctcccacaactgccacacctcgtaatacaatcaccttggggattaggtttctttgtttaaaattttatttattattttgtttttattttttgagacagagtctcactctgtcgcccaggctggagtgcggtggtgcaatctcagctcactgcaacctctgcctcccgggttcaagtgattctcctgcctcagcctcctgagtagctgggattacaggcatgcaccaccacagctggctaatttttatatttttttagttgagacagggtttcaccatgttggccagtctggtcttgaactcctgacctcaggtgatccacctgcctcggcctcccaaagtgctgggattacaggcgtgagccaccatgcccagccaggggttaggtttcaacatatgagtttggctgggagtgtgggggtaggacggggaagcacaaacattcctaccatatagttgaaggcttgtcagaggaggtgacatctgaactgatagtaagagtaggtttcggggaatgattgatatggaaagctttagttgcctggagacagcaaggcctgttaggatggggcttggtagctgattgactagaaggccaagcagggagcgggcagatgagaggcgggagggttgtaactggggtgtaagaggacaggaccgagcataggttttagaaaggccactctggctgatgagtagagagtgggagcggccaggactgggtgacagagaacatttggatccatgagccatcactcagacagcagaccacggtggcctgtaaatcactgagaaccttttttccacactgtcatgccaaatttgttctcttatatgtttgtttgttttcttttttgttgttgtttttgttttgttttgagacagagtctcgctctgtcacccaggctggagtccagtggtgtatctcggctcactgcaacctccgcctcctgggttcaggcgattctcctgccttagcctcctgagtagctgg

SEQ ID NO: 25258 - DNA, 1030 bp, Homo sapiens
tgacttggcctcccaaagtgctggtattacaggtgtgagctaccatgccatttaccttttttatgcttaaaataaatgtataaaatattaaaaatcattttcctcccaagaaccaaacgtgtattactaaatatgtttagttgaccatgcaggctatttgagagacagtgggagatgctgaaatattcaagcaccactgttttggtgggtatcggaagattttcaatcaatagtttacttatttggttatgtattaggttgtattgggtggggccaatcattatgtgactatttttttcttcagagtggtgattgaaaagcagcccccaaccgttttctccgagaggtgcatgctgagcctgcctgcagcttacccccaacccccagcccctagcccggctctccttgtcttacatgagtcagtttccttctgctgctattctggacaaaaacctctatcaggacagagaccttgtcttgttcaccctattcctggcatcaaggctgtgtctgacatgtaatggggatggctgtttgtttggtggtggttgagatgaccaagatgttcttgacctgtgtagggtggtagtggagaaacaggcacaggcccttgtggtgtagttgcgaaaaaggagctcacactaatgggaaccagattgtatcattggctgagtatacagcagatgcgttcccctttgttattttatcacttgcttacctggaagctctggtctgactttaggaacatgccacacacttggataaacatggactcctttactagagatttatagaatctttttcctagagccatttgagaagcacttgtccaagacgtgctattttataggctattttgatgtaagggaaaagacgtatcctggatcttccagaaagcatggaattatggctgcgtattaggaagaggcctggctttcctgtgggaattgaacagaagacaggcatctctcatgttctggttgttgcagttttgcttcttctgttcattgaattagcgtttcagagctct

SEQ ID NO: 25259 - DNA, 1048 bp, Homo sapiens
ttgtcctacttacggaggatgggagtccagggccaggtgctggtgggtgtggtgtctgctgagggccatcctcctagtgggatatgtgtttgcatagtggagaacagaggacacaagccctcgccagtcccttcccataaaggcacttaacccatcacagggttccacccttgtgatcagtcacctggcagaggccccacctcttattcccctgggggtcaggatttcagtataagaatttgggttgagttccataccacacccagcacgttcaaggcagaggacaggcagccacccacctctgtgttggaagcatttcgttttcttcaggttgggggtggcaagaggagaataaggactgatatttctaaatattagtttaaaatattcagaaaaagcgtttccgttactgtgacagctcatgtcgcacctccccaggtgatgctgtgatgagtgtccgttttcatgggcacaggagatttccgttccagtttcgtattatagaaataatacactctcattatgtattcggattttggctgggcgcagtggctcaggcctgtaatcccaacactttgggaggctgaggagggcagatcacctgaggtccatagttcgagaccagcctggccaccatggcgaaatcccatctctactaaaattgcaaaaaattagccgggcatggtggcaggcacctgtaatcccagctactcaggaagccaaggcaggagaatcgcttgaacctgggaggcggaggttgcagtcagctgagattgcacaattgcgctccatcctgggtgacagagcgagactctgtctcaaaaaaaaaaaaaagtaggattttatggaatttgaaaagcaaatacctgtgaagctacaacttccgtgactattgcgatttttttgtccttaaaatattttcatatgaagataacatttttaaaataaaatcagttactttgtatattttatatcatagttatatggtatatggtttcttatttgtatatgtattttcatgtaaatcacaaacactctcattgttagt

SEQ ID NO: 25260 - DNA, 1075 bp, Homo sapiens
tagggcattctgtggggagccaatgggtagagctggggcccaaggttcaggtgttgcagtcgaatcagtaaactccggcggcatccagggatgtgcacggtgccggggcacattcacagaacctacctgcaggtgggcacggctttgtagagagggtaggcacagccgccgtgggatgaagcctgctcccagcactgttagcggttgacagtgttgtcggggatctgggcagccatgtgggccaggccccagtttggccagcgctgcagcttcctctctctgattcatcgagttcccagatctgtttcttacagaagaagaaacacctgctgccgaaatacagtttgaaaaaccctgatctcagaaataggattcctgatgacagaccttagcaaatattccaataattataccaactgtactaaagatcccagtactcgagtaattcaccataaatgagtgaaaattattcaactggattagaaattgccagccttggatccttttctcagatattttgttttcctgggtattttccctcttctgggttcttagtgcccgtcccccgtagctccgtcacacagtcctgttgctgctaccttggggcccaggcgtgtcttttgtcccccagtgcctggcacggtgccctccaggagtactcctgggattggtggcaggtcatgcagtcattgctcaccagagccaggacatgcctgggctgctgagtggggcgtgcccaactctttctgctttgagttttctttttcctccagtggcaaggtttgcgtggtcttcactcttttgcagaaaattgttggcattgcatcattggcttatgctactaaataatgttttaaggaattggagttttgcgaggagatggtgacaagcctcactcaggtctttggtttctgtcctccttcctgggcaggccctttgcccaaatggttgttaaagaaatgcaaacagttagttgttccgttcatgctgttgcgtgagataagttaggatgctcttgaagaagtttagtgacattcagaggaaatccttccaacacaatatacaattaattgct

SEQ ID NO: 25261 - DNA, 1047 bp, Homo sapiens
ttttgttttatttggttttatttgtttttttggagacaaagtcttgctctgttgcccaggctggagtgctgtggcgtgatctcagctcgctgcaacctctgtctccagggttcaagcaattccaccatgcccggctaatttttatattgttggtagggacagggttttgctatgttggccaggctggtctcaaattcctgacctcaactgatccgcccacctcggcctcccaacctgctgggattacaggcgtgaaccaccacgcctgaccaagtcctcatgtttctaaaaattataccactaaatagtgtagatcctacctaacctattttcaacattgaaaaattctgccttcttgcatttctagttaaaatgaaaaaatagaatatatgtgtgtttctataaatagcagatttaacagtgtggctggagggtttgagtctctaagcttccagtggaatccaagggacatcgtcctaccagtatgccgcgtgatatgtcagatcgtctctggccgtcctttgtacccaattgataacattttgttttccatttttggccttttcgtgttactcattgaggccaaaaattcttacacaaggtaaataaatcaaatccctctggtttcctcagcaacagtaagtcacagccgaggactcagtaggagaggatgactgtggggggtcatgaggaatgttcttttacttctactaagaaattgaatttcattattatattttataaatattttcttctttggcttataacctgattgcgggcttgttgctgaggtcttggaaggtaggtagggaggggcagggctggagaggcctgtttcttctcaggtgtgcctgtggccccagatggaaaccaatcaaggtgcgatttatgttcattaagtgcttgtcaaaactgaaaaattttctaatcaacagcaatctagctgcagccccctcgatggctgggagggccacctctgccgcatcggctatttgcctgttacaactctaggctaaaaatccgctgatgattacattaggctaagct

SEQ ID NO: 25262 - DNA, 1023 bp, Homo sapiens
gatgtttaacattttcaacaggattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcaggtaagcttacagcaaatgcactaacaaatcaagttcaacagcaacaggtggtccaggctcgaggataatgttggactcctaggttaagtggagacagtaactatcacattacagattaaggtttagaaacctgatcacttctgtggctgatcatttcctttaaactttcagttccgcaaatgccagcgagcaaatggtgctttgagtcacagctgcaaaaaccatgcatctaggcctttccagggctgcatagtggaaagtgaagttaacatgtgaactgggtttttaagatccttctgaaaaacgtgaattaacgttaaagtgtcaaagattaactcatttctgataactgtatgtatgaaagtggaaaaaccattcggagcaagattcagaggaaaccatttgacctatataaaatgtaaattctgtgttgttatattttaattatctgccattctttaatgcaactttagttctctgtattctcttttaaaggagattttttttcattcaggatcagagaaagctgtattttctcaaatgttgatgtgtttagaaattcctggcctctgtgcccagttgcaagccatccaaaatgacattgttcattttatttacgtttttgcaaataattgccctgtgtcatgaaccttcccatgtctgctcatcagagataaggagaagatcctcttgagccctcccataaacacacacacagagtcaggctccttcaacatggggacatcccttcaagaatttgcattttctcctgcagaaagtccagaactttcttctctcccacctacatccagtcttcttaaaacagatttctg

SEQ ID NO: 25263 - DNA, 1030 bp, Homo sapiens
agcctgtccaacatggtgaaaccccatctctactaaaaatacaaaattagctgggtgtggagatgtgcgcctgtaattccagctactcaggaggctaaggcaggggaatcgcttaaacccaggaggtggagtgcagtgagccgagatcgcaccactgcactccagcctgcgcgacagagtgagactccgtctcaaaaaaaaaaaaatctatcaagcacctattttgtgccagaagttgtgcgcactgcagatacggagtccctaacctctagaattcttccatttccacctcccttctgaccatcacatctagtcatctagttacataagtaaaagcatttattgagtttcatttttataattttaaattgataaaaatgtattaaatagaattaatttaacttaaataaaaatttattgatctttgtaacatggtgttttgaattatgtatacattgtggaatggctaaatcatgccatttgtggagtttctaacgtgtgcctgagtcacagttcccgccttcaggaatctcccctgttgttggggagaaagacaagtagatggaggccacacggagccacaggccccaggagggctgtgtaaagggcagggcttggagacccagtgatgctgcggtcggctccccaggaggtaggccaggcttcaagggatgggggctacctgctgagtttgaataaaggataggaatttgccaggcacacagatatgaaggaagggcaccaattctgtgaagaagcgttcactatgtaaaagtaggattttgaacttcctaatcttgagatttatgttccttggagccaaatgccactgttgtcctaagggaaacactaatgtgtgattttaagtagataatacaaaggccctataaaccgtaccatatctgatggagtcggctgtggcatgggcctttctctttgagggagtgagttgtgtgtccttggaaggcatttcccattgcccagtttcattctctttaagagcccctgttgggcaaatgggagggttgcg

SEQ ID NO: 25264 - DNA, 1031 bp, Homo sapiens
ttcttattgatatctgagaactccttgtatatttaggatatgaatatattttgcaggtatttccccagtttattatttgccttttaaattttatggtcttctttacataaaaaggttttccctcttttttatttataatcagattatcttttactgttgtgatttctactttaagctatttagaaaacctttcataatcttgaaaccagatcacagtttacatatatatacttctaagttttaattttattgtttttttcccttaaaaaatatatgtatgtgtttatgtgtgtgaatatatgtatatgcatatatatctgtgtgtatgtgtgtgtatacatgtatatgcatgtatttagcccctaatccacctttaatttgtttgtgtctattgtgtgtgatagaaatctaattgaattttttattcaaataaataatcaactgtcgtttttctctttgttgaattttttttctttccctattaattccatatgttgcctttgttgtagaactcaatcacttcatcaaatgggctgtgtttctggcctctcagatgtgttccgagacctggtgtccctgcattgtcttaccttatgtagatttaccacagtgtcttagatgtatgactccgtttgtatctggtagtataacacagttgaatatttctcttttatcttccagtttttcttggctactgctgcctgcttatttttcctcaaatgaactaaagagtaacttgaaaccttctcctccttgataaaaataatcccctcattggtgcacatgacatcaggacctcccgaggctgtgatacgggcacgtaaataaaataataaaaataattctatcatggcttttaactggcattgcttttaagctatgaattgtggaggaagtggcatctttactgtgtggagttccttatcgtggaacactgttctttcccagtttattcaaatttgtattatagcctccagcaaagttcagcattttttttttttatttagctgctggacatgtcttgttaatct

SEQ ID NO: 25265 - DNA, 1075 bp, Homo sapiens
gcttccacagttattttcacatttaagtagagagcaggaaaacataatgtccaagagcaagggtttcggagtccaaatcactgaatagaatcccatttctcctgtctcagacccttctgaagttgtctcactaaaccccagcttccttgtttttaaaatggggaaatgatgtccacctctgttctatggagaagaacacacggcattcctttgaaaagcttggccgatgctgacttcacagaattacatcattaattcatcatcatggttatgccaaaagcaaggaagaggggaaagaaattatgttcttgaattaatttttcaaatacaataaagcattgacatagcctttgagtggacataatggacatagggcttagacttcacaaacccatgctccccaacagacagcatcccactatcatggcagcaagggggcagacagaagaaatgctcttctggactttcatggatgtccatggagctgtctgctccagttctgtgtcctgtggtcactttattctgtaactcctggttgtgacatttttgttctaggatgacagataccttcttgtctctaaagtgtgtctttgttgggtttttgcaactatggatatgtttttatcctaaccagattgatgcttagacctttgtcaaaggaatcctttccccttctcctctacatcccccccttccctacttgaggcccccagcggtttcgaaatattaaagccttcaggagggttgaagctgattttccaggggaggtgggggaggcggggacagcaaatgtgttttgagtattgaactgccgttgacatctaaagtctcaaccatgctgttttctccacacttcagcaatcaggacatccagcaaacccataaaaaaccaaactaatagcatgaatattcagtgacctagaatactaattattgtcatgaatattaatgtgatcggacttgctctttcctctcctctttctctctcgtcctctttctccctctctccctctctttttttccacttagccggctctaaagatgggtcataatgagagcatttaagagggagcgc

SEQ ID NO: 25266 - DNA, 1050 bp, Homo sapiens
cttcgagctgacctggactgtgtttagaacagtgtttggtgcacttgtatcctagcttgtcttgatgtcaggatccttacccctcaagcaatcaaaaaagttatccagcttgtttcacaaatgagaacttcagaccttcagccttaattaataactcattaacgtgaaatgaattccagtgagtgaaaacagttgccctcgagtactttgagtgagaatacagtgattttaaacagaggctttttttatgcttaaagatatttccaaaagtgttcaaaactcctgtgtggtaacacatagggcaggtattgcttgatgcttacataacaaaactggatgccaggacagcattagtaggtcaattagttaatgacattcattcaagaacagaaatgagattacatattagactctgtatgcatatctgtatcaaaaaatgcatgagaaagtatgacactataattggatatggaatgtgcatgattattaaaaagattcactccacatttgggggtggttcgtttctttgacgggtggatttactgaaagtaagtggaaatgcctcaaaactgtggccactggcctgggactgctgacacatggcacgagatgctccatgggcgtgttaacccagcatggcagcttccacagtgtcgtggctcaggtcgtggaccactggtttgcctcagagtttaagcagatgtcttcatgcatttacgttgaaaggcaggtactgtgtttggatcccagaaacaatatttctgaccctgtgtaattttttttagtcaaatatgtttctgcattatcacacaaaatacttttgttttcttttgttggtttttctgaaagaaaatttaagtgatctcaaatatagtgaatgggtatattttgaaacagagatttactcccttaagagaaaatcggaaatgttttgcttatggaatgagcctcctcctccgcatatttttggaaggtcctgaccagaggtcaagagtgaggtgggttgagtgcagtggggtgtggggaggcaggtgtgagcctgggcaaccc

SEQ ID NO: 25267 - DNA, 1076 bp, Homo sapiens
tgtgccagcgtgtgggtcccatagactaactcgcgctggtttctgtggtctgcagtccgcggtggtgttcacctgacttgtttattcctagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtggtaagagggggctcagccccacggacccgcagccacctcaaggtccttcgttgtaagccaggggctggacaggacgccctaagctctcatgctcctctgggagcgcagcaccctgtggggcggctgcatcagagactcacatcttgcctttcatctgtggaacgttttgtccttgctaggctgtcttgcccctgtcatctcatctgttcctctttggcacagggaggaggtagtcatcccatttggtcagtttggaaactgaggcggcagacagggcaactggcttacccagggtcacgtgacagaagtggcagcgctgagaaataagatctgattttatctccccaatcacactgccctacgtggcgtggcccacactcttccaccactagtgcacattttatatcattagggtgaattcagtctccttgtctgttttccagaattcctggtgtaccctctaaattctggagtcccctttgtaatccttcagttttcaaattcctttggcattattattattattattattttgacaagtgtatccagctttttggggaataagcatgcacgttggaaacgatctcgccgtctgtgtggagcgtgaatgacgcagcaccgagggcaccctggtggctgcagcagggtttgcctgtggcgttttgtctctggcctgttcaccggtatttaaaggaattcccactgttgtatgtaatctatcagacggggttttagagtaatcttagcataatttgttctaattaaaagattcagcatcaggtcttccctgtagacccaccagctgctgcagcaggacgtttgcttt

SEQ ID NO: 25268 - DNA, 1090 bp, Homo sapiens
tggccgtcctgtcttacttcaagacaagatgcacgttgagatgcgtcacacctgtcctcagggccagagtgctcacctgcctgcctgcctcctgagtacctgggtgagcctggcccggccctccccgctggctcctgcctgggccagcctcgtcgggtggtctcagctaatgctgttgccatggcagcctcgctcccccagccctggactgtcaggttcttctgatagctccaccccatccccgattgcttcagtccaacagtttatcttctgccacgctgactggccatcactgttaatactgcatttcttcacgtgactcttccatgtggctcttgagcctcacttccctcggcctcccccaggccaccacgcagcctcgtcaccatcgagcacaaacaccatgtccatcttccacatggaaggagtgtatcacatgtgtgtgtgtacgggtgtatgctctggtccctgtttccttctggccacgtaatcattatatctttccagtagactctgtggttataaagcagccgatcctcaatggaaagcatttgagtttttgccagcttttaaatgtcttttctcattataaaaatgttttgcacgtcgattttgatgatgggggttcgaaacatgagtttcagcttcggaagctgtctgtcccacacttactttcggagccaatgcatttgaaccacactttccagcaagcatgtccacaccattcatcaattttaatcattatagttggagcattttttttctcttcttggatattatactgacaattttagtgtatgaccagcaggcggcggtaatgtgatactgccggtctctgacctggaagcttctttgatgggagggtatcagtgaagcgtggtggggaggaaatacatgtgttgacagcctccgctgttgtgaccttcatgcctaacactcgtttccctggggatcatcatctctgataactgagcttccaaaaggctgagaaaccaagaccatacttatcattattagccaaaattcaaacccagatctttctgatttcaaagcttgtaatcattcccctctgcttttttttttttaagga

SEQ ID NO: 25269 - DNA, 1051 bp, Homo sapiens
ggctgctatccaatactgctgtggcccagattattccacccgtggctcctgggggctcctctggctgctcccacaccctttgccctacaccccatctctgtggggtttcttttgtttgagcactttccttcctttctgtcagtacaaggtgcattttgtatctttcctgccacaatcttagaatcggctgtttcccaaagagctctggttccttttactggagaatggtattagaaaccagtgtcttggagctaggcgtgctcgttgcttctggggtgccatttcttggttctcttggccaacagagtaaagaacgaaatgtgtgtatactaacctgcatatgcatatatatctacaaatatttctatatgtaaccatctgtatctatatttaacagatttcatattcttactggcataaaattggaaataactaagtgttttaacatgaggaatggctacaactatgttaatactacctccatgatgcaactgttataagggacaggttggaaaactgtggaaacataatactttacattaaaaagtagtattttttattgtagagtctccaacaaaggtctctgttggagttacgcttacaatgtgatagttgtgtgtgtgtacggatatgaactttaaaggaaaaatggaaaaggtagataagccatggcttattcatattaaactaacataaaattaactttgcttctgccataatgttagtcttccagtgagttcttgctgaaacctgaatgaagttgatgtatttaattttaaatgaaagaaatgagacactttttattccgttgttgtgttagccctgcagtgctttttcaggccctcccagattaataatgaccttgtttactcattgacagtaaccaaagagcctgctaaaaaagttgtgaagttaaggtcaaagcagttttatgggaggaaatctgtgagtgtttaaaggaaggatttccataatagcaagaagagcccaaagttgggaattcttcttttgcttttccactctgatctttgtattaatgcttgattgactg

SEQ ID NO: 25270 - DNA, 1023 bp, Homo sapiens
tataccatgtgaatgtctttatcttcctttccaatctctcggtctttcattcccttatttttgacttaatacactgggtagcagggatggaaaaaagcagttacagtgggtgtccttgtcttgagcatcctgtaactgagtgttcaaaggtatgtttctgacatctcacccttaggattagtgacattgtggggtttagggatagattatctctgtccaaggtaatggagtcctcttctattcctcgttggctaaggagttttaatcatgcttctttctcttattgattttttttctttcttctggttgagaaattggacattctacttattttcttgcagaggtttaccacatggacttaatttacttaccaacatgtgaagtgagtccttacctctcccagtagagcagtacaaggccctatgacatcgtaactcccatgtcctcaccgctactctcacgttctccagcattttgacctttcccatggtagacattgtcattagcagtcatagtcggtattgtttttatttagttttttttttttgtttacatatttatcagttcatttgctcaccaacctgtctttcacaaacctgccttctaggatcttcctgaaatacatccttttttctttttttttttgagatgaagtctttccttgtcacccaggctggagtgcagtggcgtgatctcggctcactgcaacctccgcctcccaggttcaagtgattctcctgcctcagcctcctgagtagctggtattacaggtgcgtgccaccacacccagccatttttttttttttttcggtattttagtagagatggggttttgccatgttggccaggcaggtcttgaactcctgacctcagatgatccacctgcctcggcctcccaaagtgttgggatcacaggtgtgagccactgtgcctggccctgaagtatatcatttagtaatttccctagtggacgtctattggtaataagcacttttgggtgtttttgcagaaaaatatattttg

SEQ ID NO: 25271 - DNA, 1032 bp, Homo sapiens
aaaaaaagaaaatttaaaaaaaaaaaaaaaaaaacaggcatggtggcatgtgcctgtggtcccagctactcagaaggctgagttgggaggatcgcttgagcccaggaatttaaggctgcagtgagctgtgatcgtgccactgcattccagcctgggtgacagagacctcgtctcaaaaaaaaaaaattatatatatatacacacacacacacacatacatacacacacacatatacatatacatacatacatatatatatagtgatccatgcaaaatctgcagcaggggtaggcagacaggaggaagtgggttgcagggtcaaggcaagcctcagagaaaaaaacctgagactgagtggccctgacaggcagttggtgggacagggaagggggtggtacagacggagggaacccccatgcaaaggtataaaagaggaccccccaatatgctaacatgtattccactgttgctgaagactaacactcaaggcactggttaccagggaatgagaacttgtgttgagtttgagattttacttacctggcaagttggccttccagtttcacggagctggtctaagatatgagacttcagggtcagagacaaagaaaaatccgttattcacagcaatagcagtagccagagtattagcatttgggtcatttcccaggtcccagtgcccatagctgtgatgtagtcagggccccatggcatccgcacacatcaagggctgcattgcaggagaggaaccctaagcttaggaaccaaatcttctacagtgggcacaaagcacatttgccctgtgctctggagggagatgctatctccatcatccaaggctgtttcctgtgcatgttcttggaaagatagttgggaaaaaaggcaggcagagcctctgctggaaagacacagggaaaggagagagaagaattgttacccggcaaagatcagactgcctcctccaccaagtctctggtctagattctgtgagtccagaaacctccatctcagtctaggagggacagctagga

SEQ ID NO: 25272 - DNA, 1030 bp, Homo sapiens
ccccatctctactaaaaaaatacaaaaaaattagctgggcgtggtggcgagcgcctgtagtcccagctgctcgggaggctgaggcaggagaatggcatgaacccaggaggaggaggttgcggtgagccgagatcacaccactgcactccagcctgggcgacagagcgagactccgcctcaaaaaaaaaaagaaaagaaatatggtgcttggttcttaattttgcagcattcaggacattaaataagtcatttgctgtcaccatcctttcaaaaaaaggacattttatcatagggaggccgtaacatcagaattgccctacagattcaaaactggctttctgagaacctcactatatggttttttattgtttctcagaggatttggtgatatctttgccaccaagtgacacttgaaagcagctgggctctccaggatcagctagagaatttgaggcccatttcaatttttatcaagaatttgaggctgggcgcagtggctcacacctgtaagcccagcactgtgggaggctgagacaggtggatcacctgaggtcaggagttcgagaccagcttaaccaatatggtgaaaccccgtctctactaaaaatacaaaaattacccaagcatggtggcatgtgcctgtaatcccagctacccaggaggctaagacaggagaattggttgaacccgggaggcagaggttccagtgagccgagatcaggccactgcactccagcctgagcaatagagcaagactccatctcaaaaaacaataaaaaagaatctcaagatggtaagagcagaaccgagcatgggccccttctgagcactgggcctttgcaaccgtagagatccacacccatgcagccagcgttggactaggagacccctgaggccccctccgtgcccctcttctaaggttcctttctcaccaagaagctcagcagagagttttgattttgcattatcaaagtcagtgacattgagcaagttaaactctgtgtcgatggtagaaaataaaacatctgac

SEQ ID NO: 25273 - DNA, 1030 bp, Homo sapiens
ccaagacagagcccggtgcagcctgcatgtgatgattcgcccccaccctgggtccttgccacagagattgaaataaaagctctctggaggccaggcgtggtggctcacacctgtaatcccagcactttgggaggccgaggaggacagatcacctgaggtccatagtttgagaccagcctggccaacatggcaaaagcccatctctactaaaaatacaaaaattagccggacgtggtggcacgtgcctgtaatcccagctattcaggaggctgaggcaggagaatcgcttgaacccaggaagtggaggttgcagtgagccaagattgtgccactgcactccaccctgggtggcacagcgacattccatctcgaaaaaaaaaaaggaaaacgaaagaaaagctctctctccccacaaccctgacttgcacattttcttctgtaaacataaatgcttctctccatcccccgttccctccctcctgatctgttcttcactctgccttggttctgtcgtcgctgggttggctgtcttgctgtctgtgcagcacctgctttctgttcacaggtgctgggagttgtatgacgctgggcaaactgggagcagcgtgggcatcccggcccaagctcaggggctcaggaggcaggaggcggcactcgcattcacacgcacacgcacagaacgctctcccgctctctcagtctggtccctgggcaggttgaaggcagctcagcatccatctttttccagagaagagaactttggccctgctaggttgctggccggccaccttatggccccaggcctgtcctgaaggcgggggccagattgggagcccccctgcttccgctctgcagccctgtctggctgaatggtgtaaaattccctaagtctttccttccttcttgctgtgtttcaaagaaggaaaagccgggtctgtcagttctaggctctccactgtttttccccttttgaaacttgcaataaaatctacctgtctcttctttcctgcagcctttcttttttcccacg

SEQ ID NO: 25274 - DNA, 1080 bp, Homo sapiens
attctcgtgggccagggataggcaacgcgtgcacctagacctcttgcttgcccccacactccgtctccccagggccaccccctcaacccccccatgccatcagagttttgaacaccgctggagatggcgggggggaggggggcgaatttggaggcgggacccgaactgccggccaaggaccaagggctggcctcgcccttcgctcccactgggcaccgttctcgccgcgggaccttgccttgagcgcgccccctgcgggccgcggtggggattggccccttggaaagagggaaataggctgcgcgcgccggggcgggagaggcgctgcctccagtcctcccgggtgggggtctcccctccgagatccccgagggaacccgtcccgtgcactaccggatttccggtctctgaccagctggggcttcatttctacgcgtgcttttactgctctcctcctcctccggcggttttttttttttttttttttttttgaaaggagcaaacatccccagctttaatgcggcccaattatctcgtttgcacgacttaaaatgtttctctttaactcatttcaatctagtaaatatgcttcagcaagtagctaatttctcagggatggcttcgcctcgccatttgcatataaagcgcgtcggggcccggccccttctccgagtgcgcgagtcccttcttccggtgcgcgggtggcaggcagccaggcctcctagtccagggaggtcgcctaggtttggcctagggaaggcggagtctggggtccgcgacagtgcctggggaccagggtggcagggagggcagggaaacttgggccggggagggaccaggaccttctgagccccccaactcccccgcctccccggcctccgccgtcccttattccgaggaggggcgcccgtggggtaacacgttggcgcgagggtcgggggcgcatttatccttaagtgcgtttattaaatcgcgtctggagatggatggacgtggatacaggagaggaaatctcagggctcagtcgagcaatctcctggctttaaattccgaataaaagtctcaaatattcccgggtca

SEQ ID NO: 25275 - DNA, 1089 bp, Homo sapiens
gcttctctgccttcctacctgctgtccaacaggcccagccccagcctgccctgacatcttccagaatccaaacctgccagaatccacagcctgccccctatgcctgccctcggtgccctgtccctgcccccagtgttaactagcggtcagccaggcagaaaggcctggcactgtcaacacgtgggcttccgaagccgtgacactactttgattctcactgcagagcactgcgccggctcggaaggatgccctgtgtccgcctgccgcgacgatggtgcctttgtctgggcatggggagctgtgatttatgtcataagctcgctgtgaaaccttttgcctcggtaattctgcgctccatgggtgtctctttacatctattcacagtacggctgctgcccacggacggcttgccctgtgacagtgctggtgactctacgctcggctcgccatggcgcccgtgtggtgcctgcccagcatctttgtggctggctgcagcgtctgttgctttgatgtcgcacatgattagatgccgtccctggaggagcgattgcagggagactgggtggaggaagaggctgcctctagctttccacagagttttgcttcggttgtggggaccaagctagaacattacaggcactgctgcctttgcttgtgggattctcagcatggtgaatgcatcctcatccaccatcctctcctggccaggtgtaggggtacccactggaggtgtgggggaatcccagtgcaaaaaggtggaatccttatttccaaagatttaatgcaggccatgagcctgcagtggctggaatccctttcattcattcaacaaacactgatggaaggtctgtgcttgcaggcgccatgttcagggaggcagcggtgggcaacgctttttgcaaaagcctcaaggtattaagatttctcaagaaaactccaattccttccaggatgggtgggaactgacaagattccttgtcaagcacttcccatggctttttggcccccaggtacaacaaatctaaacctacccccaacctgaatggaggatgagttgcaccactgactgaccccatttctgtgtggctg

SEQ ID NO: 25276 - DNA, 1041 bp, Homo sapiens
tgagtgatgttattctccaggcataaggaaggatgtctgagttaaaggagcaggggatatggcccatgtgtcatggttcgccctgcatcaagccttagatgagaagtctaattctgcaaatggaccccattttcacatgtgtgcacatgtccgtggtgtgtttacccacactcattccccacctatacatgacgctggtgagatctcttaataaaaactcaattagtatttctttaactttcctctgggtgcttaaatactattaccccaaacacaacataatgcctctatttttctatttcaatcaagaattcaagtagcatcttgacttgtatataatatatcagcagcaaaatcatggaatgctgacatccttaataatagcaattagtaatcagttgtttcttaagtcgtttgattacaccagttaccaaattgtacagttgatgcatttggggggcgagatgggtctcactgcccctcccccagccgtcctttctccctctctgtgttctctgcagctactaaccaattggtattgaaaagaggcaagcacaaataatgcagttgttgctaatattaaacagtagagacttggctttagcagaaagtagaattaaatatttctttgcagaaacccaaatcccaatagtgtctgtggaaatgcagtctgtgcccacccagctgaaggtgagcaaaggagcttagctcttccatgccaatcactgcacccagagtccaagctttctctcagggttaataccctgtgctaggctctggatataatcgagtgttaggcgaggttctggccctagaagaggtggcattcaggtttgaattatccagttggtatataaaaagcagcctagcaaggccatgcacttccgtaatggatggagactaagggctttatgctttcatgcagggaggatgcacgatttctgtcccagtgggaagggatggccttccagtggacgtgacctcccctgcatggggtcggaaggatgagatggcaaaggtgagcagaggaggtgcagccct

SEQ ID NO: 25277 - DNA, 1578 bp, Homo sapiens
gtcgggaaggtaatccgagttggacattgttacgtcgtttctgcagtgaccagcccttcttttcttcctctaaagcgactccaaagtcagcagctgtccgtgagagtggcgtgggggctgctataaatagcagcaccctggctcctcttacagtccctgcggagggccacctgccagcagggaggtgtgaagtaatctttccagaggcctcagcaaaggattattctagagatgggggcagcagacatgtttgtgagtggtgcaagaaggagagacaatattttcaaagacagctttcatgggtattgttgaataatatcttcttttatcaaaagtgaggctctctcctgaaactttgaaaacctcttcctggcactgggcttggacctctattctgtggaaaggaacattttctaatattctaccccttgtgttccttcacttcctctaaaaggagcgtctggtcacctgcaaattggacatgcctcaaacgcatagaatggaatggaatctttggtttccaaatgcagagaaggactggctgatctcaggaagacggaagcatcacagaaaaacaaaaaaaagtaacctaaatattacctgtgacctccctatgcctcaaggctggtaaactttgctcaaagcctataattccatgacttgtggaagtgtggagccctcagggggatttctgtgcactcctaggggcaaaggtggggctttctctccttgacctgtgtcttcagtgtgcttgggtctctgtgtgccaacctgtgcataagcacagctgtgcctgaagcttctctgctgatgccaagtgtgctgtggtctctgagggcccagggcgggccgtggagcttacagggcctccttcgccttgccttctatctcgccatcttttccattccttactttctttcttctcccctgtgcttaattttatgtctcaatttggctaggaccccagtgcccagagacttggcccaacactagtctagatgtttctatgaaggtgtttttgggatcagattagaatttcttgaaccggcagacttggagtgaagccgatggctctccctaatgtgtgtgggcctccatcaatcagttgaacgtctgaatagaacaaaagactgactttccctgagcaagaaggaattctggcggcagacagcctttggtctcaacctcaggtcttccctgggtctccagcctatcagcccaccctgctgatgatggatttaccaagtctgcacaatagtatgagccaattcttgaagagaaattctctctctctccctacataactgttggttctgttcctctggagaacactgactaatacaccctcttcctcctttcagctcatttgtgtgattttccagcttctgttccatctgcacttgaggtgccaggcactgtagttcctgcccaacatccattctccttccacctgcccaacacagcctggctttcttggtgggggcactgtgcccagcccctggggatgagtcatgttgatttaggtcagtagtgtcagtcccagtctcctttgcctgcactcaatgtccagtctccctt

SEQ ID NO: 25278 - DNA, 1020 bp, Homo sapiens
aactttatggccaggcacggtggctcatgcctgtaatcccagcactttgggcggcttaaattagctgggtgtggtgggggcacctgtaatcccagatacttgggaggctgaggcaggagagtcgcttgtacccagggggcagaggttgcagtgagcctagatagcgccactgcactccaacctgggcaacagagtgagactccatctcaaaaaaataaaaaataaaaaacccacaactttattgagctataattgacatgcaataaaattccctcatttaagtgtaaggttagagttttgacaaatgcatgttgtcatgtacccaccgtcacaattgatatataggatgttttcattacctcaaaaacccaagtaggaattaaaaaatattcttcccccactctgacccactgctgtggtctatttttgtgcaatgtgttggcatcttgcttggtgcagtgtaaacatcatagaacctgaggccagccggctgccgaagactgagtgtagcagtcagcattcgcaaaaattctgaatctaaatagtgcagaaataaaggacttattttatcatctaaatcttaaatggattaacttacttcccgagtaggagtctggttcaggaaacctccctgaatgtaacgttgagagacagtttttatgaaaggacatgtttatccccattggactaagtatctttcagaccaatacagttaatggaatcttggtttgagctcggccacagattactggctgctccggtcctgggctccattttgacagggctcaactccctaaccactaggagacacgacatggaacctccctgaccactaggagacacgacatggaactctttcctgggatgaaggacagatcacatctagggcttccaaactggcacaggccacacgagaaagctgggtgaggctctcttcaggaggccgagagatccactcacagctcttctgcttgtgccttgccagactcagagcagcaggggagagaggaactattttga

SEQ ID NO: 25279 - DNA, 1034 bp, Homo sapiens
gacaaagagaatatattaaaagcacagagggaggacccggggggacattatcttcaaagaagtagtggtaaagccagacagtgaaatggcatttttaacatgttgaaagaaaaataaaatcctaactgctatatacaaaagatcctcttttaatatttctgtgttcttacatttaaaagttggaaaaagatataccattgcaaatactaaccaaaagaaagttggtgcacctttgatagtaagagttggccctccatatctgtgggttctacatctgtgattcaatcaactgtggctcaaaaatatttgaaatttttctaaaaaaatacagcataacaattatacattgcattgtattaggtattaaatctaaagtatacgagagaatgtgtataggttatttgcaaatactatgttatataaaggactctgatctacagattttgtatacttggcagtcttgaagccaagtatatcccctgtgaatatcgaagggtgattgtattaggcaaagtagacctcaaggcaagaagcattattagagatagaaagtaatttttaatgaaaaagattgcatatagtttccttctgtaacaaattactgcaaacttaatggcttaaaacaacacagatgtattatcttacagttctgcagtccacaaatctgaaatgggtctcactgggcttatgtcaatagggctgcatatttttctgtaggctctaggggacaagctgttaccttgccctttccagcttctagaggccgcccgcatttcttggctcatgcccctctttctccaccttcaaagccagcaacattgggtagagttattttcacactgctcgatctctggttctctcttctgcctccttttttccactttgaaggacccttgtaattatattgggcccacctggaaactcaggatactcagtctattttgaggtgagctgattagcaatctagttctgtctgctatcttaatttccttttcccatataacctgagattctacggattcaaatatagacat

SEQ ID NO: 25280 - DNA, 1034 bp, Homo sapiens
gagaagaagaaacctcccctggctgtcagaattaaagaaagtgggtagcaatgtaaagtatgtaactaggcggtgggtaaatatgagagcttcttacacgcccctcccggtaaaacccagccgtaggtgcagctgttactagtgctgagtagcacagattgatagggttggagggagcaggtgtgacatcttatgttttagtacaaattaacttctatttctcaactgtgaaaatgaaaatcactattcaaatggcaaatatctactccttgaattcatcagggttcttatagaaatcaacaaaatcgtcttgggttcagtactttcttattcactcattgactcaacagatacaagccatggtatccaaattcctgtcctggggagactggagagtcagggaggaacccggcgaggacctgcctgccctccaggagttgggtcagaaaggggttgacacctgtagatcaataatgctaaccgaagacaggaagggatctgatataaaaagggcgtagacagtgttctgaaggtttggacatgagagagaatcacagccggccagtggtctcagaagtggcttcctggaggaagtggcattttgagttcttgaaggctgtatgtaccagtcaagatgctttggctgctgggacagaaaccctgactggactgacattgacaaggggaagtatattggctggagcacagcaagcccggaggcagggcaggattccccgccagcctcaccagtggctccggcctctttttcccacagcacctgcgcagctggttgggctgggccatcctctgtgggtggcctcatcctcaggctgacttgcttcatggaggccagctggccttggctttcccgggctgccactgtggagcccacacaccgtctcttctggtggctctctccagagagctagcagtatctccctggtaaactttcatgagtctgtctggccactcctgcaccaagctctttgacaaggaccatggacttaggggctcagtgcctgtggcaaaggggg

SEQ ID NO: 25281 - DNA, 1043 bp, Homo sapiens
gcaaggctgttgagacttacctgcactaagacatagaaagtgcccaacacagcgcctgcagggccagcactcggtggcagtctaaggaatgtctgtcacagcgctcccagatggcaggtcctgcctgcctgggcccagctctggctgtgtggctcaggactatgggacctctgcaggctgcgtcccctgcctgcctcagtttctgcgtctaagctagaaagcatgattgttcctccccgtggggccgttacgagaagcaagcacatggaagcgtgccaggcattttccgaacgtctggaacatcctcagcggcagggtctcctcctccctctcctcctcctcacttagaaatattttccctgggagtcccacggaggtcgtgaagatgacagaggctgctggcactaacagctgtgtggggcagcccaagcccctactttgaaagttccattccatccctcgcatttcatctgaagagcgctatgttctccctggggagaactggcctgttgcatatgaagagtccagagattttgaacaagggaaccccttcagcttcgaatgaccattaccgttgatgatcccagaagttccctttccaagcagtgacccatggacttgtgtccctcgtgtgataacctgcactacacacatatcctacaagtgtccatagtggttataagctgccacagccatacagatctgagagccagaggccttcaaaccagctaaggctctgaaacacttcaactccacttaagaaaacaaatcggagcacatccgtgatcccacaaatgctaatttgcttgtcacacatcagaaacccaggaaggcacagaatagatgctctcttactggcttataggttgggtactttaaagttggagacgtttaaatcagagataaacctattgtaacaatacatttcatgtcatgtgagccttttgtcttccagcaactaaagggaactgtggtaggatgagctggggtcacagggacaaggaagacaggtaaggggacggaagccggggcagcaaggagtg

SEQ ID NO: 25282 - DNA, 1032 bp, Homo sapiens
attaaaaacatatttatcttgttaatactctgagtccattgcgtcacctcgggcggaccatttcccctttttctaaaacctacaccatgggagggtctctttgccaaaaaggagaagttcatgagcttccattgcctaatatcattctttggaggcacagtcatagctccttatctggctctcgaagttcaagtccagctgtctagatcataactttcaactaggaaatcaccgggtgccttaaaaaaataaccagcgcaaagttcaggcctcttgttctagaaaagtagtaaggttactcctactagagccacgggatgtagaattccagttactgttggggttgtgtgtgttttaacaggcacacctctttccctgcagcagggggtacacagcaggctgtgcagagtagggcaaggtagaagccctggggtatgcaggaaggtgggtggggaggggctggtgtgtcagggacaaatgtcagctcccacatcccttggtaaagtgtgactgggtacatcagatttagattaaattatcctgaaactatttttttttctttttttgagacagagtctcactctgtcacccaggctggaatgcagtggagtgaggtcagctcactgcaacttctgcttcccaggttcaagcaattctcctgcctcagcctcctgagtagctgggattataggcacctgccaccaagcccagctaatttttggatttttttagtagagacaaggtttcaccatgctggccaggctggtctcaaactcctgacctcaagtgatctgcctgccgtagcctccaaaagtgctgggattacaggtgtgagccacagcaccccgcccctcaaactattttgtagcttgcattatatagatcaaacaccttcattgcacttacatctctagtattgtatttacttaaataatgattatcaatagcaactcatttaatccttataaaccctgggaactgggtaccattatccctcccattttacagatgaggaaactgaaacacaaagag

SEQ ID NO: 25283 - DNA, 1026 bp, Homo sapiens
gctgtctcacgttgctcacggtcagagtgcgtttgcgcctgtgacttctgcccaaggtcaggccaggagtgcgcatagcacggataccaggcgtgcctgctcagacctgctggctcctgagaggggcttagaagcctcttgcctgcgcagatcgtcgtttctagctgcgaggagccaaaatgttcagggtctgagctttaaggtctaactgttgtactagaatctagatcctctggattaaagtggaaaagaagaacggattaatgagtttttaaactggccaaattgttttatttaaaaatatgtcccccgtggtttgtacagtgttgatcacacacgggctccaggtttcaggatatctagagcccgtgtgtgatagagagacgggaatgaacacatggatgaaacagccaggaagaaattcctccctgggaaaatggctagcaatgtgttgacacacctgctcaagccatttgcaagttattttcatcatcttgagctggagctaggagtcatttctgacagcataagggttctttaactcacagttatggtgtgactttttctgtgacctcagagacatagaagctgagacccccactcagtccatgttctcccgtgggccatgccctgtggggccaagggaccatccacactgagcccacccccaagagcttttcttcttaagaagatgtgaatttattttgttagacagaagtaaccagctgccttccccagggttgattttaatacacaggttgttgtttggcttacatagccaaatttaaaaaggcgagccagtgtttaaaaccagtgagatttcggataaaaatctgaatttccagattctcttatggtggttgtagattccgccacattcccagcaaagaccaagctggccacataccctgcagggtcagggccctgccacaggtctaatgtgctcattgccctccgctgctaggagtttgccgctccatgtagaaacctgcatgcagaggctaggcagtgtcaccaagccctgga

SEQ ID NO: 25284 - DNA, 1027 bp, Homo sapiens
gaaataaagactcttcctgctcctgtcttcatgtgtggacatctgcgtattgaatactgccaagtgtgtcgttaaccttggatttgagctgtgggttttgttgctgttgttgtgttgaccttgtcaccattctgtctcatcccctgaccctttcttccaggaatgcctgaaatgactagaaatgatcgtgttttaaagatgctgggaagtttactgttttaaagttaaaaatcatctcagttatctttcttgtaaattttggatttgcatctatcaaatttgcagaaaacacggtgcctcgatcggtttgtttctgtttaaccactgtacagcagttggctatggtgaatgctgaaactatcgtgatggccttttgctgtcatttgttgctgttttttcaaggcttttaaaacctgccatttgctttcatcctccagccctcctgtctgtacagcgctgcccggccttcggggagttaccgggtgcgtgtgctgcccaccctgctgccccgcaccccctcccactgtgcatgcaccgcccccaccaagcccagagccggggatgtgcctgttcccagccccctgggggaagttgcaccttcacgtggagcttacatgtgccagtggggaatgtctgtcccctttggccagatctgggttttctctcccccgattgttgactgtagctgccacactgctctgtctccaggaagccttgtgtttgctgggatcgttaggcaggaatggaacaacagcaatgtttactttacctattggcagaaagaatggtggctttttaatgctttggtaacctggacagatactaatccatgttactatattactttggaaatttccagttttaaatataagtacttatgctatgcaagaaacgtaaagtaaatactcaaagtagctatattgtcttgttaataaccttttttttttttttttttttttttggagacagaatctccctctgtcacccaggctggagtgcaagggcacgatctcggctcagtgcaacc

SEQ ID NO: 25285 - DNA, 1043 bp, Homo sapiens
aggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcacca

SEQ ID NO: 25286 - DNA, 1027 bp, Homo sapiens
cagtctgggcaacagagtgagtccctgtctcaaaaaaaaaaattgttttaagtttttggacatttaattataaattcaggttactaattgtgtcaattcgatttgaactattgagaagaaactttttaccaaattcattgtgtaacatgtattgttgtgtgacaaattaacccaaaacttagcctcttaaacaacaaatatttattatctcacacagattctgtggatcaggagtctggaagtggtttagctgggtatttctggctcagggtctctaatcaataaagctgtcagccagggaaatagtcatgggacggttcactgggagtggagaatctggtccaggctcttttgtatcgttattgccaagcctcctcattggctggagatctgagttccacaccacagggaccatggacctctccataggctgctcatgacctggcagcagagagagagagagagagagagaggagagaggagagagaaagagagagaaagaataggaaaaagagagacagcatgcgtgagagagggagaacccaaggtggaaaccagtctttttaaacttaaccttggaagtaacagctcattacttcggatattcaaggggagagaaattagctccatttcttaaggagaagagtatgaaacaaatttcggacatgctttttaagccaccacactatttgctgaaaatgtctcgtctcttaatattgtatcttaatattatccttgaacattttttatatcacaaaccaactacgttttcattttgttcttcccagaaaactacaattgctattcattgtggaatttgtaacgtaccttctcccaggctcttttttctttattgttccagtcagtgtttgcttctatatctctacttgattctacatcagtagcatgtctttgttttaaagctataagattatccagagttatttttgaactagtaaaataatttaattatggtcaaaataaacctaagtattccaatttcaataccacatataatttaatgtgt

SEQ ID NO: 25287 - DNA, 1032 bp, Homo sapiens
aaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggttgatgcttttgcagtggtcatgtgattgtgacctggtagctacttatcagagagccagaccctgctgtcctgggagacaggagcgatgcctcaggaatcagcccaatgtctgatgtcactgagactg

SEQ ID NO: 25288 - DNA, 1113 bp, Homo sapiens
cacttccagtttaagctaaataacttaaaaacctaacccccagttcttggtttatcaacacaagcatcctcaatgtaaaaataaggacttggaccttcataagccttcctcgcactccctctgtctccacacatcccagtggatttcttgtatatcggctttaatgagctatcattcatccacttaaagtgtacagttcagcagtttttagtgtgctcaccaggttgtgcagccatcaccactatatttttcagttatagaaaatttttctataattttcagttatagaaaattctcgccagccccaaaagaaaccttgtaccagttaactgtaaatcttcatttccctcaactctaggcaaccactcatctactttctgtctctacagatttccctattctagactcccctatgaatggaatcttataacgtgctctttttgacgggcttcttccatttaacataatgttttcaaggttcactcatgttgtaacatgtatttaattcattttctacagatgaacaacatttcattgtctatctgtaccacatttgatttgtctgtcagttgatagacatttaggttgtttccatttgttggctgttacgactaatgtgacatttgtgcgtatgttttagtgtattggtatgttcttatttcttttgggtttatacttgagtgagattgctgggtcatgcggtaactatctgacaaatgttaggtaactgtttaaccttaagctttgttttccaaagtagccacaccacttagtactcctatttgcagtgtcacagggttccaattcctccatgtctttgctgacatttgttatctgtctttttgattattgccagcctagtaggtgtaaagtggtatctcattttggttttgatttacaattccctgatggccagtagtgttgagcatctttcatgtactccttggccatttgtatatatcttctttggaaaaatgtctattaaagtccttgctcctattttaattggatgacttgtctttttattgagttgtaagagttctttatatatgcttgatacaagtcccttgtcagatagatgatttgtaaatattttctctcattctgtgggtt

SEQ ID NO: 25289 - DNA, 1113 bp, Homo sapiens; identical to SEQ ID NO: 25288

SEQ ID NO: 25290 - DNA, 1039 bp, Homo sapiens
atcatttattgagatgatcatgtgggtttttgttctttattctgtttgtaatgttgtattaccttaactaatttttggatgttaaaccatttaatccttttcatatgtttttagatttggttcactagtattttgctgaagatttttctgtcaatattcataagaggtattagtctgtagttttcttgtggtgtctttgtctagtttagtgtcagggtaaaatttgccccatataaatcatgggaagtgttccctcctgttctgttttttggaagggtttgtgaagacttggttttaattcatctttaaatatttgatagagtttgccaatgacaacatctgggcctgggcttctctttgtggagaatttttaagttactgattcagtctctttactttttataggtttgttcaggctctatctcttttgagtcattttcagttgtttgtgtccttctaggaatttgtgcatttcatttgttatctaattttattggcataccattgtttatagtagtctctggtaatctttttttatttctgtaagatttatagatccctttcattcatgattttagtaattttattctttttctctgtcttgttcaatttagctaaagatttatctttttaaaaactctttttaaagaactaacttttgattttcctgtgttatttttgtagtctctattttattgacttctacactaacctttattaacccatttatgccggaggttgcaagtttttttgtgtgaaaaatcagaccttggcaataaccttgagcagtaggatataaataactcccacaagcttagcgttccaataatggaacaccaggcataaatgggttctttctttctacttgttttaggtttgatttgttcctttttttttttttttttacagtgtcttaaggtggaagattagttatgatttgtattttttttttttttgagacagagtcttattgcccaggctgaagtacggtgacacaatctcagcttactgcaacctccacctcccagattttagcagt

SEQ ID NO: 25291 - DNA, 1039 bp, Homo sapiens; identical to SEQ ID NO: 25290

SEQ ID NO: 25292 - DNA, 1028 bp, Homo sapiens
gaagcacagtcctcagctggtttccaaaggagtgtctatgctggcctgacactggcactccagagttctgcattgtgtcagttggaaacatggaatcatttgcaggaaaagccctggccaaccgctggttccaacccctctctatttatgcattctctttcttttttttttttttaaacctgtgattcatatgatttgagatccttttacaaattctatcacatgatgcgcaggggagagctgcctgccacagagctgagcacgagagtctagcacctgcgctgcctcctaggttggggttccaccctgccccgaaggcttttgtgactctgcgtgtcaaaaggggtggcactcagaggcgccacaaggaagcagcaggactatgcattgcagagcatttctcctgtgtgcccctaagcacttagcatgtatacagagtaggtccttggaaagttcttgttgaataaatgaccaacttttccttccagttttatggtcccaggattggcgcactttatatacgaggacttggtgaatttacccctctctaccctatgctatttggaggtggacaagaacggaatttcaggccagggtaaggcagaaagttaacaaagtctctgacctactgaccgtgtcatttgtagagcagtgacattgtaaagaaacatggcgctgtttcttggtctcgtggaggctctgtagcatgtccacactgctgctgtgtcagaactggctccactgattgattttacactgagggctcacaggacctgcagtctctttgggaatgattgaaagcaatgaaggaaatctctgtttcttttaactgctccaatgcatccaattccccttgtaattttggcccagcccactgaagagaactgttggacccttcatggctgaggcctgctgctgttttaacttcggggatcagcaggaccacacagaagcactggtctcctttctgatagctcctgtgtcccctctatgtatagtgacgtgttaactgggaaattagttgttgc

SEQ ID NO: 25293 - DNA, 1004 bp, Homo sapiens
tagttttctatcattgttcttttccaaaaagttttaagccatcttatttgcttattcttccggatgaattttaaaaactcttcatgactcaagaattccactcttgcaaaataaactaacgtctcagaatttaactggacttgtgttaaatatatgctttcattagtttaggaagtttaggcacctctaacttcagcttagtgaaggtgtccccctcttctgagaacacgttgcgtgtacttggttgcgtatgttggtcacagtggttgctcgctggtttattttattttattttatttatttatttatttatttatttatttatttatttatttatttattttgagacggagtctcactctgttgccagactggagtgcagtggcgcaatcatggctcactgcaacctcactgcaagtgattcttctgcctcagcctcctgagtagctgggattacatgtgtatgccaccacgcccagctaattttttgtatttttagtagagacagggttttaccatgttggccaggctggtctcgaactcttgacctcaagtgatctgcccgcctcagcctcccaaagtgctgggattacagctgtaagccactgtgcctggcctgttgttgcctcttaatccagtagttcttctgttgattcttttggctttcctaagcagacagttgtatcatctgctcttcttttctaattgcttctgatatgtgcatctgtgtttactggtgagcttgtgctctagggttcttttgtatggtcttaagagattttattagcagacatttatgggctttttgacactgagcttccctgagctatcaacagctcagtggactcctgtcttcccctcctgctagccgggcactgacctccctgtgggttccccagcaaagctggcactctgcctgaacattctgcctcgcttaagtaggttctcatttgggcaaatgctcagtacccagaggtgtgtgacacactggacctctgtgtctt

SEQ ID NO: 25294 - DNA, 1032 bp, Homo sapiens
taggggaaagggccgggccaggaagcagggcctggagctgctggtcccggagctgctgttcccggtccacagcagctgtgtggtttacagtgagtgcacacagaagtccttgaagagttttaagcagcaccgaggcaagatttgacttaggttgtagaaggcctccttttaaaactgtggagtggcaggagtaaaggctgcagcgcagcgaggagggggccatggcatctggatgagaggaggtgatggtttggaccagagtgccagtggtgacagcagagtgggtttactgtgctggcaggttggatgccacttgtttgaacggaaaggaatcaaagatgagattcattgtgggaggggtctgggctcctagggggtggcctttattgacatagacggttctgggagacactggttggtggaatgggtggcagtgttaggaattctgtgttggacaacaaatttgagatggctatggaccaaccaagtagaaacatctagtcgacagctggatatattgacttggagatcaggagagagctggagaaaccaaagggaaaaacaaaaaatggagagttctagcatacaagtgatgtttacggacatggacctttgcgcagtaattagtccaggggcgtgtgtaggtaggaaaggacgtggtgaactccagagcttgctgtggtcccccaggtcagaagaggaagaggaggaggaggaagaggaggagggaggatcatccttgcaaaggaaacagaaggccaacaagttggaggaaaacttggagaggaagaaagtgttagggaaggagagggggcttcttgtcaagctctaaggaggggaatcatgtggaggctgagaattgaccatttagttgacaagacagtttgctggtgaccttggtgtaatgtaacccttataaatcccagctaaaacaaccaaacacaaaatcttttataatattttaatctgttgttaactattttatgtcaggaaggaaggaggataatatttcagctaaaagtttagactcca

SEQ ID NO: 25295 - DNA, 1084 bp, Homo sapiens
tgcttcgaagaaaagtccatgttgtcaaagccggcctttgttgcactgactgacccggccctcgtgagccctgtgcccatagcctgggtcatcatcagagaatttgtgggttttattgttaccattttgattttttgggtggattaaagagttcaacaaggaatttatccatttctttttcaaaacatgaacaatttcttcctgtactccagttgttatgcaagctgtaaggcatgctttgttcgctttacaattgtgtgacagttccaggtttttctggaacattaagtcaggtctttattttgcttagtttccctcatttcatttttgcttacttctctaactgtttctattgtgaaaaatatggaaaagtagaaagaatagtacaactagtgcccatatacctctcacccagattcactagttttacgtttgccattttgcttaatgtacagttatgcgtgtgtgtgtgtgtgtgtgtgtatatatatatatagagagagagagacagagagacagagacagagacagagtctcactctgttgctcaggctcgggtacagtggcatgatctcagctcactgcaacctccgcctcccgggttcaagcgattcttctgcctcagcctcctgagtagctgggactacaggtgtgtgccacgatacccggcttcttatgtgtatttttgagacagggctttgctctgtcactcagcctggagtgcagtggtatgatcatagctcactgcagtcttgaactccttggctcaagtgatcctcctgcctcagcctcttgactagctaggactacaggcatgtgtcaccatgcctagctaattttttttttttttttgtagagagagcatctcactttgttgcctaggctggtttgaactcctgggctcaagtgatcctttcacctcagactcccaaagtgctgggattacaggcataagccagcagacccagcatatagttacatattttaatgaactgtttcaaagtatgttaaaaaaacatcctaacactttatctctaaatacttcgacatgcagctttaaaaaaaagtacattttcctacatag

SEQ ID NO: 25296 - DNA, 1031 bp, Homo sapiens
ctcagcataattattctgagatttatccatgttgttgcagcgtgtatctatagtttatttgtttttattgctgagtagtatttcattgtatggatataccacagtgtgttcatccatgtatcagttgatgaacatttgagttgcttctagtttggactattataaataaagctgctgtgaacattaatgttcaagtctttgttttgacagatactttcattatgttgtatgaatacagtagaacccctcttatttgcaggggatatgttccatgacccctagcggatgcctgagactgtggatagtaccaaaccctgtatataccatgttttttcatgatacgttccgatgataaagtttactttatgaattaggttcagtaagagatggacaataactgatattaaacagaacaattttaacaatatgtcagcaccactcccttgtacttaggggccattgttaaataaaataagggttactttaacacaagcactgggatactgccacagtctagactatctgataactgagagggctactaagtgactaacaggtggatggtgtgtacagtgtgtatatatactggacagagggatgatttatgtcctcagcagaactgtgcaagatttgatcaccctactcagaatggcatgcaattgaaaacttatgaatgaattgtttatttctggaattttccatttaatattttcagattgcaggtaactgaaactgcagaaagtgaaactatgggtggggataggactgttgtacctagaagtgggactgctgaggcatacggtaagtgtgtgcttaactttttaagaaactgccagaccatagggctgggtgctatggctcacacctgtaatcccagccctctgggaggccgaaatgtgaggatcacttgaagccaggattttaagaccagcctgtgcaacatagggagaccctgtctctacaaaaaaacaaaaacaaagattgccaaactgtgttgcaaagtggttgtatcattttgcattcctaccagc

SEQ ID NO: 25297 - DNA, 1033 bp, Homo sapiens
ctgtagtcccagcactcaggaggctgaggcaggagaatcgcttgaacctgggaggcggaggttgcagtgagccgagattgcgccactgcactccagcctgggggacaaagtgagattccgtctcaaaaaaattttttttcatagttgtaatttgcatttccttaatggctaatgatgttgaatatctgtcctatggttgtatacataatatataatgacacccttgtgtctcatatgttgtaaatatttttccaatctatcgcttgtctgactttgcctttttatttaaaaaacttttttttttttttgaaacagagtctggctctgttgcccaggctggagtgcagtggtctgaatctcggctcactgcaacctctgcctcccaggctcaagtgatcctcccacctcagtctcccgagtagctgggactacaggcacacgctaccacacctggctaatttttgtattttttgtaggggggttttgctatgttagccaggctggtcttgatctcctaggctccaagcgatccttctgccttggcctcccaaagtgaaccactgcacctggccaaacttttctattttgatgtaaaatttaaacagcctttttctttatacattatttattttttttctttttgttatggccaagagtttaaggtgcagttatactttatttttgattttgtctgaagaagctgtcctatcctggttgtaaaggtagtctctagtttagtcttctttttcacgtctaggtctctgcgtggtctggaagtgtgattttctgctgtgtggtagccagccaaggcttccttaccccgcctttgtacccccacctctctagggagcccaggcactacgtgtttccgggctctgctgtgtctctccttgtttcagcactatggttttacctctgggaaagcctttctaaatgttcctccactcctccccgactctccaggttgtcttgattgtgagtaagtctttatggctttatataattgtgggatcagtttgtgtggttccatgaa

SEQ ID NO: 25298 - DNA, 1060 bp, Homo sapiens
tttctgtgcttttcacataaattgtggtgtgcccttccttagtcttgatactttttatttttttggaggattttttcaatgctaaagaaatgcatatttgtaatttgggcctctctccagcctgtctttgaagttgcattggaagtaaagccatttcttattgtactaatggacttgaataatacattatagaataaatatgtgaatcagattgctttaagcgttttcttcattatcctgacttttttgctctcttttcaagaggaaatataaactttgttaatagtaagatattagctcctgccagcgtttttttttctttcttcaggtttatgaagaagtttttgaaaaaccatcaaaagaaccattttattacagtgtttcttaggctttctaaaggtttatatatgaggatgctttaggctaatggccaacagttttgaagactgttcactcactttaaagtatttaaatatttctcactcctaatttttcagtctccttttacatgatcttccctttgtttctctttttcattttatatctaattattaataaatatgatttttagatgctttttcttttcatttaaattttttattttgaaatagctattggagtacttctttttgtagatttccttctttcttcattttaaggttttgtgactgctctcttctctactttcttgatcttataaaccgtgccttgttctgggactgctagacgtcacgcccatatcttgtcctggtgagaacaggtgggcatgtattgaatttgacctgcatatatgttttttgttgccattctgaaagaaagttgtaataagcaagcaaatattgctagaatgactagcatggatgactgtcttaaagaggcatttatttgggaatgtaagaacttcttgtatcttgaaatgcctcttgatggatacaatgaccttatcgtgaacaagttatgttttaattaaagtcagtggcatataacaaatagtatttagctaaattgttgatgaaagtcagggatttgagtcttaaattatttcactttggtgatagga

SEQ ID NO: 25299 - DNA, 1034 bp, Homo sapiens
aaaatatttataaacatatgccatgggtgtattatagaccacaaaaatgatttggaagccattaaaatattacatgtatatgaactttataaagataattaggaggagataggccttttctctatagacaaataaagttcatgataaggataaaatatgagttctttacctgaaaaaaaaatagatacacatataaatgacttaagaaaactgtattataaaaatgtgtttagctgtattgtcacaaacatttccaaattgatatgcccattatcttctggttcatgattactcagtgaatgataatataatcaataaagattttatttttactgaaaatgtcactgaaattcatattatgtcctcggttttttagattttagtcagttgtggcctgataggttatttctggtcttaatttcaccagtacccttttctgtgctttgcataaaaaaaaatctttatttttgattggttttgacagcctgccttggatgtcaattcagtttctaagtagtgtagaccctggtgtttaaatatactcactgtgacacattaatggatatatgagggaatgatgttgtgttagccccaggatgaaaattagtggaggctgggtgtggtggctcacacctgtaatcccagccctttgggaggccgaggcgggcagatcacgaagtcgggagattgagaccatcctggctaacaaggtgaaaccccatctctactaaatatacacaaaaattagccgggcgtggtggcacgtgcctgtaatcccagctactcaggaggctgaggcaggagaatcgcttgaacctgggaggcagaagttgcagtgagccgagatcgcaccactgcactccagcctgggtgacaaagcaagactctgtctcaaaaaaaaaaaaaaaaaaaaaaaaaagaaaattagtggataaggattagaattaaatagaatttagtcacattgactactaaacaatgccccagctcagtggagagaagtgtaggaggtatctggagagcagtaagtagag

SEQ ID NO: 25300 - DNA, 1050 bp, Homo sapiens
tctgtcagtgtggctgggtttggggcttttatgggctcagaatcgggatgtgttatttattggtttgtgagtatccaaaaaaggctaaaacaaaggcacaattcaaaggtgggcatgacagtgtaaaaaaccaattagggaagggtaggtatatgtaaaataggtgaagcgtggggatcaatcagaggaaagtgcgccaaatgggaagagaggttctcaatccggtccgtggacttatccaagactggtagcttggcttttgggctttaaactgtctttggtttgaaggtggggtttcactagggacctgcccccagtctgcctaagaatttgtctacctccttctgctatcacttccctgataaagcttattccttaatctatcctgtgttttgttgggaaatcatctaagatctgcttcctggcaggtggtgaccaccaagagacccatcttttagacagtgccttttagtgataaactttgtctattttgtcatcatacctgaaaggtagtttccctgggtgtagaattctaggatgacaattgatctcttaaagcacattgaagatgtcattctagtgcattctggcatccactgatgctgttgagaagtcggctttcagttacatttgtttcctatgtggtctctctttctctggctgctttttaaatctttttccttggtgtcctgcagcctcaggacttcaacatgcattgaagtgtgcttctatttaaatcttgctagggatttactgagatacctggatttctaactctggaaaaatttcattcctatctcctttaatattgcttcctctcttctctgttgattcccttcttgaactccagagtagatgctccttagaccctcctaccccagccaccatgtccttcacttcttgtctatatttttctatctctgtctcttggtcctatagttgggatgattttttaaaattttttagatttcatttattttttagagatggggtctcactctgtcacccaggccagacagagtacaatagtgggaccatagctcactgcag

SEQ ID NO: 25301 - DNA, 1083 bp, Homo sapiens
ttcccagtgcatatataagttatgtttacatgatactatgatctattaagagtgtaataggccaggcgccagtggttcatggctgtaatcccagcactttgggaggccgaggcaggcagatcacgaggtcaggagatcaagatcatcctggctaacatggtgaaaccccttctctactaaaaatacacacacaaaaaattagccaggtgtggtggcgggtacctgtagtcccagctacttgggaggctgaggcaggagaatggcgtgaacccgggaggcggatcttgcagtgagccgagatcacgccactgcactccagcctgggccacagagtgagactccgtctcaaaaaaaaaaaaaaaccaagtacaataataccattatgtctaaaaatgtacacgttttaatttaaaaatactttattgctgaaaaatgctaaccatcatctgagctctcagtgagtcacaatctttttgctggtggagggtcttgctccagtattgatggctcctgacttatcgggggctatggtaattcttagatgacagtgaagtttgccatatcgtctggctcttcctttgatgagatttctctgtagcatgagacgttgtttgatggcattttacccacagtagcgcttctttaaaaattggaatcagtcctctctaaccctgctgctgcttaatcaactaagtgtatgtggccttctaaatcctttgttgtcattatgacagtgtccacagcatcttcaccaggagtggatttcatctcaagaaactgctttctttgctcatccattcaagtttgatcatgcgattgcagcagttcagtcacatcttcaggctgtaattctagttctcttgtgatttccactgcatctgcagttacttcctccatttaagtcttgagcccctcaaagtcatccatgtgggttggaattaacttctttcaaactccttttgatattttgacctcccatgaatcacaaatgttctaaatgacatctagattggtgaatcctttccagaaggctttcagttcatttttgcgcagatccatgagaggaaccactacctatggcag

SEQ ID NO: 25302 - DNA, 1034 bp, Homo sapiens
ctcctgccttagcctccttagtagctgacactacaggtgtgcaccacaatgctggcttcttcttattttttaatgtcagactacattgttgtgaatgcttgaaacaagtacatgaccatgggtgttttgtttacatattatactttgttaggttagcactctctctctcttttttttttttacatttttgtcattggatctgccagaaatttaaagaattctgttagtctctgatcacatttttgattttgccattttttccccttgtactttgaataggttttgctttgaaaattttgatgctaattgaactcataaaagttcctgcttacatattatgctctatcaaaacaagagtactattagttttatttaaggcccatttacatggcattatgtaatatttagttttaaccctagggagtttcagtagttctgtttgtgcttgtgtagaaccatttgtctaggagtttttgctttttaatacagtgaacattattgctatagctgatgttggggtctgtttctgttatctttctgttttgtaactgtttccatttgatatcttttcttcttatatgttgtttttttctttcctcttccattatactaggtttacagtcttattttattttattttttttgagacagagtcttgcagtgttgcccaggctggagtgcagtggcgcgatcttggctcactgcaacctccgcctcctgggttcaagcagttctccttccttagcctcctgagtagctgggactacaggtgcccaccaccatggccagctaatttttgtatttttggtagagatggggtttcaccatgtcagccaggatggtctcgatcttctgacctcgtgatccgcccgcctcggcctcccaaagtgctggtattacaggcgtgagccacagtgcctggcctacagtcttattttaatcatactaacggttgcctttttttttttctttttcaaccagattgtttttatttttcatgtttctagtgacttctttccagcaaagatgctttt

SEQ ID NO: 25303 - DNA, 1031 bp, Homo sapiens
ttatgctttggcccttgttgggctttggggttattgtgccagtttcatcagatgaatttgtaagtttctcttctttttctttgctctgaaatagtttaaatagccttgggattattggacctttaatggtttgaaggacttcccttaggaatttttctgtgtgcggggattccaagttctttcctgctaccttatcttgctgaacgtagtgaagctatctgatctgtggagtctcctacagcgcctggtgtcactgaatcaaggccttctgctcagggtggctgtgggatttgttggatctgtgggatctgtgggctgtggtcagtcccctgcacagtctgactttccctttcttccctgcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtaagtggcttgagttcagctctgacttgtgggctgggttgattgaatgaatcaagatgtagcaataaacaaaaaacaaaaacctccacctgagcacttggccaaaatcttcagttagaactcgcagttttccagatggttgttcagattgatcttctctttttaaattcctgaataccaagaactgatatcagggaatctctaaaagtacatgtgtgttgtcagaactcctagaattatgctcgcgctctcttttttttttttttttttttgaggcagggt

SEQ ID NO: 25304 - DNA, 1053 bp, Homo sapiens
ttcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagtta

SEQ ID NO: 25305 - DNA, 1022 bp, Homo sapiens
acactgttttatttatttttattatttttttgagacagggtctctcacctaggctggagtgcagtggcacgaacactgctcactgcagccttgacctcccaggctcaagtgattttcctgcttgagcctcccaagtagctgggaccacaggcatgtgccaccgtgcctggctgatttttttgtcaagacagggttttgccatcttggccaggctggtgttgaattcctggactcaagctatctgcctgccttggcctccaaaagtgctgggattgcaggtgggagccaccgtgcctggcctttacacgcccttttaaataaaaggactagagaatgtactccaaaaggagaaagcatggcataaaggcaatgggagatccaatgcaaagagcaaggtgactccccaggagcacagcaaaaggaggttccaggatggcagccgtgcactcagcatagaaggcagccaggttgggtttagtgctggctccagagaagatagcttaactattaggacacctgttgcctctgaacatattgagggtttacataggagctgagattgaattattgacaagtacctaggaaaccaagggacgtaactccaaggaaaatgggtaggaaagaagaagttaccgcagtaatactatcatataatttagttatgaatagtatttatatagtcctaaaatataagcactgaacagtaaccatattatgatagaagcctattaggagaatggagggcgggaggaggactgatgggaagtgtgtgtgagcaaaagctgaataatcgtcatttccatggggagaggtgaagagaaaatgcccagtcttgaaaagcattttgcccctgactgagtgccagagagcacaccctgggcagaaagcatacccatgagaggcatgtgggagaggctttggcttctgtttaaaccagcccagaagcagcacagcagagagaaatgctgcaggagggccgagggcagggccttgtggaaagctgtggagtccacacatcgtgg

SEQ ID NO: 25306 - DNA, 1021 bp, Homo sapiens
tggctttccccctgatttgaagaggtggtacaaagccctctgccaggaaaagggattctacccagcaatgtgggctctgcttcctctggtggagaggggcctcatgagcccctaggatggagattttgacccttagtagtatgtgagtggggccactgttgtcctggcgctggatgccgagttcagacacggttgaacagctttctctctgctaaactgaatgaagggtagaagccttacttctctgtattttcctttaccactctccattttcgatataattgctttaaagtatttccttcaaatctatttagaaccatattatgcagtgttataatttcgtttcaatgatgaaacataatttataaaactcaggagaagaaggaaagcctattgtatttattcatatattttcttatgtgtgtttttcttccttcctgatgttctcagtttccttcttttattattttctttctgattagagcattttctttagccattcttctaggtaggtctgctgatgacatattctccttattttcaatttttccttccttcctgaaggatagtttccctgagtatcggattctgggcagacagtttgattttttcccccatcacttgaaaaatattttgctacttccttctggcctccttggtttctggcaagaaatctgttacaattttaattgtctttttttccctatagtaagatgttatttttcttctgttattttcaagattttttttctttgtccttagttttcagaactatgatgtatcttggcatgtatttctttgggtttatccagttagaggttttctcagtttcttgaatctgttggtttatgtgtttttccaaattgggggtgtttttggccattatattttcaaaaaatatgaatgtttagcctctccctttttctcttctccctccaggacgtcagtgacatgaataggaggtcttttgttattgttccacaggcccctgagactctgcctctctgtctgtctcttttca

SEQ ID NO: 25307 - DNA, 1073 bp, Homo sapiens
gaaggcgccggagagcagtgcgggtctgatttgggcttgtgcctctttctctctctcttttttttttttttttttttgagatggagtcttgctctgtcatccaggctggagtgcagtgctatgatcttggctcagggcaacctctgcttcccgggttcaaactattctcctgcctcagcctacggagtagctgggactgcaggtgcgtgccaccacacctggctaattttttttttttttgtatttttggtagagatggggtttcactgtgttagccaggatggtctcgatctcctgacctcgtgatctgcccatctcggcctcccatagtgctgggattacaggtgtaagccatcgcgcccagcctctgggcttgtgcctctcaacagtctcaagcgatgtcctggcatgagggatggtgcctccaggactctgcttcttggtcctggagctggagattttcaggggccgatgggctctgccctcttctgctctcaatttttgtccatcaggtgggcttggcaagtccccttgacctttctcaggaaaactttggtccgtctggccctccccgacctccccccagtgtctgctccctgcaaggtttctcatgccttcctacacacgctcacctggaatgcagccctgcccttttgtatcatgaatgtccagagtaggcactggctcgaggagaattggtgaacacgctaagtaacttccccaaaactgacaacaggcactgtaattccagttagtgcactgatccctgtgcagagattccagatctggagactgtatgtggcagaatttatcatttgacatgtgtggcatttcaaataagtagggagaattgaatacaagattttagatcactggctctccatagagaaaaccatgttacctaaaaagtaacatctttctgccagtccatacgtacaatacattccatacgtacaatacatttcatatgtacaatgcattccatacacacaatacattccagctgcgttaaagatttaggtgtaataaaaaaaaacctgaaaaattccagaaggacatatagagagtatttt

SEQ ID NO: 25308 - DNA, 1167 bp, Homo sapiens
tgaggccatttgagatagaatacttcactgaggtttcctgaaactcatattttcatacagatcttgagctgaaccatgttcttgtcatccttgcttcactctgttctgggtagacggcacagatgccggattccttttgcctggcaaaaaaatttaaaaaaagaaaaaaaaacaccacacacataaagtaaactctttctgagcagagcactataactcataactttagtttaaatctgggctttaaaaaaaacaaatattttaataagccaattttaaaggctgaacttttatgacggtttttaagcttagtatttatattaatctattctcactggtgtctttaaaaaccctgtgaatgcatgctggaatgtctgtttatgtttgtgtcttttcctgggaaaggataaatgtgctgcaaaaagcaaaccaaatacagaactctccgctagcagagagttcacaaatgaggcaataaaattcaaagaagagatgaataagttactgtagccaaggactggaaaaccataaaggagaaacagaatctaagagatacagacatggatgctttcaaacgtaaaggcaagatgaaacactacaaacagaaactgattaaaaagatattccacatggtcacctgagtctacacgtgataaaattgcatagcactaaacacacacacacacacgcacatgcacgtgcacacacatgtacacacgagtgtatgtaaaactggtgaaatctgaatgaggtctggggacgatattgacgccagtttcctgattatgataattgcaagatgtcatcactgggagaagggagtgaagatatgagaatctctgtataatatttcttgcaacctcatgtgaatctataattatctcaaaattaaaataaaaaagatattctacaaaagtattaaatctatatatttagataagcaaattatctaagaaattactactaagatttatctcagagtaataaactaaaaatgtgacttgagcaaaactccacatattttttctgacgccatttgaggaatctcaatatatttccaatatataactaattagaagtggttccctgtaagtcttaaataaagaatagtatcccagaaatatgaaaggtgaaataccaattataatagcaatacatttattccta

SEQ ID NO: 25309 - DNA, 1072 bp, Homo sapiens
tttggggaaaaagtggtttctttctgcatccttttgttttgctaaaagtttcatttatgaaacttctctggtccctcgtacacagtatgagggagaattcgaatttcctctcagaagatgccgtaagggttgttagtgccttaaagatgagcccatgtgtacgtggtattccctcccccaacgcaagctcacctcaccccaaatctaaggaagtacacttctgggctattgtctggagccccgggggcatgggaggtttgaggctccagtgcttatctcggtgagtgattctgggagccacctaccggttgagtggagcgaagggtggagacagagggcaggtgggggtgcaacgttggaagggccatgtgtttgggcagtgggggctctgttctcaccacagatttccagtaacaagagactcttcccaccagaggagattctgaatgatgctgccattgccagaccttctgctaccaaacagagcgaagaggaagagggggcagtgtttggtcaagacagcccacgaaacgttggcgggagtgagcacattagcaatggctaagaacatgcttgaatcatttgtaacaacccaggacagagatgccacaagaggactttggggaaaggcgaatccactcatacatcttggagttgttttttcaagttcagaaaatgaaccttcaccaaggtcttggaacatgaagcagagactctggtgctgactctatcatttgagctcctaagggtactcatgcccagtggagcatgcacaccagcaacactgccaacaccatctcggtgtcccaccccttagaggaggaagaggacacagaggggcgcccggtaataaccctcatttcctctcttccaccccaccacatcatcttaataaaacatgaaggtaactgaatgagtacgactccctcattatcaatttaatcctgtgtctctgttgatgtaggtcagttaagctttttcatgggctcattcagtatctcgctctctctgtctctttccccatgagacttacactcttccggccagattctggtgccctgggcatgtttag

SEQ ID NO: 25310 - DNA, 1050 bp, Homo sapiens
tggcgtctgccggcaggatggcctgctcaggggttccccaagcaggatctgggcagcttagagagcagtcttatgagttgcctggtgaaagccccgtctttgggggtctccggtgttgtggcctgccttggtggtctgtccagcagctctcagtgtgcccattgcagaccggccgagaggccggagtgcggccagaggggaactggtgtgagtgggtggttttgtctggctgggtcagcaggcctggggaaggtggggagctgggccgggacagtgggagccacgcaggacctgggctgcagggaggggagggtgttggcgggaggctgtccctctggtgtccaaggaggggccagaggcgcacagcatagacctcccaggctgggggcacctgggtgggagacttggtggaaggatgtggcctgttgggtttggtatgtcagagggaaagcaggtcaggatataggggcaggggggtctggagtcaaggcccgggtgccattggactgggggctggagggggcaggtagaggatgtggaatgaccatggcagctttgcgtgaggacagcggtggtcagctgccaccttcagcacagagagaaacccgacaccccgcccccattaccctccggggaggggccccggctcccccgagcgccggccctgctgagacccaggagcccctgcaccaaggcctgggcccgcttagctgcagtggggagcctaggaggcccggactgcccgcggagaacaggagcagcacccgcaggcgggagggaggggcccggcctcggcggcgggcaggaaggcgggcgcagggcggcggggacctggccggaggggccggggcggccgcctgcggtttccagggagacgggggcggtgccgagcgcggcggggcgggggctgcgggaggacgctcgtccccgcgccgggagccaccgccctcggccgtgcgcgccagtgcggctgcggcgctgcccggggtggctgcggccagagtctcccgcgcgcccggcggaccgcagcccgccctcgtcccccgctgg

SEQ ID NO: 25311 - DNA, 1561 bp, Homo sapiens
ggcctggcctggggcaagtgggagctgccactaccatgggctgccccaggagggtctctgctcactctgggctgcagagcccccttcagttctgagggtctggcagctcattctgtgagtcaggctgacaggccaggtgcagagattcttcttttgggcctgtggattgcccactccctgctttcccttcccttgttccaaagcccagcgtggagtcgttctccacagagaacatgtgtgccgtcctccttattttatcggccccagcaagaaagatgcttctttatatttgttgtggagtggttgggacaggcagactcattgtgtagtcgttggggaggaatgaggctaccccagcataccaacacttgtgtatcacggtgcttgctggctcaggggaccaggaccctcaccatgagtcataattgaatagccttccctcttagaatgcatttgtcttcttgccaaaggcaactggactgacaggcaggcagggaagctggtgaacatgggaaggctggctggtgacatcagtgcccagtgagcccttccatcccaagggctgttttaggaaaagcagggttggagcttgagagccaagggatgtgggcatccatagcttccacgcctcctgccctgctcctgtgcccacaccggatgccagagagtttctgtgtgtgggcagaggactgcagggcgctcacgcttgctgtgaagtaaggcgtttgaaggtgaggctaagccttgacttggtgaggatgaggaagaaggcagaggggagtaaagaggtgggattgaggcagcggttggacgatttggggtgctacagaccatgggaatcagagagggggccatgctcaatgccagaggctcactcccatggtgattgtgtcccctagggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgaggcacgtggccagcatgggagggctgcagccagcgtgccccccactgccaggcctcaggcacactgtagctttttatgtgactggctacacagccctgtcaggactaagtgggaagaagtaagcttgttctcaagggtggtgtcctcagtttgtgaccttcccctactgtcctcttccagagggacgtggcccttctctcccctgaccagtcctttccactagtgcgaggcaggaagaggtggcaccgagtcaaagcccactgtctgtgccatccctggcccagctggcaacctggcaaaatcaaaacctgttttttattttagtgatagataacattcgttaaaaacagtttgtctccaaaaaatgaaaggggccaggtgtggtggctcacacctgtaatcccagaactttgggaggctgaggtgggagtatcgctgga

SEQ ID NO: 25312 - DNA, 1031 bp, Homo sapiens
tcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttaggtgagaggaaccgcgcagtgctgctggctctccgaggccacaggcccttccaaggcaggatttgggcactttccctctgtggttggcaggtgtccatgtgggaactgaggccaccgggaacctgctgccagcgccctcccatgtttgtcttcttggcagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggcaagctccttgccccagggagggagggggagcagaaggggccctcagagaatttgcatcttggcctccattgtcccaacagagggctctgggctcagtcacttgggctccccctgcccttcgaggcgctgcctagaacccgcacagggccctctcccatctccaacctctcagaggcaaggccgaagatggcctctggaagggccgggggcctgggaggtgggcagggctgatccaggcagggcaggtttccagaggaggtggtgagtggggaggaagggagaagtttggagaggacaggaggccgaggttgagaccagcgggggtgggtcgagccctggcttgggaacgcagggggctgatggactcaggagtgagaggaggggaggcccaggctggctggccacagcagcccctcgggtg

SEQ ID NO: 25313 - DNA, 1037 bp, Homo sapiens
ggcaagtcagaatgtggtgagaagagagggtttattgaaagttgctccattacagagcagggtgtcgtcagaaagcaagagggggaacaccccagctttaactttttctcatacaggggtctcgtctgtgtaaagactaagctaaactgtgcctaacatgtattattctattgatttaaagaaaactgtctgtcacggggtcttgctctgttgcaaccaggctggagtgcagtagcacgatctcagctcattgcaatctctgcctcccaggctcaggtgctcctcccgccttagcctcctgagtagctgggattacaggcatgcacccccatgcgtggctgattttttttttttttactttttgtaaagatggggtcttgctatgttgcccaggctggtctcaaacttctgggctcaagccaacctcccaccttggcctcccaaagtgctgggattagaggcctgagccaccgcgtccggccaagggtagttgtctggaaagcatatattgttctggataccagggcacttggacactttgctgtcatagaagtgtgtccacgcaggcgtcactggctgctgctttagctgtaaacatcgtatgaccatgggctgtggctggcaggtatgtgcctcattggtctcaaggtggagctgaacgtaaacggcttttctctggctctcccaggctcctgcttccctgacatcgcctcacagacttcccttcaaagcagggctgtccaatcttttggcttccccgggccgcattggaataagaagaattgccttgggccaaacatgaaatacactaacactcacgatagctgatgagcaaaaaaaggtctctgcgtaaatctcataatgttttaagaaagtttacaaatttgtgttgggccacattcaaagcccgcagcccgagtgttggacaagcttgctgcagaggctcccctagatagggctgcaggggtggcgtccggcagctctagctggagaagcaggaggaggggcaggaaggaatcctgttcggagctcctcgc

SEQ ID NO: 25314 - DNA, 1035 bp, Homo sapiens
taatcccagcactttgggaggctgaggcaggcggatcacgaagtcaggagttcgagaccagcctggccaacatagtgaaaccccatctctactaaaaatacaaaaattagtcgggcatggtggtgggcgcctttagtcccagctactcgggaggcggaggttgtggtgagccaagatcatgccactgcactccagcctgggcaacgagcgaaactccatccccccaaaaaaaaaaaaagaaaaaaagaaaacaaaaaaaggaaaaagtctagaaccaacccaaagacccagccagtgagaatgggtgaagtatgatataaccacactgtgtaatgttattcagcagtgaaaatctatgaaccacagtgacctacagtgtggagttctcttcttcatataatgctgagagaagacaatatatatcatgatgtactatgaataaagttcataaacaacaaaaacattcactattgtttaggcaatttataaaatttttaagctaattttaattacatattttactgccagaaaacctagtttttaaagacaaggaaattataaacccagagattcttatcgcaagggaagagaagggtacacggtcggatgagcccattcagcattctggctgccggggtggctgctagtcccagatgtcactaagtcattaccatttatttactttttaagcatgaaattaaactttaaaaaaataaatatttaaattcaggagcacaactcccgcttgaaaagaaagctgtggtgaatcatttaaaaccaagatttgtcccagatggactggtttcacaggtgactattatacattgaaatggcaagatgggacatgagacattttctgtcaaacccctgaggcctttgtcctgtcggcctgaaccactggaattaagtcccacagcgtcttctgggagccctggggtggtttcaagcccgccctgctgcttcacagacacagccaggcactgagccccaggcccactgccctgccccgactccaaggatatccagccctggtct

SEQ ID NO: 25315 - DNA, 1026 bp, Homo sapiens
aatatacagccttatttggatcataatgcaagtaaactaaggaaagaaatgttaagacagttgaggaaatacgaacactgacaatctttggtgatattgaggaattactgttaatttttttaagtgttttgaggggtgagtgtgcgtgtttgtgtgtctgcatgagtctgtgtataccactgttgtgcatgcgtgtgtctgtgtagtgtgcatacgtgcctgtgtgtctttgtgcatgcgtgtgtgtgtgcatctgtgtgtgtcttagtccttttcagcacacatgctgaagtaggttccaatgaaatgaaatgaggaagtgcttaacagggaagctgtcgcctcagcagggagagcagctctctccctcctccgcacagaggatgccggctccggggtagagagtcctcgtgaaatccaatgggcttctctgctggagtgagttcaccagtctccccactgagaagtgtgtttaaattattcagtgagcttctttgatcctatctgttgaactatgttttgttttgttttgctctttgcagagggaagtgtttgtagatgctgggccaccttccaaagcaataaaaggcccatcctagagcatctgatgtgcccagcatggtctagattctaatggcctggtttattgccacaaacaaaaagagaaaagctacatgggaggcaggctgctgccagttctgcagctctgggagtcacggaaaggcagtagtgctaccctgctcacctgcactcagctacttcctcccctccttcccactaacaggttcaaaacacatttcctttctcaggaagttcaaaggcacagatggatgtttggtgacctttgccaatatctgaattcaggaaattcagaatgcttaaaacatcactattgttggagcagggtctaaccctgccacattctccaggtcctcagcaaaccttcccattggttcctcctcggggtttgagctggctctgggcaccaaacagccccagacctcagccagaagcagctcttcacca

SEQ ID NO: 25316 - DNA, 1049 bp, Homo sapiens
ggcggagcgggggcgcgcaggggcggagcgggggccgcctcgcgctgacccctccggcgcccaggccttcctcctggccttctcgtccgacttcctgccgcgcgcctactaccggtggacccgcgcccacgacctgcgcggcttcctcaacttcacgctggcgcgagccccgtcctccttcgccgccgcgcacaaccgcacgtgcaggtgagccccgcgccaggtggagggggccgcgggcgcacgaggacgaggcggagcggggctcgggtggggtgggggtgcggcggtggggagccgggaggggcgggcgccgccgggcaaggccgggggagggggggagctgggggcgccgtgggcaggggctggggggaggttccccgcggtaagggacggagctttgcggggctggagggcaaatcgtggattctaggtgaattgctagttggtcatagtgtagcaggacgagtcgcagacagaactcctcagacaccggattaaagaaggaagaggtttttttattcggccgggggcgtcggcagactcgtgtcttcagagcggagctcgccgaaaaagaaattcttagccctttgaagggcttacaactctaagggtctacgtgaaagagtcataatagatcaagtaagcgtgaggaacgtgactgtgggctacatacatcagctaacggtacaaaaagttttacggtgctttctcatacagcgtctggaattcacacataacaccagtagttttggtcaggggttaatattattgttattttaaccgccagggccaggtggtggcgccaaggtcatctagctatttatcttctgtttctttccagctttttgctttcttccttttctcctgtcttataaactagggaaaaggggaggttggggagaaactgggaaggacaacaggagaagtggtggcctcataccataatagaacctgcagagcaggtagatgtacttcacccgcagttgtggagacttcctttgtgatctggttacaatgaagttttgcatgtgtttcaataaacttga

SEQ ID NO: 25317 - DNA, 1047 bp, Homo sapiens
gtgaagaagagcccagctgtcatctaaggcaaactgcccccactgaggacaagcgtaaggccctacctcccccaacctgtgcgcatctcaatcacagcagacactgtgacggccacaggggacccagatggtgcctaccaccttgcctccaggctccactcaccagacctcaggctgagggtctggcagtggaggtaggggcagggacccttggtgctttcagaccccacggcaggtaaaatcaggactgcctgagaacccgtcaccctctgcctctcaggtcaccccccagctccaggaacctgcctcctgctgtccattgccaggtcttccttgcaccctgacacctgtgctgaggcgctctggcagctggaggaggctgattgcactccacaaacaggactgtctggaccaagggaaactggcaggagggaggtgggaaaggaagagggcaaacgtttggcttttataaagtcaaggacgtttatttcctgaggtcatgacacaggaagtggaatcctagccacggctgcggagctctcgtgatgaaggccagagtgctgactgacatgccgggtggaccaggagctggagtctgttatcttagcacgaatgctcatgaccttggtttagtgttaaacagtggagcaggtcctgagcgggcacggccaggcctggaggagcggccgcacacacagccaggcgctaggctccctgcgggacctcgggaagggggaagagcgtcaacaatttacggagggtccagccgctgggtcagattgagacaaaccattgtgtggttgggtttgggtcagcaggctggagagggttctgttctttttgatcattatcgtttggggccccaagggagggtcttgggagccacctgagccccaaagctgggaaattcctcagagctgctcatgtcaggagcctgtgcagagagaggacacggcttcaggaggggatgctccccaactcgcaagcagcttccgacgcagttgccaccctcaggacaccaagcccgcctgcccgcccaccctccct

SEQ ID NO: 25318 - DNA, 1022 bp, Homo sapiens
tgtaatttaaatagatttaattttctattgtttagaaaacagtatttgcctttggttttcagaaatatcctgaattagatttaagcagttttcctttttttctttttttgagacagtctcactctgtcacccaggctggagtgcagcagcaccatctcggctcactacagccttcacctcctgggctcaagggatcctcccacctcagtctcccacttagctgggattacgggtgcccgccaccacacccagctaatttttttgtattttttgtagagacagtgtttcaccatgttgtccagactggtcttgaactcctgagctcaagcgctcctcctgcctcagcttcccaaagtgctggtattacaggcgtgagccaccacactctgccagcagttttcttactgttttcattatgattggttgctgaatttcatatgcctcatcagcatctattaatgcatgattttttttcccctatactgtgttgttggattaatattggtagatgcttttgatacattcctggaatctaattgctagcaaatattgtattcaggatttttgcatttatatttgtgagtgagattggcctatggcgttcattcattcctttgttcctttcttatgtctccatctgggtttgttattaaaactgtgctgtcttcataaaacaaattgttttcccttttctctgtagaggcttggaatagttaaatgactttggtcttgtccaaggttagatggagttcaactctaacgtcaagtcttggtccttttcattggtatgtctttaatcagctgcttagtgatacttgttttagtcagattttccagtttttggttctgtattggtaatttacagtgcccattttttctgcattttcagatttggggccattttgctacatgtagtcttctctgtcattattttagctacttttctatatttgctattttttcctgaattgggcttgtgaggaatttgttttagaaaaccagcttttgcggccaagcacggt

SEQ ID NO: 25319 - DNA, 1051 bp, Homo sapiens
attcccagcagaccagataatttagaattctgataatttattatgatgaaattgatggggctcttagacttgataaattggtttaaatcagcctttgcaagttagttcagagataaattagtgctaaagaacatattctgagaaaagcagaacttgtggttaacattgcaagattattatttctgttttttttttatctttgaatcctgtgggtgttcattactgtccaatgcaaaatcatcataccagtttttgcattttataccagtgttagcatggaacacagataagcaaaaaaaaaagtcattatttcaccactcaggaataaccactgttaatatgttacatatattctttttcacctgtgtgtgcatttgactatacatttacaaaatgtaatcctaaaggaaatactattttgtatcttgcctttttcaattaataaattgatttttaaaatttcttctcattttcagtatgccactgtctagattctggttacttctgctattcttgccttctcatatctctgtcctctctctcatcagatacccttctgtcaaggaatattgatgcttcagtgtagtcatctatgatcttctcattctgtcttttctttcttggtctttgacactagatactcaacatcccacccctaatttgcctgcctcacccttgatgaaactctgttctatagagctagaagcacagcaagagagatgcttttttcctcgatacttttcagaaatgcattgcacctaatacctgggagaagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagtttttctttttttaatgctcctagttgaatactac

SEQ ID NO: 25320 - DNA, 1056 bp, Homo sapiens
gctctggatagtactctgaccttgggcaaattagagtttctttgagtaccctcaaagatcatactgcaaacatagtagtactgtaggtactaaacacagaatgatgtttgtgaggtacttagcccagtaccaggccttatgtaaacacttaaccgattgaatggtgtcatatgaataaggtcatgacaaggtttttctttttatttaaaggtgaatcaggtctaggaaaatcgactctcataaacagcctattcctaactgatctgtacccagaaagagtcatacctggagcagcaggtaaaaacattcttatgttactgtaagtgtaattctacatgaaagatgctgaagactgcctaattaatattttatgtcttagctgtgtgttttgtttgttcttgttcagctttgaacacaaggaaaacacttttatggggtaggtgtgctgcaccgaggtccttggatttgggttgtagactttctttgacacgtatccatggatccatcctctcttgagtttgtctgtaaaatgtaataagtagtttctgcctatattaaatatttgatggaaggattaagtgagaatgttttacatcaaaaatgctgtgtaactagaagattactaggatagatgttcgaattcatctactgtcagaaagttccagcacaggacaccagcatccacaaatgactgttgaatgaaataggcacacatagtgagagcctaagacttgggctgctgcaagaatatgtagccctttcagaatatttttgaattcagtttttaaatgaattcgtaaattgctttctttttcccaggaacagaaattataatttttaacatttgtgtttttaaccttccccagtagcacaataatcttagctttaaccttcccctttctgacttctctgggatctttttttcttaatccccatggtatctttggagaacctacctctgtagagaggcagtagactctgaagtcacctgtcgtaagaacgtgagctttcctcttcacatgctgcttatattccctattaagtttgtttcttttc

SEQ ID NO: 25321 - DNA, 1023 bp, Homo sapiens
gttaaaacatctctttaaagggaataaaaacgtgttattaaaacagcttgtacagattaaaagtagagatggcacaaggaagaagaattatgtgaggtagataagggttccctggatggtgactgctgacctcctgttcctcagatagctttgtcccgactgatggtcattagtgaatagatctgtctggcatggtgtatgctggtctgcctgcttgaaaagaatctgcagactccagagactcaggaccaggaaaaggcagatgcccactcccctgtatcttatgtatcttatggacaggcaggctctctgaactgtccaggtggccactcccatcacttgccagaggaaaagcatgaaaggtaaagttaagtaatgacctaagagtccaaagaagagggtaggtcacatggagctggggtaaaggcaaacaaacctcatacaagagatctgattagagcttgaaagagagtttgagttggccaagatctgaggatgaaacgctgggaatttggtagaaggtctctactacaattcagggacctcattctggaagcatgagtgtgttcatgaaaacagggaggggacttgagccttcaacgacatacggcagggtgggttaggcagaaggcagggagtcttgaggcctccacagcatgtggacaggtggctgaggaaggacccagagtgacttgctggagccttagtcaccaaacgctcttgcagcttagtgggaaaggtgttcattgtaaaatacggtatttacacaaaatgcacaaaaatacgtatgtacagtttaataagttactgtaaggaaaacatccatgtcacccccaactgagtccaagttggttgctttagtttcatcatcacagtgacaccttagaatagtcctgagggtatgtgcttagttcacactttactgatgaggaaattgttgccgctccgagagtttaaaagtatttgctgatggtgccatgacttttaaacgatggcctgctgactctagaggctggtcctgca

SEQ ID NO: 25322 - DNA, 2131 bp, Homo sapiens
ctttatggaatgaaaattttacttttagatcgataaaattttatttctgtatactttctagttttgcagcatttccagtttccaggagcctcatgaatggctttttggtttagttaactttgtggtcatgtaagccctgccttttgctcagtttatgacctttgttaaggagaaaagtagaactgttaataattaacgcagcagacattgcctcactcccacttaagtgtgttttgttttcttttttctagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctga

SEQ ID NO: 25323 - DNA, 1051 bp, Homo sapiens
agtcttagtcttaaatttagtgttaaagtcttaaatataagtcttagtcttaatcttaaagctgagtaattattaaacggatagtttatgccacgttactattatgtgacaacaaacagatttttctttgggatatcagcaacagagtaccacagggtcatctcctctcaagtgaatctgtcttcttaagatcagtctcatgaacaagggtatcttgttgtggccctgcatctcagctgcagccatgttgacgtctgtctgggctaaatgaaaatgaggatgtaagtcgctgcttggaaagtgtgcaaacgtgtaaagatttcctctgtgagccacatatttgagaagagagtttgatattccttaagctaggaaaagtgttttttatttgtctagtgtgtcatgttctcgtggaagaggaagcaatgttaaaaaacttgttttaaacatttttgttataaaataaacacacataaaaacatgaatcagatatatggcttaatgaattataaaatgaacactgtccagatcaagaaataaaactgtgccctgcccacctaagaactccttctctgtgttccatcccagtgacagtccctctctcccatcaagaagggaccactttagtaataacttcctggtgttttctctttatggttttatcagtggaatgtgcacctctagggagtacaggttagtcttgtctattttttttttttagcagtagatgtttagacatgactttcttataatgagtagaagagaaagaacctgaagaaatttttaaagctatacttaagaaaacataaatgagaattatacagtagaataaataagagaaatgacttctaaaaatgtatttcagttgtataaatgtttacagatttgtagcattacttaagggaaagaatgcctttggtgaccaaagtaaaacatcctatcctttgtttcagaagaacccactgttggtggttctatatttaataaatgttgtgagctgaccaagaacatatagatcacttatttttattttcatgttttcacgttggag

SEQ ID NO: 25324 - DNA, 1031 bp, Homo sapiens
ggccaaggcaagtggatcatttgagctcaggagctcgagacaattctgggcaacatagcgaaactgtctctactaaaaatacaaaaattagccaggcatggtggctcacgcctgtagtcccagctactcaggaggctaaggtgggaggatcacctgagccctagtggtggaagttgcagtgagccgtgattgcaccactgcactccagcctgggtgacagagccagaccttgtctcaaaaaaaaagagaaaaaaaaattttaattacctatttgcccacacccagaattaacgtcttcaacatttacgtcatatcatccatttaactcttctagacattttttgcacttacttatgcacttttatatacacacaccccatctatatcactacttctgtccttttgattacataagtactgagaagaattagcttcccattgtgaatgtgcttatatgtatttctctctttacctcctgtaatttttattttatgaatgtcaacactatggttatttgtccaaagatatacataactgttagatcttaatggatacaaggttactgagcaaaggggctggctgcctgatgtgcatatggcaccagcttgctttgatttgatttttttagagatggggtcttgctctgtaacccaggcttgagtgcagtagcatgatcatagctcactgcatccttgaactccaaggctcaagtgatctgcccatctcagccttccaagtgccccaccacacccagccaattaaaaaatatatattttttaattttagagatggggtcccgctgttgttgctcaggctagcttgagcctgagctcaagtgaacctggccccaagtgatcctccggcctgattctcttgagtagctgggattacaggcgcgagtcattgctccccgctcagcagtggattttgagaaaagaaaagctttattgccagtcaaccaacaaggagacaggaggccggctcagatctgtctccccattctgtccttaagacagtatatttaagggaga

SEQ ID NO: 25325 - DNA, 1032 bp, Homo sapiens
tacagtattttaggaatatgtgagaacccaagatttgaaaatgtgccaaaatgagagtgaaatgcctatcaaaaatgttggtgacctttcaaagaatgtagctacagtttccttttgagcgctcaagattattttcattgtacagtataatattataaaaggaaatttgggattgatctaattaggcaataaaaatcttaagtaatgaaacttacagtacagatatgaattatataataggaggggccatctagatagatagaggagttataatttggcaaatgaactgtaaatgagcacatgaaacaagttaaaggacaaaagctgtttcaagaagaattttcccacagagcttaagacaaagaataaagaagtactttgttagccaggcctttgtcgcccattttcatctagacacaacctttaatagttttgtaaatgtaagtttttaacaatattgtttatacctaagcctggaaaaggaccttaacaccatgaccaactagaaaactggaaacactgaacaaaaagttttgctttttaacttgtattttttatactatgttcttaatactgtttctcctccagcctagtattgaaacagttctgatttgagtcaatgttgagttcagcaggaagcacagtgtgatggcggggttttcttccattctgagcatctggatgatgccagtgctctaactggctgtgaggcccttccgacctagtgcagggagaatcttgtttcatctgatcatttggtactttgggaacatgcagtgattattgtagtccacctgatagtgaatttctgtatttttaggaccagaaggtatgttttaagtcgagaagatttgaaaggataaaagtggacatgtgggccaggtgctttggctcacgcctgtaatcccagcactttgggaggccgaggcaggctgatcacgaggtcaggagattgagaccatcctggctaacacggtgaaaccccatctctactaaaaatacaaaaaaatagctgggcgtgatggcgggcac

SEQ ID NO: 25326 - DNA, 1072 bp, Homo sapiens
actggcccggtgtggggctcatgcctgtaatcttagcaatttgggaggcccaagcgggcagatcacctgaggtcaggagttcgagaccagcctcgccaacatggtgaaaccctgtctctactaaaaatacaaaaattagctaggcgtgatggcgcatgcctataatctcagctactcaggaggctgaggcaggagaatcacttgagcctggaaggcggaggttgcagtgagccaagatgacaccactgcactccagcctgggcaacagattgagactgcatctgagaaaaaaaaagtagatgtaaacacattaacttttttttaaaaaaaactttttcatttatcatttttttccctaaaacataaactgggggccgggcacggtggctcacgcctgtaatcccagcactttgggaggccaaggtgggcagatcacaaggtcaggagatcgagaccatcctggctaacatggtgaaactccgcctctactaaaaatataaattagccgggtgtaggggcatggtggggggcgcctgtagtcccagctactcaggaggctggggcaggagaatggcatgaacctggaaggcggagcttgcagtgagccgagatcacgtcactgcactccagcctgggcgacagagagagactctgtctcaaaaaaaccaaaacaaaacaaaaacataaactggggaaaaaatgtctctctctctctctttatatatatatatatgtatgtgtgggtatatatatgtctgtgtgtatatatatagagagagagagagagagcacgcgcatgtttttgtgtgtggaggggtgggcaatctcgttctgtcacccagcctggagtgcagtggtgtgatctcagctcagtgcagcctctgcctcctgggctccaccagtcctcccaccttggcctcccaagtagctggaacttcaggcatgcgccaccatatctggctaatttggggtttttttgggggggagaggggcgggtagagatgggatttcaccatgttgcgcaggctggtctgaaactcctgggttcaagtgatccaccagcctccgcctc

SEQ ID NO: 25327 - DNA, 1032 bp, Homo sapiens
agaaaccctacaagccagaagagattgggggccaatattcaacattcttaggaaaaaatttccaacccagaatttcatatctggccaaactaaacttcataagcaaaacagaaataagattcttttcagacaagcaagtgcttagggaattcatcaccaccaggcctgctttgcaagagctcctgaaggaagcactaaatacagaaaggaaaaactgttaacagccactgcaaaaacacactgaaatacatagaccagtgacactataaagcaaccacaaaaacaagtctgcaaaataaccagctaggaccatgatgacaggatgaaattcacatataacaatattaaccttaaatgtaaatgggctaaatgcccccaattaaaagacacagaatggcaagctggataaagagccaagacctatgggtatgctgtcttcaagagacctgtctcacgtgcaaagacacacatagactcaaaatgaagggatggaataaaatttaccaagcaaatggaaaacagaaaaaaacaaggcttgcaatcctagtttctgacagaacagactttaaagcaacaaagattaaaaaagacaaagatgggcattatataatggtaaagggttcaacaagaagagctaattatcctaaatatatatgcacccaatacaggagcccccagattcataaagcaagttcttaaagatctaaaaaacgacttagactcccacacaataataataggagactttaacaccccactgacaatattagacagatcatcaagacagaaagttaactttctgaaaatattcaggacctgaactcagccctggataaagtgaccttatagatagctacagaactgtccccccaaaaacaaaagaatataaattcttctcatcaccacatggcactttgtctaaaactgatcacataatcggaagcaaaacactcctcagcaaatgcataagaactgaaatcataacaaacagtctcttacaccacagcacaatcaaattagaactcaagattt

SEQ ID NO: 25328 - DNA, 1864 bp, Homo sapiens
agttatttgggggcctctgagctattgttggcccacttcttgggagggcttcatctcttacctccgtggcaggccctcggttttttgttttgtttttgagatggagtctcactctgtcgcccaggtgggagtacagtggcgcgatctcagctcactgcaacctccgcctcccagcttcaagcgattctcctgcctcagcctcccgagtagctgggacttagaggcgcctgccaccacgtctggctaattttttgtatttttagtagaggcggggtttcactgtgttagccaggatggtctcgatctcctgacctcgtgatccgcccgccttggcctcccaaagtgctgggattacaggcatgagccaccacgcccagcctaggccctcggttttttaagactctgtcctggatatataaataatatctagaactggggctatggggattttgtttccttttgttgatgttttgttttgctttgtttttgagaatacaatttaggacagaaattttgagaatgtagttgaaaatcctccaatattttacttttttttttttttttttgagacggagtctccctttgtcgtccaggctggagtacagtggcgcagtctctgctcactgcaacctgcgcctcctgggttcaaatgattttcctgcctcagcctgctgagtagctaggattacaggcactggccaccatgtccagctaatttttttttttttttaattcctgacctcaggtgatctgctcacctcagcctcccaaagtgctgggatcacaggcgtcagccacagcacctggccttcaatattttactttcagtagaaattagaacgacttagtgttggggcaatattttgggaactaggaagcttaagtcctcatttagaccctaatgtttgtatcttggctttgagaacatctaactcaggatttttttttttttaattgagataaaatgtgtatgccataaaattcaccatgttgaagtatacaattcagttgttttaggatacttacacagttgtatgaccgtcactactatctaatttcagaacgttttcatcatcccaaaaagagaccctcatactctttagcagttactccgccagcccccagcaaccactggtatccagaacaggcacccatcaggatattccctctctatggatttccctattttagatatttcatataagtgggatcatacaaacatgcggtctgttgtgtgtagtgtttccttgtttccaggttcactcatgtggtagcatgtatcagtgttttactccttatggctaaaggggtttgttttttcctttggagctgtctctgaggggactgtgtccctaaccttgctgcctcttacactgagtttgcaggtaagagtaaatgttggtaacatcaaacgtatagtcgctgaaatgcccaagcagtgtctcagacgtttttaaaattttattttgaaaccatttcaagcttatagaaaagctacacaaacagcacagaaaggtcctgctggcctttacctgagatgcccgtctgcctttaactggttgtctcagtgttgtttactacagaaggtccaatctaggagcaaatgctgtacccaggcattatgtctctctggtctctgcaatctggaacattcttcctcctttccttggttttcatgaccttgacattttggaagattacagggcagtcattttgtagaatgtttatgatatgggattgtgcagtgcttccccaggatcagaccctgggctcactgcctaggtgagaaactcccagagtgatgatgcgtcctgattcatgtggcacatagggtccatctgtcccattggtggtggtggtggta

SEQ ID NO: 25329 - DNA, 1035 bp, Homo sapiens
taagatctctgatgttttgcctggatggatttactgtgattgcacagggaccacgtggctcaggtgtctgagccattgagggcatcttgcaagggctggttttccttttctcatcagtgttggctggatgccagcaggggttttgtggctaaccacatcaggcagtttcccatttttgtagctttgttatacctaaaccgcagtctcatcattttgcttatgcagctagaagtttcagtctgtatagttgttattcattctgtccctggtaatttagacctgccttcttgatgctttaggggccattgggcacagctttctacattggctaacaaatacctgtgaaaatgttaacagacagaagcgcagcagtgaacctgaggtcaggacaggactgtttgggaggttcttcttttcttactgtcactccaaaaataaaccttggatttgtgtgctggggagaaatgagtatagataacatttaaaacgttttcctaaaccttagtattcatatggtagctgatggttcctctccccttcattactgttgcctgacgacggtccttgctgatgctgtgaactaacaaagttgtctttttgtttttaagggaacccaccctggcgtctggacagcaggttaggtttgggtggttttgagctagcactgctgtggggcaggggtggccgctccctggtgaagctaatgctgtggaagctggaatgttccttcctaaggagtgggatcatgcccctaccccagcagaggtatctcatcactcgctcatgtgcgagattctaaataaattttgttcttgggcatcttctactaggcctcctataaaatagatcttgctgtttttggtttgtgttaatggaacctcactttctagagataattctttagttttttatttaggaagttttcaaaatatacaaagcaggaatgtaaggaacccgcatcacctcaaattcagtgttacccacacttgaccatgcttgccccagctgtgccttttttctttccttgggtatttt

SEQ ID NO: 25330 - DNA, 1032 bp, Homo sapiens
cttcaaggtatgcttgttccctcccagctcgtggaatatcaaaaaaattcattgctggaaaaattatttcatagacaaaaatgttaatgttctcttggggacttagagttgaaaatatttgtatagatttggttctcaagtccacagaatcgtatctgctgtggtctccctttggtgctcatctgggagccatgtgtatggaagattctgtcacaggcggctgggatgtgggcagatgctgttagcctccctctccacgtggtggtccatgcctgacgtgtcccctagttcaaggaagcgccatctttagcatgaaaacaattgcgttcccctaggaaatgaagaaaaaatgagctgaaatttccttatacatttgaatttgttcattttttaaagagacatttttgttgtctgctttgtggtacttataaaatttgttttccattgaaattgccatttataaatttgcagatatgtactaatttagatttttttaagtgttcaataaaataaggatatatttactgtgaatttttaaatgggctttttagctttctttccctctacttttagttttgatttatataagttaaagattcttttgcatattaatccctgaagcagctgcatattttttataacagtgtcactgacatcttcataggcttctgagcaagaaacagggaacaggcaccatgactcttgtgcagattgtcttgttttaatatgggtgatgatgtctgtggaaggccagtggggaaaggtgccttgcttcttcttggtcttagctctgtcagtgcttcctgctctcgcctggtgtggcctgcacggcagagctgggtgtcggggaggacgtgccgtgcaggcccccaccacaccccacggggcgggccttgtgtccttgcacttttaccgtgcacagaacagatgctgttggcttaaaattctgaaaatgaggttattattgcctgttttttccacagtcagccaaaaccaccctgtaaattacaggggaggacgtgaacaagagac

SEQ ID NO: 25331 - DNA, 1027 bp, Homo sapiens
ttctctgcctttttttttctttttttgagacacagtctcactctgttccccaggctggagtgcagtggtacgatcttggctcactgcaccctccacctcccgggttcaagcgattctcctacctcagcctcccgagtagctagaattacaggcatgcacaaccacacccggcaaatttttgtatttttagtagagatggggtttcaccatgctggccaggcttctctcaaactcctgacctcatgtgattcacctgcttgagcttcccaaagtgctgggattacaggcgtaagcccggccaacatctgcttttaaccatgcattctgatatgcattatcagtgtcaaaaagattttctaagacagaggagcactacggccaagtgtccttttatgatatccacagaattcaaaattgcagagcctaaaaggcactaactttatcctgtcgtatgtcactgtggaaagcactcttcagagccatgttcccacacttgttttctcactgtggagtacatctgtgttggtgacttcagctaaacctgttccccagggataaatgcaacagcccatacaaaatcaggcatgaggacacagtccaacaacttcgtgtataaataaagttacacattcatcgccagttgcttgttttaaaaataaaaaaaaaaagtctccccacagatttactgactttcatgtaggatctgtgtttgtgtaatttgaagtaggcttgatttataaggtttgctatagctaacatttaaagaaatgtttaaattaggcacagtggtgcatgcctgtagtcctagctacacagaaggctaaggcaagaggactgtttgaggccaggagttcaagttcagattggacttcataagatcccatccattaaaaaaaaaaagaaagaaaaagagtctgggcacagtggctcacatctgtaatcccagcactttgggaggccaaggcaagtggagcacctgaagtcatgagttcgagaccagcctggccaacatggtgaaaccacatct

SEQ ID NO: 25332 - DNA, 1032 bp, Homo sapiens
gtgtcagctgttagacactgactcagtggctcagaatatgaaaggctcaggaagtagcatgctggccccacctccctgtccccataccttagcagagcagctgcccagcagggcctccttctctttcctaagagtttactccatccatggtgggtgtcttggtaggcccgagatacgagagggagtgctgctgttacaagaatttacagttgttctcttcagcacagaaatgctgtaaatggcctctttcgatactagtttatgaaattataagtgtctgatgattgtgcatctttggtttcaacagctactctgacctacgacactctccggtttgctgagtttgaagattttcctgagacctcagagcccgtttggatactgggtagaaaatacagcattttcacaggtatcggccatgctggagcccaccctggtctgaccgcttggcctgcagaagcattttgtgatcactgttctctgctaactctgccataacttgtgacttgcaaacttaaggcgttgtgtgtgtgtgttttttttcttttaaacaacctctagaaaaggacgagatcttgtctgatgtggcatctagactttggtttacatacaggaaaaactttccagccattggtaagtactctgttttattacaacgcgggacaaaatatgtttttaggaaggaggaaaacttacgcttgtagatttgacttcaatatgccactgacttcatttgaatcttcacagcaatcctgcttaactgaattggccgaggcctcacgtgtagtagtggcaaagctagaatccacggcgcctgactctaggctagtgtgttttcaactgcaaatcccagcttattactggagctggaaatcagtatcatgagttatgaccaacgttgttttaaatgtaggacagaatgtcatagaaagcggtgtgtgtccgccacgggcacgcagcatggcgcttcagggatcttcgttttcgtttgcatgtttgagtgtgtgttctgggtcacagctgtacaatgtg

SEQ ID NO: 25333 - DNA, 1026 bp, Homo sapiens
gctgtttctctggaagcaccaggccactcgccatgctcgctgtttctcctggtcccctgcctgctccccaccagcccccgcccctgttgctggatgatcctccccaacctgcaagtgctgtggcactcaggcacatggacggcttccagggctgatttgtccctggactccaagctcaggtccagctgcttattctgcatttccacctgggtatctgtgtgcatggtgacctgacagccagagcccgtgctggccccagcctgcttctcctacagtggtccttcaggtgctcaaaccaaaatctgggattgttctagacccctctttttgagacggagtctcgctctgtcgccaggctggagtgtagtggcatgatctctgctcagaatcccaagtgattctcctgcctcagcctcccgaagtgctgggattacaggcgtgagccaccgtgcctggccaggactcctctcttttttctttttttttgagacagtctagctcagtagcctgggctggagtgcagtggtgcaatcttgggctcactgcttcctccacctcctgggtcccggttcaagcagttctcctgcctcagcctccccagtacctggaattacaggcacccgccaccatgcccagctaattttttcaatttttagtagagatggggtttcaccatgttggccaggctggtcttgaactcctgacctcgtgatccacctgccttcgcctcccagagtgctgggattacaggcgtgagccaccgcgcctggccaggactcctctctttcttttttttttttttattttttttccgagacagagtctagctctgtagtccaggctggagtgcagtggtgcaatcttgggctcactgctacctccgcctcccgggtcccagttcaagcaattctcctgccttagcctcttcagtagctgggattataggcacatgccaccatgcccaactaatttttgtatttttagtggagacaaggtttcaccatgttagccaggctggtcttgaac

SEQ ID NO: 25334 - DNA, 1025 bp, Homo sapiens
agtcgtgcttcccactaagctgcagatttctctataaggactcagattccttggttgtcagctcagcgtgtttggtggaggggagagcagagcagagcgtgaaggtgctgggaggcctgcctcaaagttggcaaaacccacagcgtctcagagctgcgttcatgttctagttcctgcctctgtgccagtgagaccagaaaaccaggccactcaaaagcctcttgcgtgtgctctctatgaatggaggctggggcaagggcaggacccctgggcctcaggcgagaagaagcagatttaccctcagctttcttcctgtctgtggcattggctgtgccccggattttaggagccttggcccttctcatccgagaagcacctctaacgcgaaccctccttcgcgcagctatagctgcaaagatgaaccgtctttgaattgtacaaaagcttatggtcattctcctactctctgtaggaagcttgctgtcttcgatacgtggagctccttggcggtccacattgcaatggacaacactgttgtgatggaggaaatcagtaagtggctcagagtttccatggacaagaaagttgaaatcacgggcaacatacacacttcctcgcctgagtccccacgggagcctcggcgagtgttgtcagtcgccccatgccgtgcaggtgctccgtggggcctgtgcgccaagccagatgcacggtggcctcgctctcctatcccggcggtcataccaagagaggagagcccaggctgtctggaggccgcgacttggtatctcacgtcgtgttttgtgtcttggttacaaatcgtttatgaaggccctgctgtgcttaggcgccctcgtgtgggaattctggtgaagttattttgcgtgccttgatgtgcgacagagagatgtagcaaccatctctagctgcaccatctcgagcaaaggcacgtcgtgaaggcagagctcttttcagctttctggaagaaaggtctgctgcaaccctgaaggaacctgggcgtggcaaca

SEQ ID NO: 25335 - DNA, 1034 bp, Homo sapiens
agacttgaacttgggatcataaccaaagggtgtttgtttcttccatctgcctttttcctccattctgtttcttgaaatttttataaaacattggaaacacaggaagagtacaaagaaagagaaaaattattgattttaccactcagaaataactcatatgagcattttgacattcttactctcagtatttctcctgtgcttttcaaaaacttacatagtttcctaagtattttctcctggccatgagtgacagcattgtaattattaactggctacacaatatactattataccttagttccctgttcactgccccatcctccctcccgtgtttggggaaatcacttaccccctcgttccgcacgcgtgctcaggatctcaccaagtcacacctcagtccctggcctcggattagggaggctgttgctgggtgcagtggccaggaaggcgcaagggtcagggcttcctagaacctccgtccctctgggtgcaggtagcactggtgggagtgttgggggcagcttgtctgtgtggactccagctccgtcccttcgggagtctcagggctgcccaaagcagtgctgctgaaacgtggcttgtcagagtgagagtggagtcaggtcctggaagagcttgaatctgcatttcccagcccctggggatggtggctcccgggaggatgtggaggctgcctggtctgactggcttcgtctcactgcgtcagctgcctgaaaggacactgttcctcacaggagcatgtggaaggtgcctgatgcccccatttaggaagaaaggcatccacatccagccagcaaaggcactggcattgatgcacaaggcttgggtttctgggttcctgagtgtggcgtggtgttgtgaggaggacatcggggtcgttctgaatgacccctaccaaaagccccaggagggagtagtggggggagggcaggaagcaggctgcttttttcagtcgtgctgctaagagtgcgcaagggaggacgtctgaggaagaagtccgcaaagccgaagctaga

SEQ ID NO: 25336 - DNA, 1050 bp, Homo sapiens
acttgaggccactggtggaaaagcagcatgccctggggttcattttcagcctggtcgcgggcggcctcctgtgtgcccctttccctgatggtctggtgccctcggctccctccccacctcctgcccactgcttctcagtgtgatgtgggtgcagtgggtctgaaatgcggcctcctctgtccctttcctctgccggctcggccacccacctgcccacctgcctcatcctcccaggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggtacgtggcggccacctgagcacacaggcatttggtgctgaatgctgtttgggaatgacgaggaaaactttcggatttttgcgttttttttttcagcatgttgggataagtactgtgttcacgtggttgggaatctgaagggtataagagccggaactgtgtccttgcaccctcacgtccctcccccaggcaccacctcctgtgcagccttcatggccttcgagtggcccagagagcgtgtgtctggatgtgagcgtgtgtgggcgcgtgctgagtgtgcatggatgagtgtgagccatggtgagtgtgtccccctcacacctacatttaaacacacgggcggcccctccacccacccctgcaccaccttcgtcacacccacatttaaacacgggcggcccctccacccacccactcctgcaccaccttttgttttccggaggctctgacttgacctctctgggggatttcctaagaaggagcttccctgtttttccattttgattacctagttgtgatttttggtgtgtgatttatgcagacctgcctgccctcaaatatatttgatggggaaagaggccaaaaaacccccctagaaatcatgaatgacggtgacatgctcagggaagcagttaaccgaatcgggggctctgttgtggatgctccgccc

SEQ ID NO: 25337 - DNA, 1059 bp, Homo sapiens
aggattggacattggggttgttttctgttttctgctcttatgaatgtttcccgtgtggatttctttaggtgacataaggtttgtttagggtatttaagagtagtgtgttctttcttgactgctctaccggaaaaaaagaaaagggaaaaaagagtagtatgccaggtcataggaaaggtggctacaagttattcatacaggatgtttgagagtcgaagaaggcactgtgaccacttgctgtgtaacattcagagctgggactgtcctgggcacgttgccgtaaagtctgcacattcacacgatcccagactgtttgtgcagaacggttctgcccacttgcgctcccaccagcacagcgtgagttcatgtcagcctacatctttgccacaacttggcgttggctgactttagttgttgccagtctggtgagcacatcatggtgtcttgtgcagggctagcttttcccccatttctccatcagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtgagggcggggcgggggccatggctcttcctctgacctctactcctgcctctcatgcaacaaaatgtaaaaactgcccggaaatgggcatagccaagtggaaggctggctttggtagctgacgctgctggaggaagtgcagacggaatacacttcatgtaggaccatccctgttttttttttttttttttctgggccctttttgtttgtgtatctgctcggaggaaccatttgggttttttttgagacagtctcactttgtcgtccacggtggagtacagtggtgtgatttcagctcagtgcaacctccgcctcctaggctcaagtgattcttgtgccttagcctccctagtagctgtgattacaggcatgcagcaccacacccagctaatttttatatttttagaagag

SEQ ID NO: 25338 - DNA, 1029 bp, Homo sapiens
gagccaccgcacccggccaacacagatgtttattgatcgtggaggatacattgtggaaaatgtttttctctcttttaccatttttgggaagagggataggtaagtgcagggagtttgtgctgaaacagcgcctggcaatttttcagaaatgaatttgatattgcgctccacctttgagctgttcacacctgtggctacccctggaaagcgctggggttgttgatgcttttggctgcccggcttcctgaggtctcgctgctttttggggaaagatgactggcttccctgtgggacgcttttgtctgacacgtgatgatgtggtcctgcctgccactgtgcaccatcccaggtattgaattttgaccttttcttttcaagtttctgtgcttagtgtttttaatgtttacttttgccacttacaataatatcaccaaaataatatgcatagagttttggaagaaacatagaaaacatgagcagaatgagacaattccttgggctgtagtttggacccaactgaatcctgagtgctctgtggctgacgctgtctacccgtgggagagacacactcaggagtggccgtttggccagaaaagaaggtcatggcccctggcctggcccccgccctgcagggacacagaagccacaccatttgcaccatccacgccttgctccagaaggcctggccgccttctccctgggggtgattcaaggatttggtctcggaccagacccccctccacagctgcccggccccagacccatctcttggattgagggtgtgtgggctggaaccagtgggtcactgtggcagcttcatctgagccgaaggtgtgggtcctctgtggctgtgcgattgacctcgatgggaaggagcgttctacccattttccttgttttcagtgctgcggtatcagtcagtgatctgaggaaatcctgtaggggaaggcaggctgcagtgaaaacaggagctggtgaaaccgagccctctgcatctgcgaatgtgccctaggtgctgctgctggggac

SEQ ID NO: 25339 - DNA, 1044 bp, Homo sapiens
ggctccctgcccttcccctccgggccctgagtaccggccccccaccaaggaggagcccgaggtctccgtcccggcggcgatgctgccccgtcggcctctggcgtggcccgcgtggctgttgcggggtgctccgggagccgcgggttcttggggtcggccggttggccccctggcccgcagaggctgctgctccgccccggggacccccgaggtgccgctgacccgggagcgctaccccgtgcggcgcttgccgttctccacggtgtctaagcaggacctggccgcctttgagcgcatcgtgcccggcggggtcgtcacggacccggaagcgctgcaggctcccaacgtggactggttgcggacgctgcgaggtgggtgaggcttgggaagctgcggcgtttccgcgtccctgctccgctgcgccttcccgtggaggcttcaaagcgggctgagaacaacctggatgggggtgccagcccctggctgcgctgagaggggcgtgtgcaccgccacaggctgctggaatgaatgaccacgaacgagtcgcttagaacaacccaagttttgttgttgttgttgttttgttttttcttttttttaagacggagtctcactctgtcgccaggctggagtgcagtcacggagtttcactctgtcgccaggccggagtgcagtggcgcgacgtcggctcactgccacctctgcctcccgggttcaagcgatttgcctgcctcagcctccctagtagctgcgactacaggcgcccgccaccacgttccgctaatttttgtatttttagtagagacagggtttcaccatgttggccaggatggtctcgatctcttgacctcgtgatccgtccgcctcggcttcccaaattgctgggattacaggcgtgagccaccccgccctgccaacaacccaagtttgcctggcgcagtggctctgcctgtaatctcagctgccctggaggctgaagccaggagttcaagaccagcctgggcaacatagccagaacccccgccccactcacctctaaaaata

SEQ ID NO: 25340 - DNA, 1558 bp, Homo sapiens
tgggggtctcagcagacctgcctgctgctgtgtctccacaggcctgcttcactcacagccacttcttcggttctcctgggacctgcctgcggctcctttcttgcttcatttgaatcgggcgggtttatccagcatttcctcctcaggagttcagaagtcgcacagcccggcagtcttcgcgcgggaggtggcgggtctagctcaccaactcccagttcggtgtcttgagctgccagaagcttgggcagccctggaggatgctgagactccgcatgcttgttccttcagccacttacatcttcttgttgtgatgtgtgttccgtattttaagcaatctcaccaggattattattttatggccactttctctgccctccactctcttgtgtccgatcttctgtctgggattatgttgcaaacatatcctcgttcatttcctgcagtaaaggtctcctggtgaccacttcttcacttctggcgtgtctgaaaatacctttatttcatcctcattcttgaaggctcttttccacaggcgcatggcttcaggctgttgtttgttttcttttatcccggtggaaacgctgacccgctgtcctctggcctcctcgctgttgggaactttgctgtcggtagctgctgctgtgaagggattctgcctctctcctggccccccttgggccacttaaagatcattctttctgatcttctaaagttttcagtgtgtggtgtgtgtgtgtacgttctttttcatctccttggaattactgaatttcttaaacctgtggcttggtatcttttaccagttctagaaattcttagccattattgcttcagatattgtctgtgttttcctctccttttgggactgtgattcaggatagaatgtctcagtccgtcttctgtgtctcttaatctcccctccatattgtcatcatcgtgtctctctgtgctgcattctgtgtgatttcttctcatctgtcttccagttcacgaatgccctcttctgctgtgttttatttgctgctgaacccctccatgagtggttccctccgtccattgagttttacattttgattatgaaagtttttatttctaaaagttttgttatttttgtcaaatctgcaatgttactttttatagttttctattctaggtattctcaagctcaccatttgtgtctttaaacatagtttgacgtctataatcccagcactttgggaggccaaggcgggtgggtcatttgaggtcaggagtttgagaccagtctggccaacatgatgaaaccctgtctctactaaaagtacaaaaattaggctgggcacagtagttcacacctgtaatcccagcactttgggaggctgaggcaggtggatcacgaggtcaggagtttgagaccagcctggtcaacaaggtgaaaccccatctctactaaaaatacaaaaattagccgggcatggtggtggacgcctgtaatcccagctacttgggaggctgaggcaggagaattgcttcagaccataaggcagaggttacagtgggctgagatcatgccactgca

SEQ ID NO: 25341 - DNA, 1034 bp, Homo sapiens
ccgacccaggctgggagcgggcacttcgagggagggggtgggacaggggcttacgctgaacggcttggccaagtacacgttcagcaggtgacgggaggagctgtggatattcatgaagggggtcctgacgcacgtgtcctgaacaaacaggtgtgttacttacttgtgacccacgttcaccttggggtggagactgcacatctaactgcgttacaatcaggccctgcacgtcagaaggtggagccgggacgggaagcactcggtgcgcagcctctgtaaaccgccagaaccagtccggggctgggggtccctgctcaggggacagttactgaaatgcggctcttgtccgatggcagctgtggttctggctgggggagcaggggtcagcgaggcagcgtctggcagcgggtgagctgcacctgctttaacgttgttcgtctcaaggccagcgtttgggtgtcagagaaaaagaaaactcccgtggcaggtagaacataaataagtgcagcgtgtgtgacttcgcccctgcccggcatggcctcaggtcccgttgataatgtagcgtcttatggccacagtcagttctgctgggccatggtctccttttattttttaatttttaaaaaatttactttaagttctgggacacacgtgcagaacgtgcaggtttgttacacaggtatacacgtgccacggtagtttactgcacctattagcccgtcatctaggtttcaagccccgcatgcattaggtatttgtcctaatgctttccttccccttacaccccatccccgacaggccctgggatgcgctgttcccctctctgtgtccacgtgttctcattgttcaagtcccacttatgagtgagaacatgcggtgtttggttttctgttcctttgttagtctgctgaggatgatggtttccagcttcatccatgtccctgcaaaggacatgaactcattcttttttatggctgcacagtattccgtggtgtagatgtgccacattttctttacggtctctatgtaacatt

SEQ ID NO: 25342 - DNA, 1041 bp, Homo sapiens
gcgtatactattttcttctttgagaattacaaaaaaattatttctacactgacaggatttactagttaagcaatgtttaatataaattttaaaaaacttctgttctacaaaatttccattccgtatgtaaaagattttgtttttctatataaaaagagctgactgacatatctttaaatactttgtactaactttatcacacttactgtgtcatagaatatcatacagtttatacgctcatagttctcttgtgaacacttcaaacatcgctaagcatttgatctggccatgtatatggtagctgtgttttaatttgagaatcttgagggtagagccacaaatttcaattcttacatttccatttgcaaagtgactagagaaaaagaaatcagcttaaatgaggtattaagtaatgtttagagtcgtaggtattaactagaatataaatccttagaaattgtctttataccttcaaaaattatactatgcatttatcatagaaatgtgattacaaagaagtctgactaccatgtctttaaacatatggcatctctcaacttttcttccttatggggctacatttgttcatttccagcagtagcataaacttacggtgacatggtagacttgtctctaaataaaatttttaaatgtttactaagttaatatttcaattttgtttttcttattttttttgtaaggtaggcagaagtcctatgtctcatatgcagggtgaaatccacctccgttctgggctgcctgagctccttcctgaactctagactcccctctccagctatgcactttacagctccgtttggacaaggaacaacacctcagccttcacgggctcaaatccaagctcttctttctcctcacttagcctgcccctcccacagtgttcctcttcagtaaatggaaattccatccttggatttccttggtcctcagggtgacttcagagccaactttcgttcttctatctcatgccctctattaaatccaccagagattctgttgcctttcagacactcgctgacc

SEQ ID NO: 25343 - DNA, 1102 bp, Homo sapiens
tccagtgtttttcccagatgtttctcctccgagggggttgagcatctgctcctagagtcctgtatggagagcaggtgcgatggtcgggggctcacctacagaagatgctgtgccatggtcttaggtatgcagagaaagctctgagaggttttaaaaatgtgtttcaccctttgtggttcacacccatgttacaggccatgttaaagagacatcaagttcacacccacattacaggctgatttaaagagacatgaaaagtttggcctttggatacacatcctgtagaagcaaaagtggttaaggtataaatgttgacaccaagacagcgtaaacacctagatttttatcttacacagcctcttacttttaaagactcaagattagacttagacttaggtatctggttgttaaagtgctcctaaacttgacaaggtcagctgactggctgcacttgcttgggaagggaggggatccctacagagagacagagctgagggaagctggctgaaaaagagctgaggccacagatcccccaaagaatgccttggtaatgtgacattgggaactagagttcctttctctattagaaacttcctataaacagcaccaaggaaaaacgtttcctgataagaaattaaactctaagtgggctgtggagacagagattccagttcgaacccccgtactttcacttaccagctgtgggacccaaagggaacatcacttgccatggttggtttctccgttgcttctgtgtttgtatttgaggacaggacaaggtaaatggtaactcagttacaactgagttaatattcctttagcccattctccaaagaggttcttgaagaaaaaattaaaagggaagatttacagtccactttttaaataaaactcactttacgttacggaatttttttaaacgcagctgtgaaggcattaacctcttaccaaggatttcctcatgtttgcttaccatcgctgcagagaaaagtcacagttacatggccccagggcccgagccttaaattgaaaacctgatgaagcaggacactgagtcctccacgtgcgagctcctgaatctgtctcagccccacggaggggc

SEQ ID NO: 25344 - DNA, 1060 bp, Homo sapiens
ggaataaagaagggctactcaataggtggagtagtggcatgggctgctcaactaaggatacttacaattgtttttcaattatatgctaaacacggagtggattattcgtgagttttctggaaaaggggtgggcaattcccggaactgagaggtcctctcctttttagaccatatagggtaacttcctgatgttgccatggcatttgtaaactgtcatggcgctggtgggagtgtcttttggcagctaacgcattagaattagtgtataatgagcagtgaagatgaccagaggtcacgttcattgccttcttggttttggtggatttggccagctcctttactgcatgctgttttatcagcaaggtcttcgttacctgtatcttgtgcggacctcctgtctcatcctgtgacttggaatgcctaaccttctgggaatgcagcccagtaggtctcagccttatttcacccagctcctattcaaaatggagtccctctggtttgaacacctctgacaattgtatatgagaagaatgaaataataataaatttctcacttctatttagcagaatttttcattaaaatatcttttgttatgtttcagtgaataaccctataccttccaatttgaaatcagaagcaaaaaaggctgccaaaatattaagagaattcacagaaataacttccagaaatggacctgataagatcattcctggtaggtaaataggatgagtgctgtttgtctctaaatgtctttttcctaagttgttttttgcattgttcgacactccatttcaggcagaagcctccatcaatgccaacaagtagttcagccaccttttgttccaccaccttttttctcatgactgatccagggatgctttggaaactactacctgttcattacaacttctggttatttccaaagggtgttcacagcataacttgtttcatgcaaaggagatccaaatgccaattaactttggcaatgttacagaccaacctccctcttaattaatcacagcacgtgactctgagctctgttttaaaaatttgttattg

SEQ ID NO: 25345 - DNA, 2029 bp, Homo sapiens
ttcttgctgcccaagctggagtgcaatggcgccatctcggctcactgcaacctccaccttccaggttcaagtgattctcctgcctcaggctcctgagtagctgggattacaggcgcacgtcaccacatctggctaattttttgtatttttagtagaaatggggtttcaccatgttagccaggctggtcttgaactcctgacctcaggtgatccccccacctcggcctcccaaattgctgggattacaggtgtgagccaccgtgtccggccataaaacatttttttacaaaaggcttacaaaggaatatttatagcagttttatttgtaatagccaaaagctggaaacaacccaattgtctatcaacagtgactggaaggacaaattgtgctatgtccacacattagaataccagttggcagtcaaaaaggaagagctgatctgtgcagcaatttgagtctcagtaatttcatggtgagtaaaataagctagacagaaaagaacacacactgatgactatatgaagttctggcacagacaaaattcatacttaatgacagaaatcagattggcactaacctgaggcaggggctgggtataggagtgaccactacagagggcacggatgctgtgatcaggagtggtctctacctctgtccatgcacactgagctatacctgtaacaggtagatttcattttgtaaattgtatctcatgaagttgatttgaaaagcctacactgagaggcagtattttaactattctgagataacattgattaaaaaatgcaacatgccaaaatacactaatgctgtgatgccacttgtttttaaaaggagtaaagagctacacacatgcatcatgcacacttaattttgcataaagtatctgtggaaataccttcctctatctgacttaataccattgatgaatcttgggatggatttttttcctggtctggatcttgttaatactcctgtgttgagccacaaagaactgatactgacatcttttaaagaaatttaaatagaactccaaaatgaccctaagtcagttttcactttttaaaattttattttattttgaggcagggctttgccctgttgcccaggctggagtgcagtagcccagtcatagctcactgcagccttgatctcctgagttcaagtgatcttcctgcctccgcctcctgggtagcaaggacttcagcaaggaccatgactggctaattttttaaatcattttattggtagagatgggggtctcactatgttgcccaggctggtctcgaactcctggcctcaagtgatcctcctcccttggcctcccaaagtgctgggagtacccagccagttttcacttttaagataaattacatgtttcaaacattccaggcaccaaaatatatcacattttattggagatatttatattttgctgaataaaagaaagggatttttttctctgctgtttcagcatttgatctgtcgaaagaataaaccatgagtttatacatgagctctgacacaggttttaatcaattttaaaagtttattttgtcaaggttaaggacagcccatgacacagcctcaggaggtcctgatgacgtgctcaaggcgatttgagtatagtttggttttataaattttagggagacatgagacatcaatcaatatatgtaagattgattagatccagaaaggcgggacaacttgaagtgggtagggggcttcctgatcataaatagatagaagacaaacagttgcattcttttgagtgtctgattagcctttgtgatttacaggaatagtcacttaggctgtagtctggcttagtgaaacaacagggcaaaggaaacaatcagatatgcatttgtctcacgtgagcagagggatgagtctgagttccatctgttgtccacagggaatttccttgtgatcaaattgtgagggaggtgtgtagcttcttacctttgtagctatctttttaggaataaaatgggaggcaggtttgcctcacagagttcccag

SEQ ID NO: 25346 - DNA, 1029 bp, Homo sapiens
aaaaaaaagcaaattcaaaagacaagtaacagagagtcaatgtttttaactcatattccaaaaaaatattaatttttaatgtataaattaataagaaacagagagaaaccccctgtaaataacaaggtgcatgagaaacctttgatagagagagtgaaatgtggtcagcattgctcatcataaaagaacaaatggaaaatgcactgagagctactggccagggcagcgaaatggctcctgctactcacacatggtaaacagctaggaaactggacagctgtgtgtagagcactttttgcacatggtggacatgtctgagatccacaagataaggggaacaggaggtgaactccattagtgaccgttttctgcctggagcacttcctaaactgcaggacaaggagggggcacccagagcccaggctcctgcttaaaagaagaggcagaaattgagtctgaagaggctgaggtaactggaatttgcagagcatgttactagcaatgagggacggctgagagaaagagctccagaaatctgcagagggatccccctgagccttctgctgaatattaagtgctagctgtgtagggtgaaatttgcaaagcaggcaagaacaactgccatgaagctttgaggtgaactattcacagtgcttgcatcaggctggggacagccattcgaaacagccacaatggagacagcttattaaacaaccagggcacccaggagagagcccagaagggacacaccttgatggataaaatagttctaaaggctactctagacacacaaacagaacacaacaacaagccaacaagtgatcaagctgatctacaagtaactcactgcctgctaacacaagtgttaacacttttaagggaagcaatgaaatctaggcactcaacatggtaatatctacaatcctgttttactagaaaggagtaaaaacaggaaaacataacccatagctggaagaagaatcagtcaaaaacagatcgagaaatggcagattatacaatttaaaacac

SEQ ID NO: 25347 - DNA, 1021 bp, Homo sapiens
aggtccctgtcaggaggggacaggtttcagtcaggtgggggcgggtttctgtcaggggggcaggtcccagtcgggatggggcagatttcagtcaggagtgtgcaggtgcctgtcatgaggggaccagttttattcaggaggggacaggtttcaggcaggaggggacaggtccctgtcaggaagtggcaggtttcagtcaggagggggcagctttctgtcaggagagggcaggtctctgtcaagagggggcaggtccccatagagggctgtgtcccagcagccaagtgaaagaagcttttttgtaagggtgtgttgggctgtgtcagcgtctgtcaaaagattgcgtatgttgaagaaaaatgaaatcaactttggatttattagggttcatgtcattgggtgagatggttagagctgttttcatcactaaaaataaaagttggttggaattagtttatagtatttggtaaagtatcaactagggacttactattaagcagaaaagaatgacaagagggaactagaaagagggcagtaactttaggggtagataaggtgtgtgattctgtgtgtgtgtgtttctttggtttggtgtgtttgtgtatgttgtgtgtttgtgtggtgtttggggtgtgtgtttgtgtgtgttgtgtggtgtgtctgtgtgtttatagtgtgatgagtatgtgtggtatgctatggtgttggtatgtgtagtgtgtatctgtgtgtatagtgtcgtgtgtatctatatgtttgatgggctatgtgcgtgttatttataaggtgctgggtgtgttgtatttgtgtggtgtgtatgtgtgtctaatgtgatgtgtgtgtcgtgtgtatctgagtgtagtgtgatggatgtgtgatttttgtgtgtatctgcatatataatctgtgtgtgtgtggtgtgtgcgtcatgtcctatgtgtggcgtgtgtctgtgtttaatgtgctgtgtaggtggcatgtgtcaggagggggtaggtccctgtctgaagggggcatgttt

SEQ ID NO: 25348 - DNA, 1742 bp, Homo sapiens
acgagctgcagtgtgtcctcatccgtgccccgtgtgcattgcagctggcggtgtggttgaacggtctttgtgtgctttccagggtgatgctgagaacacacccatccttcatcttctttccgttctgctcccatcttctcctgtgccctctgcctctttctgactcttcgttgtagacattgctcctaatggtcagacgtctgccaagactgtggtcattttcttggtcgcgtttttaccccaggctgttttttacatgtcctgttttgaatgctttctctccggaagctcttcctcagttcactgtgacgcctcaggacagagtcgttattgagggccagaccgtggatttccagtgtgaagccaagggcaacccgccgcccgtcatcgcctggaccaagggaggtaagacccaggccggccctttgcctgctccctccgcggccacagacgcaggaagcacacatttccactgtgcccaggcaaccccagcgtgttctggacagggctgagctgggactggattccacaggaccaaggcactgggaagcgcagaggtgtctgcacatcccccgcggcttcctgtccatgcatggccgtccctcatggacatcatggcaggaaactctgagaagctctgtcattgcggaagagacttggggttcctgcctttgactccctcacacctgccttgtttcagatagtctctaggatgtgcttttaagtagcctcttgaaggaatctatttgcatggaggatagaattttctggaaacagtcgaggaatatattgaaacagacgaatagcttttgctctgactttgcttcccagagccctcactgtcacctccccattcggcatcatgacctttcatcacattctttgcctacagtcctagccctctttcttcaatgggaaagtcgctgggcatgttactgcataaaggcacagcctggatgggggttggggtgagggcaggagctgaaactgctggagaaggagctacgcagacctcctggttcctgtcctgggatgcaagcagtgaccctgagacatcctggccactccagcttgcaccaaatggccagcccatcccttcagccctctgaggggccccacccagggctcctgaaagtctttggggaggaggcttgtgcctgcatcacacgccctggatttcccttttctcaggcagttatgggcaagaacaggagaggtttatcccggaaaggaacttgctggggcctcgcttggctcttcgtcatctccagcactcaatcctctccctggttctcccagctggccatccaccccgctctgactccccgagtccccatgtcctcctggccccctgtgtagtgcttttccctctgttctctgccactgtcaacccctctgtctgagttacgggtgcagggacgttcaggtgtcaccatggtgtctgctggggaggcaaagatttgcttatgcagggccaggccaaattatccggcgccccgacccaggtggagacaagcttctgtggtcatgctgtcagtctgagagcaggagttctccatgcgtccgagtgtccagtgtaacgggcccatgcccttgcagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctg

SEQ ID NO: 25349 - DNA, 1095 bp, Homo sapiens
ctgctcctctctggccatgtttagtcatgaggcagcaagagggatgcgtctgagatgtgagccctgtgatactcgggctcaaactgagtcattgtttgatactcgggctcaaactgtgatgaggcacaaactgagtcattgttccagactccagaggcaaaccgggctgggcttggctctcgggcaaggtggtgtttatagaagagatggacaggagcagggagctggccatccccagtggtcaggaacagaatgggaagatgtgttcatgctgaagaggacatgggaggtttgttccagctctagattttgttatcctcatgactgaaaagtcatattgaccttggctgcagtgccggacaaggagcctgtaaggtgcagtcactctcttcacagcttttgtcttggatggctcccaagttgatgagatttaaaatccagagaacactggaggaattctgcagtattatgttgtgtgcatttaaaagtcagggaagcataaatttggccccagtccatcacacctacattttatatacgaaaaaattgatgcccgcagttgaaatctcacagctaaatatggcagagctagagccaaagccctgaggcctggtgacctgtgctgggctctgccctccaccagctcgagtctcacctgccggctggccttacctaacatccagagtcacctgcaggccaccctcacctgctggctcgccgtgtttctggtgggggggattgggccacatcagagagagtcttgtttatggggcctaagctgacattgcttccatccagcaatccctgtgggtaaggacagattgcaagttgggggattggtgccaggcgaggagagcatgaggaagatttgggagaaggtgggcgttggtctttcgagtgttcccgacggtttggctgcgcgctggcaggtttctgagggcggtcatggggaagtgcttttgcacagtgctggtgctgctcctcctgcatgagcgacccagcttggtccaggctgcacaggctccttaggaaactcgcgtggaaggtgatgaatctcgtgcactgaggaagtgggtttctgtttcacagaggtct

SEQ ID NO: 25350 - DNA, 1035 bp, Homo sapiens
cctcccgagtagctgggattacaggcacccaccaccacgcccagctaattttttgtatttttaatagaaacggggtttcaccatgttggctagtctggtcttgaattcctgacctcaggtgatccgccggcctcggcctcccaaagtgctgggattacaggcatgagccactgtgcctggccaaattcttaattttctatatttaaaaatgaattcaaacacatctgagacttgcgtatgggaaaagtcaagattgttttattttaaaaatcagtattatggaaggtattagaataaactttataacataatctttagtgaccgctttttagaattcataactttggcatgattaaattaagcattaccaagtggtctgtgcattttagtttactgtgaaagggaatctaatggcaaaagtccctggagggaattagattaaaacttggatctccaagcttccttttagttctaaccttcaactattctgtggttctgcagtgacttgtgattttgatattgagtgtaaacctgtactttgatgtttcgttccaaacactacaattcttgacattttttttttctggtaggatttttagtacattaagatttgagaataatggaaacattacagcaaaacaaaaggaaacacaaaaactaccctaaaactccttgacttgaagttcacttgctttttaaatgtaaaatgtaaatgaatctgtgttctgtttttgagactgtaaattgaaaaattcatagttcatgcttaatagttattgcagtcttctctttgaacttgagagggcttgtgttggcgtcgacgttccctaagtaggtcagaggcagcggctctgctctaacacttgggagaactcttgaatgtaagtggaagagtctggtgaattctaccagggaggattaacctcttgaaatgccttcaatgagagcaattttaatgctgagaaaagagccctgggccgactctaattgcatttctagttctgccacttacagactgactgactttagacaaat

SEQ ID NO: 25351 - DNA, 1241 bp, Homo sapiens
gcatggaaccacaaatgaccccaaacagccaaagcaatcttaagaaaggagaacaaaatatgaggcattacacttcctgatttcaaattatattacaaagttataataattaaaacattatagtactggaataaaaacagacaaattggccaaacaaacagaatacagagcccagaaatgaactcaggcatagatgatcaactaactttcaacaagggtgccaagaatacacaatgaggaaagggtcgtctctttgtaggagagcagtctgttgaatggcagagtggtgccgtcttgaagcaaaaccaccatgatgatcaatgtttgactcctccataccaaggtgttctgcagcaagatctttaaactgcagcatagataaacactcataaagatgcttatctaacctcctcagtggtcacaagtttcacaagaaagtctgagatgtgaccaactctacatgttttgtcaaaagaacctactataaaaaggatattttctgtgtaagtctctattaaatattgctttctgaccaaaaaaaaaaaaaaacggaaattcagacttactttaaataaaatataaggctgatgttggtagagatggaaaaattttgacttagcacggattgaaactcttagattaatatttttctgtggggacaaaaataagactataacaactttcaggcaggaagatttcttcactgagaattgttgtgggaaagaaacatggctttggagacaaaatgcgacagtgtctgtgtttcagcagtggaaaacaaaggctgcagtttatctgaagtccttgtcattaaatttatgctccttttcctagtcatagccaagcttccttttgggaataagatgaaacttgttgcatcctggcatgaagcaaatatttctaaaaatctataaccagcagagcaacacttttaacttttaaaatatcaattaaagcagatacagttactcatgattgtaacttactcaaacgtgggatgtttgtattggcatggcaacaggcggctgatgttagtcttgaacatttgttttcttgtgcatgtttttttcattgtataattttcctggatcagtgcccatgtcaccctatccattcacgtttacccatccatccataacccccctttcatccatccattcatccatccatccatccatccatccattaatccattcattcatccatctattcatttattagtccatctgtctgtccatcca

SEQ ID NO: 25352 - DNA, 1029 bp, Homo sapiens
tgcctgtggctgggccgtccgccataccctgagcctgactgcggtgctgccctttagccaaggagccccggctcttcctgtttacttagcgcaattctaaagttgtgtatgaatttgtaagagctttggaaagttgccccactgccttctctcccaggacccctcaactgcccatccctgttcacctcttgtaggtgtggagtttggttgggcacacagaggggtataatctgccaggcctgtttgccacaagggctcagcagctttttctccacaagctgtaagctaagaattatgatgcctgctcttttacccactaattgcatcatccagctttcttttacaacatatttttaaaatatttttatgcaagttacacatgttcatgttagaaaaatttaaaaataaacaggaacaaagtgaaacaaattactcacattgctgtcattcaggagaaacattagctgggctttgttctcagatgcacacacacagaagcattcaggcgtgtgtagtacgtagcagtatttgtctacctgttaatatttatctgtcatgtatctattttcaaaaattgggtcatgatacatgttctgctctataatgcactttgtatggttttaaaatctgggaatatattatgattgtgtgtctgttcaataattagaggcctccatcatcattgttaatgaccacacagtatttgtttgaaatgaccaaatctgcctaacagaatttttattatgggtcatttctttgtttctacttttctgctcctgcaaacaatatttccaaaatgtgattgcatgcatttttgtgtgtgtctgtctagattgtttttacggcacatttctagagaaatctttttttaaaaaaaatttcagtagatttttggggaacaggtggtgtttggttacatgaataagttcttcagtggtgaatcctgagatttgggtgcacccatcacccgagtggtgtacactgtatccaacgtgtagacttttatccctcacccccctcccccaccct

SEQ ID NO: 25353 - DNA, 1072 bp, Homo sapiens
agcaattggattatgatatgccttggtgtggttttctctgtgttttttgtgcttgggtttttaaattttgattttaattttttatttaattttatttttaaatttttggacctgtgggtttacagatttcttcaaatttggaaaatctgggggtgtttcatcttcagatatgttttctgtccccatctttgtctcctctttttgaagattccagttatacgtgtattaggccacagctctctcatccattgcttaattttttgttactgtgcctttttctctatgtgtttcattttgggtagtttctattttttgtcttgaaagtaacaagtctttctttctcaatgtctgatttgctgttaattctacatgtttttcaaatcagacattgtgattttcacctctagaaaatgcgggtattaaaaacaaaccttccatgactacttggtgttttgaacttgtggaataaatacaattttaataatctgctaactctaacatctgtggcagctctgggttggttttaattgaataatttaatcttctcaatagggattgtaatatccttcctttcatgccatatcattttttaagcagattccagacaatggaatttcactttggtgagcactggatatttttgttttcttataattatccttgagctttgtacttggtacagttatatggaaacagtttggttctttaaggtcttgcttttaagatgtgttgggcaggattggagcagtgctttactaaggctcatcgttttcaacaactgaggcaaggcccttccatgtcccataccaactgcctgtgaatcatgaggttttcagtctggctgatgagaacggcactgctcacttctggcccagtgtgtgtgtgaccctgtgatccttctggccccgtgtgtgtgtgaccctgtgatccctactccatttgggtggctcttttctggctgtgggcagtttgtgcagctcagggctcagctcagtgctggacgctctgcaggcccctgggccttttctctccctatcccgggagggctcaggcgtcccatctctgtcctgcc

SEQ ID NO: 25354 - DNA, 1047 bp, Homo sapiens
ctcggcacgtgtccagctgcacaaagcagggtcattagtaacccactttccccgcaggcgcctctgcagcatgggcctggcagggctaaactgagaatccaggagctgtgtgagattgggagcaatgggagattttggatttaacacttttcaggagccccttctggtgtgggctgcccagtgagttggcgctgctcttaaatggccgggctgtggctctccattcctgctctctgcctggccgggtgatgggagggagggttggcgctaattgagaatcatcttctgacaccagcaggcgaagccctgccaacccacagcaagcatcacgcagcatcctcagggtgtcctggtgaagccctgccaacccacagcaagcatcacgcagcatcctcagggtgtcctggagctggagccggaagtccccctccccacacccggggcacatgctgcatactgcagggacacactgtgtgggctgcacctgccccataatgtgtgtggctcgttcagaagagctgtggctgcttcctctgggatgtgaaaagctgcggtgttgggggcagggtgtgagagcactggatgggctcctaggggtgtcaccaatgacatgaggacagcccttgttagtgggaactccagagggccagctttagttcaacaacaaggaccccagacaaaggtcttgggggacggagttgggaggagcaggccttcagcagggcgggtgagcctgctggtgttctccctgagacactgtgctaggccctgcaaaggcatctcctgtagccagggaggcagagactgaagacaccagaaatggggggtgggggatcagaggagggaaggaaggggtgagggacagaaggcagagaccaggtcaaagatttgtgggcccctgaggacctcagggctagagaaagtgggtgccaggcaggggacagtcaggctgggttggataggtgggtgggtagaagggtggatggacagattgggtgggtgagtggatagtggatgggtgggtacaggtgggtggatgggttgatg

SEQ ID NO: 25355 - DNA, 1059 bp, Homo sapiens
ccatgaaggtctctgacatgccctggagaaattttccccattgtgttggtgattaacattcgacttcttgttacttatgcaaatttctgcagcaggcttgaatttctccccagaaaatggttttttcttttctattacatagtcaggctgcaaattttccaaacttttatgctctgcttcctcttgaatgcatttccacttagaaatttcttctgccagattccctaagtcatctctctcgagttcaaagttccacagatctctcaggtgggggcaaaatgccaccagtttctttgctaaagcatagcaagtgaccattactccagttctccatatcggaccacctcagcctcgactttattgtccatatcagtgtaagcattttggtcaaagacattcaacaagtctgtaggaaggtccaaactttcctgcatcttcttgtcttgtgagccctccaagtctccaggtaggagttccaaacttttccacattttcctgtcttctgagctctccaaactgttccaacctctgcctgttacccagttctaatgtcacttccacattttcgggtgtctttacagcagtgcctcactctctgcagtaccaatttaccgtatttgtctgttttcatgctgctaataaaggcataactgagactggataatttataaagaaaaagaggttcaatggacttacagttccacagggctggggagacctcacaatcatgggaaggtgaaggaggaacaaaggcatgtcttacatggcagcaggcaagagagcatgtgcaggggaactgccctttataaaaccatcagatcttgtgggacttattcactgtcatgagaacagcatgggagaaacctgtccccatgataccatcacctcccaccaggcccctcctccaacactgggaattacaatttgacatgagatttgggtgagaacaccaagccaaaccttatcagtattggccttggcaatgatcttttggataagacacaaaagcacaggcagcaaaagcaaaaataaacaaatgagagtgcatcagatttaaaa

SEQ ID NO: 25356 - DNA, 1114 bp, Homo sapiens
gttgaccatcccaaacctgtaatgtcagtttactgctattctccccgctggacggaagcggaaaccaaggctcagagagatgcaggcaccaagggctcaatccttccaggctgctgcagactcatgtgccgcagcattccacgcttgcctctcagcgcgttccatgtaattgccatgccgttctgtgctctcctcttagcgcgttccatgtgatctgtgctcttagtcatacagcagtccctgttccaagaccctagcggacccctgaaacggctgatagtgtggaaccccagacgtacagtgctttttcctgtgtgcaatacatacgataaagtataacttgcaaattagatgcagtaagagctcaatgcagtaatggctaataaaatagaacacctgtaacaatagactggactaaaggttctgtgaatgtggtctctctctctccttgtctcccaatatcttgttgtactcacctatttttagactgtggctgacctcaggtaactgcaactgtggaaagcgaaactggataaggcaggactgccatatgtatggtgtgtgtgtgtgtgtgtgtgtgtgtgtgtgtgtgtgtgtgtgtgtgtgtagttttcaaaatacagcttaatcctgaaaagtcagatcttctttcctcaggttaatgatttgtggttttttctggacagttctcctcgccctccccatctcccaggtggacctgtgtggggatcactcagtctaatccctccctgggtgcgtctttgtgtgccttgtgaggagctgtggcggctgctgcagccaccgtaggaaatcacagccacccggctttgtttttctcgtgtgttaacatggtacaaatcagtatagtcagcagctttgaaggtaccagatagtgttgccttagtccttttgcctaatggtgatattgaagccaacaagcttcctgaaaattgtgagctttcaggccacgtgcagacctcaagatactgagtcagcccttggttgactctcagctctgccatttatagctttttaatttggggctggtcactcatctttctgtgtttgttacctcatctgtacaataaggaagagcgtaggagtcacctcctag

SEQ ID NO: 25357 - DNA, 1050 bp, Homo sapiens
tgtactcaggaggctgaggcaggagaatcacttgaactcaggaggtggaggttgcagtgatcccagatcgctccactgcactccagcctgggtgacagagcaagaccccatctcaaaaatacaatacaatgcaatgcaacgcaacgcaacgcaacggtaaagtaaaataaagtaaaataaataaaataaaataaaataaggaatggttatcagagtctcccttgccccatataaatgttattaaaattaattattagaaaggagatgatgagaaaatactttagtaaaatgcaaagtacaggcgcaacttattctaggaagagtcataatacaaaaatctaaatatacagtgcagaaaatatagataattacttatattgcaagagaaattcctatctcccctaggattttagttcaatttccattaaataatgtggttcaaaagtatgtttttgttgatccttttatgaagcaaatgggtgttttaggtaaagagaggcagatcggtgtgtccaggcgaatggctcagaaaacgccttagtccatttgggctgctttagcacaatcccataaaccaggtagcttccagacagcagaaattcattgttataagttctggaggttgggaagtccacgatcaaggcgctggctaagttggtgtctggtgaggcccctcttcgtggttcacagatggctcctttttgctgtgtcctctagtggtggaagggaagaaggagctccctcaggcctctttgataaagggcactgattttgtttgccaaggctttgccctcatgatctgattaccttccggaggctctgactcctaatactttcactttggggattagaatttccacatgtgaattcttgacggggtggggggcttccaacaagaacatagcagaataagtttttcaaaattctatttgtgatatttaaacttgaagtttaaataattttaaaatgttatgcctgaaggtatactaaccctgcatgtaaggaattttaactagagttgacttttcttctatgtttaataaacagggg

SEQ ID NO: 25358 - DNA, 1042 bp, Homo sapiens
taatttagttttcttttttttagacagtctcactttgtcgcccagtctggagtgtcatggtgccatcttggctcactgcaacctctgcctccgccttccagtataagtgattctcctgcctcagccccctgagtagctgggattacaggtgcccaccatcacgcccggctagtttttttgttttttttctttttcgagacggagtcttggtctgttgcccaggctggagtgcagtggtgcagtctcggctcactgcagcctcttccgccagggttccagtgattgtcctgcctcagcctcctgggtagctgggattacaggcgcccaccaccacgcctggctaatttttgtacttttagtagagacagcgttttgccatgttggccaggctggtctcgaactcctgacctcaggtgatccacccgccttggcctcccaaagtgctaggattacaggcgtgtgccaccgcacccagctcatgcccggctagtttttgtgtttttagtagagatggggtttcaccatgttggtcaggctgctcttgaactcctgatctcaggtgatccacccacctcggccttccaaagttctgggattacaggcgtgagacaccacacccagaccccagactcttttaaacatccagattgtgtatgaactaactgagcgagaactcactcaccaccaagaggatgctgctaggctattcatgagggatccgcccccatgccccaatacctcccaccaggccccacctccagcactggggatcacattgcaacatgacatgtggaggggacaaacatctcgactatgtcgctcccttaaattctttctggaaaagatgggctatagataaataagaagaattaataaaattctaccctttgactgttacagaaattgaggctaaatgagatgaataccaacgtcacccttataattgataacaaatttttactttccaagagtagataagaaaggtttctttaggacaccttttaaaaatattgtatatggttattcttctattaaaggatta

SEQ ID NO: 25359 - DNA, 1030 bp, Homo sapiens
attgtatctggtgtagactttgaagggaggtagcttacctgagagtggaaaatcttacttcacctgtaccacttttgctttattgagggcaacgtggatatagttaaggagtttggtgagctggcgtttacaggaaagtcactttctttacacctgaacagaattctccaaagaaggaacttgttggggatgtgggggggagtgtctgccattagtcatttcttccacagaatagctgtttttactattccctgcctttgtcatcttgtgtatttcattcattttgaagtgcagccacaatttagtgctcccattattagttctataacttgtaagattagacatgtatttttctaccatttagaaagattaagataatctacacctctgttgggttagtgtgtgctagtgggttaggcattcatttttttctttcctactccaaattgccaactttccctttggttatttttgtgtttccaggagtgccattgccaatctcgtgggctctgcagaaagatcgtgtaactgaaaatttcagcaaataaataaataaataaataaataaaattcccttgtagacagaactgtctgtacactccatttttgtaaagttggaagtgtgaacattatatgaatatatgatggagttttttttctttaagccataattgcatgttcttttagacccaatatggtatataaaatggtcactgaatttggaatcagaaaatcctggttgaagtcttaatcttttaacttcttatcattcaatcatggttaacaatggtattaataatattcacaaagttagatattttgtcattgagttcgttgctatattgcttggtcgattagttgatattgagatcgcaagagcatcatcaccagtaagtgatacattttcgattgtaacctaaggtcgttgttattttgtaatgccatgctgttttccttcttgtactacccatgaaatgtttttttatgttctaacgcaatatataatatttttatgttcttcacttgttat

SEQ ID NO: 25360 - DNA, 1026 bp, Homo sapiens
tgtcaaatagcatcacatgctagagaaatctttcatgaaaagaagagtcaatagatgcagaaacttcattgttatctaagaaactgccattgccactccatccttcagtagccaccaccctgagcagttagctgccatcagttttgccattaaggcaaaaccctccaccagcaaaaagatgacaactccctgaaggctcaggtgattgttagtattctttagcaataaagtattttaaaatcaagatattcccagtagttttttagacataatgttattggacacttacttgactgcattatagtgtcagcataacttttacatgcactaggaaaccaaaaaattaatatgactctctttttgcaatattaatgttattgtggtggtctagaaccaagcctgcaataagtgtgcctgtgtttcagaaagaggggatttcatccagggaggaaacacagatcttagttaccatgggaagcagctaccaccgccgcatggagacgcaaaaggaaaaggtaatgaacctggagcttggaggaggtaccccgcagagcacacactggcacacgctgacacaccccaggccctctgcgggagtgttggcatccatggagcaggtcttctgagagactctttggaactgagaccctgcagcgagcacccgtgtgggcacagatgggcttgcactctgctcagcctgagccctgacatcccctccttgtttcacccctgctttgtgctttccaagtcctggttatatgggcaaaatggaggctactgcctctaaatcaataaagatccatatctctgcccatctgcccatctggacaatgtggacagccaagtgtcctgctcagagttttgcctcctggtatgatttctccttaccagttgttgtcagagacatttcttcatggagcacctaccgtggctgcagctcatgaggcagtgctgtgtgcaagccaagggctggtgctcccaagctgagggatggtgctcctcttcattcgcgtgctggggagcttc

SEQ ID NO: 25361 - DNA, 1043 bp, Homo sapiens
cagccatctttcacgaggacattttccatggtggtctgacgtgtccctgtgtatttaaccacttctccattgggggacattgactttcactatcttgcccttgtacaatgctgtattgaagatccatacctacacgtctgttcttctttcttggggagagttgctgggtcacgtggttctgacacccgctttcccttctcacagtgacctcaccacgatctaccccggggcctctgcactctgtcctctcgcagccaccttctcttcctctgactctgctgctggcgggcccccctttcccaactgtgtgctccttcctgccacaagcggaaaggcaggataatgacacggggaaatggatttggagttgggcagactcgagttggaatcctggctccatttgagttactgtatcctgagaagtgaaccgttctctgcccctgacttttctcatcaacagaatggaaataacatctgctttgtggagtgacattagatgggctgaagaatgcaaagtgcaggcacataatagagattgagtacatttgggttctgtttccctttctgcaccactgtccgtggtctgcacactgctcaagacccggcctcccgccccatctccatgtgcccagcttatgtgcagccgtggcgcggccttctgtgcctgtgggtggcctccggccccatctccatgtgcccagcttacgtgcagccgtggcgcggccttctgtgcctgtgggcggcctccggccccatctccatgtgcccagcttacgtgcagccgtggcacggccttctgtgcctgtgggcggcctccggccccatctccatgtgcccagcttacgtgcagccgtggcgcggccttctgtgcctgtgggcggcctccggccccatctccatgtgcccagcttacgtgcagccgtggcacggccttctgtgcctgtgggcggcctccggccccatctccatgtgcccaccttacctgcagccgtgccgcggccttctgtgcctgtgggctctcccatttgcacgtctgcttcctg

SEQ ID NO: 25362 - DNA, 1033 bp, Homo sapiens
caggacaagcatgtgccaaggccccaggtggcggcgggagactgtggccctgccccacccgctgctctcatctgccatgacgccaccgcatcaggatgccaccccgtcaggatgcaccctgcgacaaccttacctacagcagactcgggccacggggaggagaggggaaccctgtgaggggccacgaggagctctcatggcaattaccccttagtgcaggcagcctactccttactcagtaccctctgcacacgaccttggcccctccaccgcctgggtacataggggctacagcatgccgaatgagctttctggagcatggtgaatgagctttctggagcatggtgaatgagctttctggagcatggtgaatgagctttctagagcatggtgaatgagctttctggagcatagtgaatgagctttctggagcatagtgaatgagctttctagagcgtggtgaacgagctttctggagcgtggtgaatgagctttctggagcgtggtgaacgcgctttccggattgtggtgaacgagctttccggagcgtggtgaacgaactttctggagcctgaatgaactttctggagcatggtgaacgtgctttctggagcgtggtgaacgcgctttctagattgtggtgaacgagctttctggagcgtggtgaacaaactttctggagtgtggtgaacgaactttctggagtgtggtgaacgagctttctggagtgtggtgaacgcgctttctggattgtgaacgagctttccggagcgtggtgaacacgctttctggattgtggtgaacaagctttctggagcgtagtgaacgagctttctggagcgcagtgaacgagctttctggagtgtggtgaacgagctttctggagtgtggtgaacgagctttctggagtgtggtgaatgagctttctggagtgtggtgaacgagctttctggattgtggtgaacgagctttctggagcgtggtgaacgaactttctggagtgtggtggacgagctttgtggaacatgttgaa

SEQ ID NO: 25363 - DNA, 1027 bp, Homo sapiens
gccctcagctcggtcagcaccttgtgcgctcctggggctccatgctccaccccgcgtgcgaggcacacagtaggccctcagctcggtcagcacctcgtgcgctcctggggctctgttctctacccggcatgcaaggcgcacagtaggtcctcagcttggtcagtgcctcatgtgctcctgggtctctgtgctccaccccatgtgcaaggcacacagtaggccctcagcttggtcagtgcctcatgcgctcctggggctctgtgctccaccccacatgcaaggcacacagtaggccctcagctcggtcagtgcgtcatgcgctcctggggctctgtgctccaccccatgtgcaaggtacactgtaggccctcagcttggtcagtgcttcatgtgctcctgggtctccatgctccaccccatgtgcaaggcacagaatcctcagctcacacatgcactatttctgtgcgtctgactcttggtggtacctgacagcacatggtctgttttcctgaggcattttgagtctctcactgttgggactgtgtctagactatggcaagaggttggcgtggctggggaaggtgtggaccaggtcagggggctgtgaggccaaggagcctggtggcctggctagcgtctgttctgcagccaactttgtggtttgttacttgaagttatctgtacagcaaccctttggggaaaaaagtagtaattacacagcttcattgtgaaaagtcaacgtgaagacagaaaaactgggtgaaagttgaaaagcaggaacttgaggaatgggtctcatagaacgtgtgagtgtggcctgtgagttgggagagaggcaggattctgtccaaatagtaatgaatttgcaacatcaggtataatggctgcctgtggattgcctcataggaagtttgtgtagaagtatgggacttaaatgtacctaatcaaggtctatttcaggcattaaataaataaataaatagataagtacttaagccaagctggtgtgccacagtggctttgcaaa

SEQ ID NO: 25364 - DNA, 1035 bp, Homo sapiens
tcctctgtgccattggccttttcccctgagggagttgttgcaatgacctgccgggccagcagcgctaattaggagcacacagcgcacttccagagcacctgacctacagctacaaggcttcaaggatgctgcttctgaggcacagattttgtaaatacgccttgttgtataaacatgttttcttcttgctggtttttgtcacgcaggatggagatgtaactattgtctcagagtgacatttgtaatgacgctcaagcactggagtttagaagccaatgagattaaatatcttaaacacttttctcctttctgtctttagaagtaaaattagatgttatggacccaactattttgttgctggggtaagttccaagtatctgaattccttcttgtctttttaggagacatcatagaatcgtttggcattcttcctgtagctcagagtcccacgattgtctttgtaaacacgttgcaccaggtcttcttcaggggacaggtcgcaggtgagctcaaaggtgtttatgtaaacaagcacccctcctgagtttggggtgcatgtgtggcgatcgaggagtagcacgtcaccagatgtattttggcttcagagtttggaacggtgtgtgaggagaactctgattgccgggacagagctgagcattgcagaatgagagtcctggttctggatatgaaggacgtgaatagcaaggggcttcagacagtagggagcacctgtgttttttgtttagttgtgttatggaaatgaggcatggctctggaatagtgggccattttttcgaggccgactcctgtgttgtttcttgcgttcctcactgactcttcagatcccgtttgtatcatctctctgtcctcattgactttctgtagcacctccaaattcagtgtcatctggcagtggaattaatgtgctgtttatggctccttccagatcactaatgaagatgtgaaataagacttggtccctggagcagcccacgacggctcctcacggcgtcctgctctatcatttgccgggtg

SEQ ID NO: 25365 - DNA, 1030 bp, Homo sapiens
caagtggtgccctgggcagggtcggctttcagaaggtgccgccttgagcgggtgggtggccaggggctgccctaagcctgagttagcatcatgggagaatccccccaggacagacagctgcccgaagctgcagggcccgtatgtggccacggcctgggagtccagcctggagggcagcatcctgcatcctgaggagcagcagtgggcacacggagcgacactgtctaagcactgggccactgcccgggaggagctgggaaagccaggtgggtgccgggaatggtgcagcctcgtgtgctgctcatcatgggctctgtgggtgtccctgcaggggccgttaatcatgtccccaggggcagtgagctgtctcgggtgggtcctgcgctccaggggctggggacctgctctggctttcacagtgccacatgtcgctcgtgcagtgcctggggaggaggtgctcctgtctctgagcctcagtcttctcatctgtaagatgggaggaattccgtctgccttgactactttagactttgttgggattcagagaaggccgtgtgcataacatgcttttgttatgtgatttcttaaatcgttgttctgtcccgtcattgttttcacactggcgctgtgaattcagttttcctacatgtctgggccttgactctgaaccttccaagagtgttcagcctcacccttgctgcctactccaacacggcagcagcggagcacccctgcctccgccagcagggcccagtgctgcctgtgccacgcactgtgctgcctccttatgcagatgggttcatttagccccgtgatactaagcagcagacactgttggaaatcccagcttttcagatgagaaaacagggttcatagaggttgcctggaggctggattcaaacctgggcccatccagactctgctctgggtgtcttcacgtcttgccaccatagctcccagactctccctcacatggtaattctctgtaagggactttaaaggcactcctcaggaggaggctgctcacgtg

SEQ ID NO: 25366 - DNA, 1030 bp, Homo sapiens
gttcctcactcctaaacttcaggaattcgccgaggggaaccttgtcaatatctaaggacctctgacccaggaagcccaggctggtgccgcaagatcattagagaatggtcatggaactgtcatctgggggagcccaggctggcacctcgagatcattagagcatggtgggtagacctgtgatccaggggagtccaggctagtaccctgagatcattatactgtggtatgtggactgatccaagggagcccaggctggtgccccgaggtcattagagagtggtcatggaaccctcatctgggggagcccaggctggcaccctgagatcattagagcatggtgggtggactctgatgttggggaacccaggctaataccctgagatcattagagcatggcgagtagagcctgatgcaggggagcccaggctggtgccctgagatcattagagcatgataggtgaactctgattcaggggagccaggctggcactcggagattattagagcatggtgggtagatctgtgatctagaggagtccaggctagtaccctgagatcattagagtgtggtaggtggactgatccaaggaagcccaggctggcaccccgagatcattagagtgtggcgggtgggctctgattcaggggagcctggctggaacctcgagatcattagagcatggtgggtagacctgtgatccaggggagtccgggctagtaccccgagatcattagagtgtggtaggtggactgatccaaggaagcccaggctggcatcccgagatcattagagcgtggtgggtgggctctgattcaggggagcccagctggtgccctgagatcattagagtgtggtgggtagagtctgatccaggggagcccagctggtgccctgagatcactagagcctggtgggtgggctctgattcaggggagcccagctggtgccctgagatcattagagcctggtgggtgggctctgattcaggggagcccaggctggtgccctgagatcattagagcgtggtg

SEQ ID NO: 25367 - DNA, 1089 bp, Homo sapiens
caaacatacttgtgctctgtagtttttgcccttagctcacctgtaaatcactaggcttccacattgccatgaatcatatatgaattaaatccagaagcaccacagacttagattagacggcattgcttaaatcatcacttcgttataacaaatctctttgtaaagatcagagttgcaatttatcctctttgtcttccagtagtgttttctcctattgtgcttttaccctgccggtgcctgggctggtgggaggcatcttgcggcgtttcctgtgtgtgtgccgtttgttaggggtgcttatagagaagctcctgttgtctgctgtacttggagacccacgtgtgttttctttgttgttgctcttttgtagccccttccttctttttgtttccattagtttgtgtgatattttggtgaacggtggcatcttttaatgaagaggctgagggcttctgagacacacctttcggcgcacaccctgcgtggggcagccagtgtggacagtagaaccgcacgtggagagggcaggccgatcacagggccagctggcgtgagttgttaggagcaccctccttccgaaagacagttgccctcttctaaagctgctttccgtgtctttcttcacagatgtcctaaaatcctttttcatgattttttttttttttttttttggaggtagggtcttgctcttggctcttgtcacccagtctggagtgcagtggcacaatcttggctcactgcaacctccacctcccaggctcaagcaatcctcccatctcagtctctcaactagctgggaccacaggtatgcactaccatatctggctgatttttaaaaaaatttctagtagagatgaggtctcactgtgttgccaggctggtcttgaactcctgagctcaaatgatctacccgcttcaccctcccaaagcactgggattacagctgtgagccaccacacctggccttccatggatcttatcttatggggaggaaaggagacgcagccatggagaaggggcctctgaggagggtgtctagaaacagagttcatttggagggcccggctcttctttaggacgtggctattg

SEQ ID NO: 25368 - DNA, 1043 bp, Homo sapiens
gaaacccccctcgtgcaggaccagcctcagcacaacaggagctgcctccatggtcctgcagggcatggcctttctgcaccctggatattccaggcaagctctgctttttctgtggctcctcaaaagcctcccagcctctacccactgccaaaatccagagctcctcccgcatttcaggcagttgttactgcggccccggcttccatagtcattatacactgcagaggaattcccacaaacagcggcttccaacagcgcatgcctcttcaacagtgtgtactggctgtagcttcgtagcgcactggcctggggtctccaggcccccaccaggctgtgtcagggctctcgcctcatgtggctcctggggttgtaggatgcaggcttgtttcctggctgtccgctgggaccaccctcagctgctcccagctgtaagtgggctttgagttaagctgccaagtttgtggcaatttgtagaagcaacagaaaactaaaacaattgccaagcactcttggtcttgttggtcgtccacaggtgtaagttgattgtgtccttcaagttaccctggatctcgtgatttccagtcgtggcttccagagactgactctttctgccagactttgaaggcagcatagatcttctgttaagtatttccctaatctgtcagcctctcaaggaagaaagacgaaattgttccacaacattcatgtctaagttccaagaattctattttattcctgccatagcagaactgagatttacatcccacagggaaggctgttttccagtgtgaaatgctgcaagttcctgctctgatcaggaaagagcagcacagctgcttgactcgtgcttaacctggctcttcgcccttcgaagcacacacggcgccacgtctcatctgaatcaggtcatctgcagcagtggtcgcacccgtggggcaaggcgccaggccctcctgcttcaggtgcctccggaaaagcctggagtcacagacctaagcttgctgtgcataacgcagggcagggaaaacattctagagacttca

SEQ ID NO: 25369 - DNA, 1020 bp, Homo sapiens
ttctccatgttggtcaggctgatcttgaactgctgacctcaggtgatccacccacttcggcctcccaaagtgctggcattatagacacgaaccaccgcacccggcctatatgctttcttaatatccattctggatcagtgctgttggaagacaaaattacaacaaatttagttaaagatctaattagcttttattcttgatttgtgaatagggcaacctccgttctacaaaatagaataagagctcgatagggtaatagcacaacagtgggttttgtagggcggcaacaaagaaacagaacaataggtagaaaagctgattggttaacgtcaagttacattaggttacttttttcctaagggttaaagcagaagcgacttccttattattctgactcaggaagactggaatcttctgatcgcaggaaaagctggtctgtttgagatgcacctccttctttaaagttttagtttgatcaagtggcatatggcatgagtggctgcattttggtttggtctcatcctggggcctagtgcaggggctcagtccaaaacagtgacctctcctgggccaggcatggtggcttctgtcatcccagcactttgggaggctgaggcggcagattgcctgaagccagaagtttgagacctcatctctaaaaaaacccaaaaaacaaaaaagccacacacacaccccatattaacattatatatatgtaacatctcccataatttttaacagaggtaacacatgtggacatgtttgtgtatctgtttaatcaatctgttattagtgacatagagttctaaaaaaccttttgtcatacatacaaacaattggaagattattttagcttggaataaactaaatacctgctgctataacaaaatgacaaaaatagcttaaactgggcaatttataaacaacagcaatttatagaattcttatagttctagaggctaagaagtccaagattaaggtgccagcagatttagtgtctgatgaggatcctgtcctcat

SEQ ID NO: 25370 - DNA, 1030 bp, Homo sapiens
tcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgct

SEQ ID NO: 25371 - DNA, 1045 bp, Homo sapiens
tcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctctt

SEQ ID NO: 25372 - DNA, 1045 bp, Homo sapiens
aaaaatgctattctgtcaatgtaaacatctttcataactgtagtataataatcaaaagcaaaaattaaaattggcataatactattaactaaactacagactttatatgaatttcaccagcttttccacaaatgtcatttttctggtccaggattcaattcagttgcattttatttctccttagtctgttttaatctgtgacagtttcttggtctttccttatctttcatgaccttaattaacacttttaaggaatactggttagttattttgtagaacgtccctcaatttgggtttgtctgatgtttcctcgtgattacaaggggactgtatattgctagaaaactgcaggagtgatgctatgcccttcccagtgcatcagagttgaaggttcttgatgtccataagccttcccaccactaatgctaaccttggtcacttggttaaggtggcatctgccaggtttcagcctgtaaagttttattgttccttctataactagtgaatatcttggaggagatactttgaaactctgcaaatatcccgtttctgcttatacttttgcccattaattttcacttccgtctgtggatcatgtgtgcactcactgttactatgtttgcctaatggtcattttctgctttcctgttctacatttattaattggaattctgtaaagaaaagctgtctctgcttcctaattaattcacttttttcaattatttagttatattactatggactcatggaaatttattttatctatgaggcataatccagtaagatcattagttattttgttgattaaactatttttttgtgatttttttgaacaacaaaaaatgtaaacaattgtaactgtatccagagcaaggagactggttgaggaataaaagcatttgaaagatagaaaagataaatatgactcagcaataagaagaaatgaaggactggcatgttatgacatggtggaccttgaaaacattatgttaagtgaaagaagttggaaaaaggaaaataggaagttataagacctgataagtta

SEQ ID NO: 25373 - DNA, 1056 bp, Homo sapiens
attctgtttgaatttggaaaagtatttactcatttttgcctcttattaaagtatagtgaaaaattgtcttcacttcccgcttgaaagtctttgtgccagacttcaactcaagaaaacttttttcctaaacaattttcaactaaattgattgggatattttcacagaaataatattacagtaatgttatgaaatcctagagtacagttaaaagtttaaaaacaacaaaattatgttcattgcagtagtttagtacttgtgtttttattttgttttgtttcattttggtttttttgagacagagtctcgctctgtcacccaggctggagtacaatggcacaatcttggcttactgcaacctccacctcctggattcaagtgattctcctgcctcagccttccgagtagctgggacccaggcgtgcaccaccgcacagtgaaaaattagcccagctaatttttgtactttcagtagaaacagtgtttagccatgttggccaggctggtcttgaactcctgacctcaagtcatccaccactgtggcctcccaaagtgttgggattacaggtgtgagccaccacaccctgccagtacttgtgttttttaaaagattgctcttaaaatgtagtgttatgcctaatttgtcagctttgacctagtatttcttaagtagcttgaagagtaagttatattttccaatcaggtgaataatagctttcttttgtgttttggatgtcttgtagtaaactgtaatttccttagcactcctattttggtatttttgcaaatctctacagacagctttttaaaaacctatttataataaggtcgatagtgtaaactagaaaacaggatttccacgaagtgccccagatattgaatatgttaaaagaaagacatcaaacgtcaggctagcaaaaaccctgccatttaatatactaaaacagtgttgtaaattaactttggtacaaattgccagtcatctctagatcattttaagcattttaagaatatttattatcaatctaagtacagaagaataactgccagcagtgatt

SEQ ID NO: 25374 - DNA, 1047 bp, Homo sapiens
tcctttgagttaatgttaataggagagaaaaagagaaccgttgtggtgctttcgttgagaggttgatgattattttaaagtcattttaacatttcagctgaagtgtttcagtgacttcagttatccacagtaaaccacaataattctcttcagtgcttacaggatctttaatccatgggtcatcatcactatatgcaagaatgacctttagtttagtcagagagcctttaacatacacattattgcatgcaattcaattctctgagctaaaattcctgagcaaagttttgaagaaaatcagatactgtgaagaagttaatggccttaatgacacagacatgctgacatagtagctattcccatgctcaagaatgtagacaaatacatgtcattaaaaggtgtctgtagtttcttttagggaccagtaaaggagcattaggcaaattttgaaatgagtttttggagaaggggaaatcgtgtgattcttgagatgtgtttagaagctcaacaaaggtgctctgcatatattagtgactttgtctagtagaataaccatatcatttgcttttattttactatgaaaagatcattttatgattagcataacaaataatagatgcttactaagcttcctttgcttttaagaaattaacaacgacaatagaatgtaaaatttgttttgtcgaagcctagaaaaactaagtagtcacttagttcaatgccaaattgaaagctgtggtggaaggtaaagaatcagaacatgggaacattgccagaactttgtagctggaccaacagagagtacctagcagaaaagtatgtgtagcccatcgagctctgtagcagaaaactctgtgtttctggacaacgggatttcccattggtcccatctctgctcagtcagccgtctctatacaaagcctgcagaagagtcaagaactacacaaacgtttttggacaaattgtcatgtcacaaggtaatgtgttaaaaaagccaggccataaggggttaaccagctatggtcttttcaaaatagagatgatccc

SEQ ID NO: 25375 - DNA, 1091 bp, Homo sapiens
tctcacgtccatcagtaaaaacgagtttgcccagagatcagaacaatggcctagtaagtatataaaagggtaacgcaaatattaatttaataataaacatagatagcatttgaggtttggttatttcctttacatagtaaaagagtgcaactgattttatacatagttttaagaaacaacctattactaacataaaatgtatttattttcatttctggtaaatatctatggaaggaaaatgactagcagtctcagcgaagaaatgttgacttgtttatagccagaaatttctggcttgtaatatagtgtttgctaccaaaacttttaaaactaagcctttacatttggtaatttctaatatcttcttaaagaacatgtgtatacagtacctttatagtatgtaaatattagcaccatgatataaaaaatagaggatgtattgaaggaagaacatttcaatcaaatggcaggaattaaacaagataagggaaattcttccaatgaactattgaatctaagaaagacatttgtgcccaaaatattagaggttcctgatgataaaagtaatagtttaaaaaaagaaactctctattaatatgtttttataaatcaggaggcaaaaacataaactgttgagtttcagtgttgtatattattttaccatcatgttcatttgtcttcacagtttggctccccccttccccttttcacccacactctcctgttttgtgttgttaggaagttatcaaggaggatgctgctgaggggctttcttcacccacagactcctcgagggtaatggagtagtcctgtggtgtggatcgctggcatctcattgcttctgcctcagtaatgactgtcttaattgtgatgatagcagctcactaactctgcgtttgtggtgtgatgagcagctagtgtagagtagctgaatgctaataattatggttcctgaattaattaaaaagcggatgtttaacttcacccattatttcctcctgcttttcccctttttcaatacatgggatggggtttttttttattcttcaataaggaagggctttttctatcagctgtcaggggtgttccgt

SEQ ID NO: 25376 - DNA, 1114 bp, Homo sapiens
atgcccttggttgcgtttcttggagttctccttttctatctagacctgctaccttggcgaccgcatttactctgaaaggcttaaatgccatctatatgccagtgactctcaaatatgtatcttcagccctatagctcttcagttgcttgtttgacatctaatggtgtcaatatatatctgacacataatatgtccacaattgaatgtttgattctctgactcaaacttcatccatccatgtctttcctatctattaatccaactcttttccagttccttaagtaagaaaatcttgatctttctttcatatactaccaccaatctactagtaaattctgtagcactgttttcagtctatttccagaagatgagcactgttcgccattttctggcataccaccctcatcagatacattatcatgttctacctttattaattatggaaatagtctaactggtctctactcctgtctttttctctctacagcctattctccatacggcaaccacagtgattcttttaaaatagaagccagtcatgttattctctgctcagaactctgtaatgtgtcctcatttcactgaaaacaaaaatctaagtccttatagtttcctacaaagccctttatgatctgattttctgcatccccttcctccttctgacctcatctcccaccattctcctcctccatcccttactgacttctttgctgttccttgaaaatgtcagatatgctcccatcaaaaggctcctcctgcaattgctatttcttctgcctgtacagattgttctttggatatatgcatcatggggtttctcacttccttttaagtctttgcttaaatgtcagcttttctacaagatcttccctcaccatctcgtataaaatgacatcttctttggtatgctttgcgttacctgttccctgctttgttttactcaacagaaaaaatcacctctaattcactacatcatttacttttttgtttgtttgtttctttggtttttgtttgtttcccctcagtagaatttaaaatccacctggcaaaggttttctatctatctttctttccttctttttttttttttttttgagacagagtctcaccctgt

SEQ ID NO: 25377 - DNA, 1052 bp, Homo sapiens
aacacataacataaaatttattgtctttactatcttaaccatttttaaggatacagtttaggagtattaagtatttctccattgttgggcaatagattccagaactttttcttttttttttttgagacggagtctcactctgtcacccaggttggtgtgaagtggtgtgatctcggctcactgcaacctccgccccctgccttccagtgattctcatgcctcagcctcctgagtaacttggactacagtcgtgcgccaccacacctggctaattttttatatttttagtagagatggggtttcaccatgttggtcaggctggtctcgaactcctgacctcaagtgattcgcccacctcggcctcctaaagtactgtgattgcaggcatgaccactgcatccggtctaccagaactttttcatcttgcaaaatcaaaattctgtctattaaacagcagctctccctttccccctctccctaaaccctggcagtgaccgttttactttctatttgtatgaatatgactatttagacacctcatgtaattggacttatatactgtttgtctttttgtcactggcttatttcagttagcataatatcctcaaggttcatccacgttatagcacgtaacaggatttccttcctttttaaggctgaataatatttcattgtatgtacgtagcacattttcttggtctattcatctgtggctagaaatttgggttgcttccatcccttggctattgtgaataatgctgctataagcatgggtgtgcaaatattatacatgtttttgcttgtgttttttgtttttagacaggttctcactccattgcccagcctggagtgcagtggcagaatcagggatcactgcagcctcgacctcccaggctcaagcgatcctcctgcttcagccctccaagtagctaggacacaggtgtgcaccaccatacctggctaattttttgtatcttagtcgagatggggttttgccatgttgcccaggctggtctccaactcctggactcaatctgtctgcccgcctcgac

SEQ ID NO: 25378 - DNA, 1027 bp, Homo sapiens
tttacaggtagagccaaaagcatttgctaatagattgagtgtagggtgtaagaggaagaggtaagtcatgaacaatttcaatgcttttggccttggaagaatggacctggagctgccgtttactggcatggtgacagcaggaggagcaggggagcattttggagtggtgatgaggagggtttggggatggatgtggagtttggtgtttggataagttaagatggaggtgagtgtgaacctaagagacatcacggcagctttttgacacctgagctatggaagccgtgggaagtcgtatcttcacttctgccactggaggtgtccttgcatgaggttaatgttaagaaggatattgtatttaatagtaacttaattttttctaattataaattatgtgtattttgtctaatttaacaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgaggtaagaccaagtttgcaaaattacattctttcacaaatatttgttgactgcctgctatgtataggatagaagtgtgtaagaaataggtagttctaacccttagtaatactgcactgtacttatgatagaatgtcttatagttaaaagtacttcaaatttcatgtttttggagtacattttaacttatataaatgactgttgaatttagatttattgttttttttcccctgatggaataattaatattcaggaagcttgattactgaaatcaagtacttctgtgaaactttacagatcatctggacctgatcttgattaaccagacaaaatcagggattgttgaaatactttcttttttatttttatttttattttttgagatggagtttcactcttgttgcccaggctggagtgcaatggcacgatctcagctcaccaaaacctccgcctcccaggttcaagtgat

SEQ ID NO: 25379 - DNA, 1033 bp, Homo sapiens
cgtcgtaatcatccttggaccttttcaaaaatcaagattgacgcttgttggcagcaaggcctaggaatgtggaggctgaaggaggtgaggggaggtgctgggagacctggaaggagtgtgaactacaggccccgcgaaaggcagaggtctcgctcctggatccggaagaaggctgctgagcgggctttcatttcttatgtatgtgcagtttcttctgaagatataattgatgtttatttctctgaataagcttgattataatggaaaatagggataataaattaactgtaataagagtgacattgacactgaaaaaccttgcctggggcgcttgtcctgggtgtccccgccccgcggcccctccagccccgcctgctctacgccccgccccgcccctcccctccacgcccagggggcgtggcaacccggagtccctcccctacccagggcacgtgatctgtcagttcgcggagagggaagaatatggccgccgggtgtggtgagggcgacgcgcttgcagtcgccgtctcttgcttccccgtcctctgacatcgcctgcagccgagcgggcccgttccgccggagctgaggaccaggttgggagaccgtcagtgtggaggccggtccgcgaagctttgccgcgggattggggaggagtcgggggcgaggccgggctcggggagtcgggcggggaggtgggacagccgaggagtgcgcggaaggggcgagctcggaccgggggtcccggggagggcatggcgcgggccccggacgctcgggccccggctttcggggcgagtccgcgtttcctggagcgccgggaaggtctccgaccttggagtctctggtggtctgtctcctgaggggcccctcgggtgggttggggtgaagggtgttggtaaaaccgttttttttcttttgccaagcagcctctggcacatccaccaccttgagagcccccttagctggtaccgctagtctttctaggttcctcctcctaggcttccacgggccgggaggtgttgttttctcc

SEQ ID NO: 25380 - DNA, 1035 bp, Homo sapiens
aaataggcatgatgatgtgcacctgcagtcccagctactcaggaggctgagacaggaggattgcttgagcccaagagttcaaggctgcagtgagctataatcctgccactccagcctgggcagtgacacagggagaccctgtctctattttttaaaaattctagagacatatacacagagtaggttctggtgaaccaagaaagaaaaaaaatggaaggaaaatattatgcctcacttatatattattgtttataggacacttcaaatatatgattaaaaagaacatggtgctcccagagcaaaaacatccccttagcaacttcttggcagctggttgagcgtactctgctgtgttccagtggcacagctaatgttggggagcgtttcctgttcgagtcttcaccttcacctattggtcctcagcagcttttaaactctacccgcccccaactcatgcatgatgtctcatgtattactgactaaccaaattgtcctagatatgttattttcattgtatgcgatgttgtttctgacttaaaaatcagaataaatctacttttactgtttaagaataaaagatataataacacataccttctgggagaatatggtaaattgttatggagattcttaatacttttttctaatgttgttttctatagctgatgccattaataatgctgcaggctttggtttcagagggtatgacgaaaatggagcagctcgctgggacttaatttccaatttgagaattcaacaaatagaggtgagtcaatctttaagaagttagttactatatactttaagtaccatagtttgctttcataagttatggtgtgatgtcctaggagtggtattgaaggttttttaatattaacactcattctttcatttaaccaatacatattggtcgtcaactatgtgccctgggcactggagacaaggaataagataggtgcaattcaggccctcatggagctttagtttcctagaggttacagaataaggtaaaacaggtggtgatcagagaggggt

SEQ ID NO: 25381 - DNA, 1045 bp, Homo sapiens
ggaaaaaatatatatatccatataaaatttattgccaaaagtaattagtgttaattttttatattcacttccattcacaccaatacacttatgcttgcttttagatttttttatttcctgaaaattctgaatacaaaatggagattttagtatgagttgagcaataacccctaggtagtacttatagatacagttggaaaagttcataccatgagaccatggaagactttaaatgccaagtgcaatgtagctcttgaattttgaccaggagagttgtaggactgatgatccattcaggaagattaatctgtcgataatacatagaatgaattaaaaggagcatggataaagttgatgaagtctcgccttgcgcttttcagactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctaggtaagtaacatgtaaatagatttccctgtgtctggttgaagcgtttcttaccttgtcgatagattgctatcagtgcgccctcttgaggatacataaagaccaattggaaaaattaagtcatctgtgtagaaaaaacagccctcgcaactcatatgtaagtatattctaaaaactgaatcaattttattataatacaaaataaaaatacatggatcaatgaaagacaacagatatttgttgaatgcatattatattctagattcagtgctagccaggatagatacgagtatgtataagacatagttcttatcctccagatggttataatttagtatgattgtattcagcttacagttatgatacctgttaaatagaccattagccatagtataatatgatcagtagtttatcagcaaagtgaataaaatgatattggcacattgatagggggtcatcagttatgcttggcagg

SEQ ID NO: 25382 - DNA, 1034 bp, Homo sapiens
atccaggccctgcagcaggtggggcacacagtgcacagcacgtgtttgttagaagagcaaatgattgcctaggaggagacagcactttgcagatagtgcgtccatctttgatttgtctcatcgtgagaaatctaagttgaaaccttcatatttgctcataaggatctgtatagaaactcttattcagacatacttttgagcatgactatgttctgatccttaaaattcttattgtatgggtacaaatgaaaatgaaagcttgttttactttggaaatggagagcagtgaggtggatcgttattctatcagatgttctgaagcttatgctgcatctcactggttgcatgtcttttcattgcaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatgtaaggtcatgagatttatctggagcctttacagcatgtattggttagtcttatttaaagatacaaatattttcacattgtgaacttatccatctgtttctttaaaaatacttttcaagataaataacttcacactgcacctggtagaagtacagtcatgattaagaacacaaataaggtcacttgagaaactatgtggtaaattcctcagtgagaataatgctttatggttataggggattttacaagaaagctcttagcatggaattggccagcctaacaattttccaggctcccttcccccttcccccttccccctttccttcccttccttttctttctttcttatttctttcttacctatgccttgtgttccagcagattgtaaacactctgtatcctccatttcttttttgctttccctctcctcttcttaattattgcaagttgaaatctttcttctctttaaaagcctacttcaaatacca

SEQ ID NO: 25383 - DNA, 1022 bp, Homo sapiens
ccggagaattgcttgagcctaggaggtcgaggctgcagtaagctgagatcgtgccactgcacttcagcctggatgacaaagtgagaccctttctcaaatgaatgaatgaatgaatgaatgaatgaatgaatgaacaaataaataaaatgtaagagccatgggtaaatcagtggtatttcttacccccaatgcatgtaacagaacatactttaattagtaatagtactttctatagcagtaatttttacctctttgaagtaaagggttataccagattttgggggactggaacagtgattctgatatgttattatactcttttatccccacctggcatacaaaaaaggtaccagccaatttagagatctatttttgtgtctgctgacataagtagaaaatttcccacctccccactaccttttccatttaccgctctttcagtttgcgggcttatctggctgttctgttcttggtgtctctctaaattgctgtcatttaccatcctctggatcagtcatttgcaaaatctgatccagagatctctgagagtccctgagatctttttaggagggaggtggtatagtcaaaactattttcatagtaataacacttagacattatttgcctttttcactttcattctctcaagagcatacggggtctttccagagtctatatgatatgtgatttgcagtagaaacatttgaggatctgttggtctactattaagtcagacattcagtagagttgtaaaaatataggacagtaccactcttctcactaattttttttttgttttggaaatatatttttcataaaaattttattataattattcttgaattaacagattttttaaaattctcagttttaattcgtaatatggtatatatcaatggctattatttatgtaagttatgtttctttggtttcctcaataatttttaagggtaaaaagggtcccgagaccaaaaaatttaagaacagctgctctagaattcattcatgcctcttgggtagct

SEQ ID NO: 25384 - DNA, 1122 bp, Homo sapiens
aatgtctagctggaggggaataaagtaatacttggaaaggtcttgataagtccctgtcagtttttcgtttttctagaaagtgtatattgatttttggccaaaatgttttattttgtgataactctggagttatcagctttggagtttaggtttaatctgtagtgtgcttcactgtgagtgtcagcatgccttttctaatactaggactgacacagctgttcttattacctatatcccaagaatagcagtgacagagatttttggtttgcaagtagagccaagaagatgaaggtagaggacaggggagaggtttgttgaactagtacttagtatctttggagatagttaaggggtccttagtataagcttataattttgggtgctgtaattatagcccttgtgtatttcttgtacgatgagactagttatgtcttcaccttttgttcttggaaaatacttttaaagccacatagtaaaggaaaattttggtaaacttggcatcaaacattgagcctcagctgtctattagacctggatggaaattctgatatgttaatcaaaattaattctaagtattgttgcaatttttatgtgaattgaaggaattcatttctaaggattcaagtttctttttaaggtgtaagaaatataaattaatggagaaatattccaagaaggtttttggcatatactcagagttttactttataggattataaagtgatctattaaataatttttaaatgaatatttcattgggtaggaaatgcttcagtagattaaaaaattcttagaaattaatagtaaaatagtatattaaagataaaaggatgttagtaccatgtcagcaaagactataatgccagaggctggacttggattgctttcctttttgtattttattgaaagcaggaaccactagaaaataatataaaaatattaaactacttttcctattttgtctctatctccagatttgataaatgtgtgatattggagtttagcccttgtgaaatgaaggagaaagtataaattttctcagaatcctggagcaaaggtgcaacttctagttaaggaaactgcagtgtaaagaagggacagcctagctcattcagtatttat

SEQ ID NO: 25385 - DNA, 1058 bp, Homo sapiens
taacatctgttcatatgtatttcatttttaatctttaggacttgctttttaggaagggaaatacaaggcttgggttcggtcgtatgcccacacagtgattaaactaggattaaaatctagttttgaatttggagtcaaaagtggtttttctgcttcctcactgcttcaagagctctttgtctccctgctttaaaaatgcttcctatgttgttactgcctctgtaggtacaaacagccttcatctccttcaactcggtttattgggtccatcagggccaactttccagggaaataaaaacaactcacactcagcttttggctccagttggtttaacaggtgggactctacaatgatagcacttggtaagattcctttaaaataaaagcagccataaatacgaccctcagcagagtggtcttttaatgatttttatgcgtgctatgggtgattgaagcaggcttttctcagtatgtagtgtgtggcaactggggcagctgatgggtggaaaggtaggctcaggattcaggagatcggaacaggcactggtgacgtgcctcttctaccatggcttcccaatcctaaccgtccttcctgtatccactgcaccttgcacacgaatctttttctgaatcccatctgatgtgactgcttccttatttgagccacgagagtattttggatttggcattgttctggcatttacattctgcttaatgttatacgtatcattcagggttctgctaagagatacagattgaagtaggtaactaaggcaaccaggtaacttaaagagctatttacaaagatgtgggcaggtcttgggaaatcagcaaggaatagcgaagttcccgagccagctgcactagatgtggagggtcaagagggaaggaaggagcagaaccccaagatagtggctgtggagcaggggctgcttcacagcaggggaggaagagctatggcctccagttgaaggacgcagccagcctacagcgaacctgagtgagggctgcggccgggagagcatgcccctgcctctcgcttctcccatcctctcatc

SEQ ID NO: 25386 - DNA, 1032 bp, Homo sapiens
tatttaaataaaaaataaatgtgatttcttacctctttgggagcatggtcagggaggaaagaggaggcaggaggagaggcaggtctcagaacaatccagctgtcaatgcgtgttctctgttccagaaactgacaactcctgcaaggtgtgctgcagggacctttctggccgctgtgtgccctatgtcgatgctgaacaaaagaacttatttttgaggaaaggaaagccctgtacagtaggattttgtgacatgaatgtgagtatttatgtacagctttttctgtaacagccagataggaagtttttattttgtaagtacttgattttgcagatgaaaacaaatcaaaacacaagtggggctacatccttctggcccattgttatctacgggtattacttaggaggagaagacggagtgctttcaggtccctgcctgtagtttccttctgtggtgggaggctttgagcccagagactgagaaggactggggtggggactttatggtaaagttggttggtttcaggcagtgggtcctaattatgttttcctagattacttacagaactgactaagattgcaaaattattcagggtgtgattttgaaacaggtgctgaatgagtaggaaagacctagaaggctgcttgacttacttaagccagacccttttgttctctagagaagcataatttttctcatgcagaatgatgggagagggttttaagatttacgaggcttcacagggagtctggctgtgttgttcactgtccactgtgtatgtgtagagtccttactggaatgcctcatctttagcaaactggtttccttgatttttgtctcctggtaattctaaatcacttgtaaaaatggagtaattatgaaagtgttaatgacagatgttctactttcttgggtactcattacgcggaagttattgccttgtgtcaaagatgggaaaacgtttgattttaatgaagccctttacatgtcagttatttttataaagctacattgcttctgaatacattgtgttt

SEQ ID NO: 25387 - DNA, 1059 bp, Homo sapiens
tcatggtgggcttctaagtagttctatcccagatttgaccttgaccagccaccatcaaaactgcagagtccaccccagtaaacttaccacacagtggcagaggagaccagaatgggccttctctgcaggcaggcaggcaggcaggcaggcagagagactcacagaaactctgagctgagcatggtttccttctttatctcacacttactaatgggagcctttgttacttttttttttcttctttgcaggtttaatatgaatttgtctgaaatgcctgtataaggagaagactctattcttagccttttattcctttgatgcacaaagagatgtatattttattattctttcctgagttgtcgactgtagtcgtaataaatattttaggctcctgtaacccaagttcttattttttcaaaataaacatggaggatatgaaaatttaagagtacatttataatattataaataattcattgacatatgttttccataccatatgcttctctgtttgtttcaaacattgaatattggtactgaagaatttatgaattttggttttaaaatgttttttttctagaacgattctttttttgaacagataaaataatgcagtattcagagccttctgacttattttggaagtgttctaagtatatgatctctttaagtatagattcgcattctcaagtctccacaagaggtaaaacctggtgaaaagcactacaacatggcaaaaagttacccaaatgaagaaaaggatgcttgggatgtgaagatgttgctagaggtaggtcttagaatcctggatatggtgctaacaccactttgtcatttctgatatgtggattgtatgtgttttaatgaaggagcatgttagaaaagatggacacccagaagcagtctcctccagctgatccagcagtaaccccatcccatgtagcagcatagacaacaaataacaaaaactctatgaaaaagaaaaacgctataaagcaatgcttccttttttttttttttttttttttgagacagagtttcactcttgttgccctggct

SEQ ID NO: 25388 - DNA, 1355 bp, Homo sapiens
gcctgactctagggttctagcccacataagagatgatgatgttataatcagaatcaacacagatggggccgaatataacatagaggtaaatttatatgtgaattttttttcagtagcttatatctctgattttcaaaaagctgctcagttctgcaaaggtgaaaagtaattatacttatttctttcctcttcgtatttgaagttttttactaggaaagtagactttttaaaaaaggataatctctaagaagctgtgttatgatacaccctgtatttctaagtaccataattgagagagttacatgtgggatggataataggaagagaaaactttctttccctcctgactcattttttaattctttctcaaataataaatgtaaacatcctcagaaatgaaaagtgaagtattatttttcaatttctctgtttttctgctagacacactggaaatgctagatcaatgaaaggtggtagttcatagtctgagaagttaaagaggaagctaggaaagtcaggctgtggtcactcttccattgaaagagtagcaatagaaatcaagaccacagtggctgcattggttaagacacatatctatctgtcagatattagtctacaaaacaaaacgtttcctcataattgtgaattgaagttgattctgtgtttcctgaaaaatgagaagactctgggtggtggtggtgatatcactaaaatagatcacctgtgggaaaactgagtaagattggtcaaaatgaaatgttcaggtgtatttgagtgcttaataggggtaaaacagtctgctggagctatatatactatatgttttaattatatccaatctacatgactgttagtcctttgactgtccattattgtgaaaaagaaacctatggccttgcagtatgttatagtttgttaatgtttaagctatttaatgtcaatgttttgaggagtctggcctaccagaaagagtcagaaatttagtagaaagtaaaggaactaatattataaatgcattcattctagaataggcaaagcatcactggaatgtcttaaatttgcctgttctttcaaatcaatttattttttaagaatacctttattttaaaatatatgctcattgcaaaattcggaaaatagattatctgtacttggacagataactactattgacattttgacagacatccttccaaatttttttttctatgtgtaaatacacaaataaatatagttatacccactattttttcctgcaaaactaggaccatacaatatgtacagtttgtcttcacacatttttcgtttaacaatatgattatgaaccttttcgtgttaatatagatctaaattag

SEQ ID NO: 25389 - DNA, 1041 bp, Homo sapiens
catgcaccaccatgcccggctaattttgtatttttagtagagacagggtttcaccatgttaatcaggctggtctggaactcctggcttcaggtgatccttggcctcccaaagtgctgggattacaggtgtgagccaccatgcatggcctcatttgggaaacttttgatatcagaatcttaggtttttcattagagattgtcagatttccatattcctctggaaggtaaaggcctaattgctagcattctggaagccagttagggtaggagggtaggagggtagggtattgggtagaggataaagaaggggtttgggaaaggtggggggtgtctcttggcagttgtatggttaaattgagtttttgttttatttagtgatatgtgttttttgggtacatgtgatattttgatacctgtgtataatatgtagtgatcaaatcagggtgattgggatacccatcatttgaaacatcttttctgtgttaggaatattacaagtcttctagctgttttgaagtatacaataaattgttaactataatttctgtactgtactatcaaatattagaacttactaatcaaactgtatttttgtaacactaaccactttctgttcatctccaccactcccacttcccttctcagcctctggtaaccaccattctgctgtctacctccacgagatccacttttttagcttccacacatgagtaagagtctttcttttaaaactggttttgtgagcatatttaacatcagtagcaataaacttgtattttaagctcctgttgctgtattttgaggaccttctaagtccattggaaggattttgaataccatagtgtctgcagtgatagttgttgaaagaaagggaaggcatcagtgcaaatatttttagacagtttttaaagagactcaagtcacccaatttgtcttctaaaaatcctgattttggaagaggcagtggagtttctgttgataaaaaatgatttatagtttgtgcttggcacttcctaatggattacatcaggaaagatttat

SEQ ID NO: 25390 - DNA, 1028 bp, Homo sapiens
tctcaatctctactggctaaattaaaaagaattcttaatgaaaattgttttttttccttgccactcagaaaatgaaggctttagttcatatttatctggtaagttttttttttttttaaggcatgagccctctagttactttctgaaagtaaggaaataagcatttatcatccagcattgcttgtcacatttattttacatgctttacaccaaaggcccttatataatcaatgttatttgcatgctcaatgctgcaatatagtggaaaggccatcagccagggtcccgggccaatcttcccactcactggcaagctacacggaatcttggggccagcatcttcacttcttaataggcatgttttttaggcatcctcacaaataaaactcagtttgataacaaagttttattagaaggtttctcttgatttctggagggggaaactgaagcaccgaagttagtgacatgacctaggacttgggcttcatagccaagtagcggtgtcaggatttgaacctgggcagtcctacttcaaagttagtactcttagcaactgtgttatgttgcctttttttttttttttttaagattacagcaattgatcagtgctttttaacctctagtcatgaccaactggtaacaaacttcatgggtgacagccaacttttttaatagaagggaaaatatgtagcatgttataagggaaataatactttgtgaaaccaatttcagtttatacatgtatgaaaagtgggttgtgatgtcaaattgatttcaaataagtttgaaagccatttcttatggatggtcttaaagatttctgcaatccatctcctaggactgtaagttggtcataattttactgttgtgaataattccagaagtttttttcatgatggcattgttgagtctcttccacctacagcactgtgacaatttctacttcagaatttgctgagccatgagtatcccttaatgcccttcagaagaaaggggagacttccacttttgagagtgatattttcatt

SEQ ID NO: 25391 - DNA, 1099 bp, Homo sapiens
agggaataggtaagccagaggagacagaagagattgggagcaccccattgttggagcagtcagaacagacacagcatatatcgattaagtttaccatcttgtgtgggcatgcattctggtaccccaaaacaattacagtagtaacgttaatgaccaccgatcacagattgccatagcagataaaataatcataaaaagtttgaaatattgggagaattaccaaaatgtgccacagagacatgaagttgagcacacgctggtggaaattggctctgatagacatgcttgattcagtgttgctacaaaccttcaattggttaaaacaacaaaaacacaccacagtatctgcaaaagagcagtagagcaaaagacaataaaatgagatctgtctgctaggacagtgggcttaaactggaatggtcctgggcagccaggtcacatggtcactttactactccagtatacctcattgttaaaatgtggttgtagaggtttggaatttggtataggattaaatgaaaagttttaaccttgtggatacaaggatgtaaggatctgattaggctttgcaacttgagtttgactgatgtcttctgtgtggtgtccgctaaatcccacagcatataggatcagtcgcattggttataaggtttgcttctggctgggtgcggtggctcatgcctgtaatcccaacattgggaggccaaggcaggcggaccacctgaagtcgggagtttgagaccagcctgaccaacatggagaaaccttgtctctactaaaaaaaaaaaaaaaaaaaaaaaaaaaatagcccggcatggtggtgcatgcctgtagtcccagttactcgggaggctgaggcaggagaattgcttgaacctgggaggcagaggttgcggtgagccgagatcatgccattgcactccagcctgggcgagatcgcaccattgcactccagcctgggcaacaagagtgaaactctgtctcaataaaaaaaaaaaaaaggtttgcttctatctctgaaaatttttacttcattccatacttcatttttttgaaaatgaacttaacatgggcaccagaatggggttgattcatcatt

SEQ ID NO: 25392 - DNA, 1062 bp, Homo sapiens
aactaagtttatgcagtgttttcagtcctttgttgtcatttcaacggtgttaatggcatcttcaccagaagtagatccttctcaagaaaccactttctttgctcatccatgagaagcaagttctcatctgttcaagttttaacatgagtttgcagcaattcagtcacatcttcaggctccatttctaattctagtatttctcttcctgtttctaccacatctgcaggtggaagatttccactgaaatcttaaaagtcctcaaagtcattcatgagagtagaaatcagcttcttccaaactgttgttaatgttaatattttgacttcttcccatgaatcacaaatcttcttaatggcatctagaatggtgaatcctttctaggtggttttcaatttattttcccagatctgtcagaagaaccactgtctatgacagctatggccttacgaaatgtatttcttaaataattccacttgaaagttgaaattactccttgatctatgggctgcagaatggatgttgttttatgtgagcaggcatgaaaacagcattaatcttgtacatctccctcagagctctttggtaaacaggtgctgcattgtcaatgagcaattataatttgaaaggaatcttttttttctgagcagtaggtctcaacaatggacttaaaatattcagtgaagcattttgtaaacagatgccgtcatccaggcttggttggttgttccatttgtagagtgcaggcagagtagatttagcataattcttaaggaccctaggatttttggaatgctaaatgagcattggcttcatcttaaagtcaccagctgcaattagctctgaagagtcagccttcctttaaagccagatactgacctcctatgaaagtacttgatggcatcttctggtatgaggctgtttcctctacattggaaatatggtattttgtgtagccatcttcattcatcagtgatattagctagatcttctggataacttactgcagctctacattcgcacttgtaccttcagcttgtacttttatgttctggaggtgacttc

SEQ ID NO: 25393 - DNA, 1025 bp, Homo sapiens
tagctgtttaaaaaaaaaatgtgcgtaggtgtattattagctactagtttcattttaacttagttaaggaggcataaaatgttattaaaggacttatttttatttatttatttattgagacagggtcttgctctgtcacccaggctggagtgcagtggtgtgatcataggtcactgcagccttgaacatctgggtacaaacaaccctcctaagtagctgggacttacaggcatgaggcaccatgcctggctaattttttaatttttggtagagacaagatcatgcttagctgcccagactaatctggaactcctggctacaagtgatcctcattccttggcctcccaaagtgccggaattttaggcatgagccaccacacctggccaggagttattatattaaaggataagtgaatagaggaggagggaaaggatatttacaaattaaaagctctaatgtatcattactaaagttgctttattttttggcattactgaggttaatattatggttcgttgtctgaattagtatctgttcatttgatatatagacaactttttgtttttattaatcttaagaaccagccaggcatggtggctcatgcctgtaatcccagcactttgggaggccgaggcaggcaaatcatctgaggtcaggagatcgagaccaccctggccaacacagcaaaaccccgtctgctaaaaatacaaaaagaaattagccgagcaaggtggtgagtacctgtaatcccagctacacaggaggctgaggccggagaatcgcttgaacccgggaggcagaggttgcaatgagctaagatcacaccactgcactccaacctgggtgacagagtgagattctgtctcaaaaaaaaaaaaacaatcttaagaactgctcttagttatggatggcatcacgtgtgtggttctcagtgtatgcctaaggaagttttattaccttttatatgaacgttaaatggtacaccaggatgattcattttttaccttttaagtattgaagtaat

SEQ ID NO: 25394 - DNA, 1019 bp, Homo sapiens
atgaagaaactgagatacaactaggtaaggagcaaatttgtgagttattagcatgtagatattggttaaatcataccagtgaaatggacccatgtcgtcttgtcatttaccttaagatagatactgggctgttgaaatatttaggatccttgattattctagtgaaacattttcttctggagcaaataatcaatacttcagttgtcagattttagaaagtatggtcttaaaaggcagacacttggtagattaagggggaaaaaatcatgtaactgtcctccaaaattaagataatcctctgaaagagatgcgggaaacacgtgtcctcttcatacttctttgctttaatagccaactcagtcctttacagtactcttattttggactgttaatactctaattgatgacttcttttattccattacttcttccttcccactctaaaaaagtttcttttagtaatgatctgtgagtgggaacttctgtctttctggaaacgtctttatgtttttgcactgtttttgtgtggtgctttaattggttacagaattctagttgacagttgtttttctccgcactttgaagatacttacttgattgttttctgatgaaaaatcagctgtcatattgttgtttcttcctttatggtaatgtgtcatttctctggttgcttttaagaattttcttgtctttggcattctgcaattttaccatgatctaggtatgatttttttttatcttgcttgggatttattgtgcttttcctatctcaaggtatttatcccattactggaagtctcggccattatcccagaataacatctcatcttcattctttctgttctctcctgaaatagctgttggctattaccttagaccttctctttctattcgcatcttataatttttccactttttttgtcttattctttattctgtattctgagtaatttattcaaatatgccttttgttgtattaattttctttgtccatctccaattttaaagttgttttcatt

SEQ ID NO: 25395 - DNA, 1030 bp, Homo sapiens
tgatatgcctgtacttatgtcttcagcttgtaactgctagaaatgtatgggtatctgaaaaagcaagtatggcaaaaggttaatggtaagatccaggtggtggatatgtgggggtgttcactgtaattgttggttgccatgtattgggggttatgatatttcacatcactggttgagtgtctttaatacatatagcaagaagatagtgtgtagcctgtgtcttgttatcctcaagatacgagaatgtatagaacggtattgatccccacttaggagacatcactggcaccatcacttttttgtttgggtgatgagtgctaagtagattgatggagttaccagatgctgtgtaagacgtcttaattggccatactctgggacagtggttcacaaatttgatctcaggacccctttttagaaaataaaataactttaacaaaaaattgaatgagaatagcggcattgcatttcattcaacctattgtagtattccacctcctgtagcttctggaaaactccacttgtgagaaaatgacagtggaaaaaaagcaaatatcttagacttatgaaagtggttttactttgtctcctctccaccccacaaaggatataggggagacctctaggggttcccagactatactttgccctatgagaatttaattactgaagttaatagtagaactgctgttctacgagaattttattactgtgtttgggtgattgagcagtttattttctgagtagtcatcatatgtggtgataatggaatttgtaaaaccttccccacccttcccatttctctgcccctgcaccccatcttatccctaggaatataggtttgaagaccaggaaaatcacagatgtgataatgaagaaaggagaatagttgatattagacattgggtaataaaagtccctgttaattcctggaaaccagctaaagatctggtatgttggaatgtctttctgctttcttgtgttgagaaggataatatgaagttaataatctcttaacttgcccctccca

SEQ ID NO: 25396 - DNA, 2211 bp, Homo sapiens
gcggggccaacggtcgcttccatcttgggccggccgggcgggggtggcgggagcggccgcggctcgggctccctgcgcgcggggcctccgcgccgcccccgcctcctccagccgcgggccgcggcctccccgggtgcccagcgggggagggggcgggggagagggaaattcaagcggccgcgtgtgcgggagacaaaagcgggcggcgggccgcattgtctgacggcgctccctctctgctttttgttctcgcctcgccgccccgcccctccgcagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggtgagtcctcggcgcggggagcaggggaggccttttgtgagatgcttttcattgagagtttcgcgggcacggaaacaaacgtgagccggggcttgccggactgtctgctggggtggagggttttaggtgagccctgacttccctactgtgtccctccggttgttgagactcaagaagccgcttttccaaggataagtccttttttttcgccccagatgctgggtagctaccaaacgatggaacttggaaacatccaagtaggtctctgcgagactgaaaggcgtttttaagtttcttgtgcggggagactgcgtcctgagatctgtgagccctttaaatgtattcagtcggttcacaagcttcaggcagttgaaagaaggcgcaggcacctttttgttacagacaatgtagtagggattttttcccaaacccagtaatggaaatttacttagaaaatctgaacagatactttatttttcaagtaagagtatctgttgtgctcccccccaccccccataaacaggagaggaggggagttcgggaaatgtgaaaaggacacagctgtatctgaagaacacaatgtcctggtaaatttcaacatttaataacatttccttgctgttgcacacctgtgcttaaacactagtgttgaagtgaattcgtttccagtgtggagcagacaaggaaagctttccaggttttgaactgtccagtcttagcaaggacgattgttgggtggagtaggtggctgctgtgattcacccttattagtgagagagaacatttttagctttgtcattccatggatcttttgatccgtaggataagtttttaaaactgaaataccagcattatatccaggagtgtttttaaatgtttcagtgctgccaagagtcatttctatgaataaaatgggaaataatctcatatggtttgccttttaagtgtcacttttacaagaggcctacttatttttgatgtgtttgtgcacatcatattttaggtgggctttgatagacaagcatactagactggggatttttcaaaagggaatggaagaaataatttctccctggcctcctcccccacccccaccccccaagccgcctttcttcatctcatcagaatggtggggcagggaatatgttccccaccccttgtttaaaaaaaaaaaatccacgaaacttttttaacctatctatttttctaatacgatgacaggcgatccggacaaaatcatggctgatggaaataactggtaaagaggcaaagaaagtaatgcagacagtgtgtactaaagtggagaaaacttaagattatttactttatgaagtcaaaacttcgttgtattcttccgtgtgctcttagcttccagtccctgcttggcattgaagaagcacttgtaaaagctttttggactgaattgctcgtattaaaaaattttgccaacttgaaagtagtggtagacttcaacttgagtaacatatggtaatggctgttaacagcattatctgttaccaagggaagactcataagaattccatatgttaaggttttct

SEQ ID NO: 25397 - DNA, 1099 bp, Homo sapiens
gagcccgtcctccctcaaccagggcaggtgctggcttccactctgcgagggctcagcgttgtgggagatgaagcggacgcagtagaagcctgctggtggatatgtgctgggcgagagcgccacagggtgtcccagggcaaagacttcggtttgggtttcaggatgggcccactaggagccattgtggtggccaggggaaatgagtgtgaacgcaccatcctgcctcctgacagccctgtcccatttctgacccacagagccccaggcagcggtcgcaagaagcccgagaggccggcagccatctcctacgaccactcggaagaggggctgatggcgagcatcgagcgggagtactgccgctgaggacagcatgctccacccccgccaggcctcggaggcacctgctggctggggcaccctctgcttgcacagagctctagcaggagctgaaccacctccaaaacgcagtcactcccggatattcaaagctgccctttcaaatccactttcagaccgcgctgacctgggccagccactggcggtcatggttgctggtgggggcgattagctgtgtagacccacaggtgcgtgggcctgggccgccggcgcctcctccccaacgcggggagcctgcccagttcttctggagcctgaaatgcgtgcccctcttggttgcccgctctccacagtggggagggctcacgaggactaggtgacacaagcgagcccctcctggcatccgcgccacaacacttccggaaggttctgctgtggaaggtgcacccgcgctgctccctcagtctcgggcccatctctccaggggtggccgggtcagcttagtgcttctcaactttaactccctaatgagcagcctgggggtgctgttgacttgcagggcctgaggttctgtacgtctaaccagctcccagcccaggcccgagctccgaagccccaactgcactttgaggagcgagaaccccagctctgatctgccttgcagtgggaggtagagctcgtcactgcctctctgggcctcagtttccctctctggaaaatcagctctggcagctcttggaggccctccccagctctgacaatc

SEQ ID NO: 25398 - DNA, 1084 bp, Homo sapiens
accaactaatctggttgaccaccatgacctgggaatattctcagttctggggtaacagaaataggtggtcactgtattagtctgttctcacattgctataaagaactacctgactttgggaggccaaggaaggcagatcatgaggtcaagagatcgagaccatcctggctaacatggtgaaaccccatctctactaaaaatacaaaaaaattagccaggcatggtggtgggtgcctgtagtcccagctactcgggaggctgaggcaggagaatggcgtgaacctggggggcggagcttgcagtgagctgagatggcaccactgcactccagcctggttgacagagcgagactccatctcaaaaaaaaaaaaaaaaagaactacccaagactgggtaatttataaagaaaggaggtttaattggctcacggtcctgcaggctgtacaggaagcatggctgcagaggcctcaggaaacaaccatggcagaaggcgaagcagaagccagcacatcctacatggctaaagcaggaagaagtaggcagggggacacactttaaacaaccagatctcacgagaactcactcactatcacgagaacaccaagggggatgtccacccccatgatccaatcacctcccaccaggtctctcctccaacattgccgggaatacacttcaacatgagatttgggcagggacacaaatccaaaccatatcagtcaccccacctacatggtggcccagggtaacggtaatagttgcatatattcagagctcgctggtctattctgctaggtttgtcatttatttaggtacagatagcatcatgaaagaaccatggggtttgcagagagagtggcttgagtcccagctctggctgtctctggcttcaagaccttaggccagctccccactcttcggagcctcagttttgccatctgtaaaatagaggcagaaaatatctatcttacaaggttaccgtgaggctcatttaacgagccacagtcggtaaatggtcagggcagggcctctcgaagtgtcagctgtccccgttgggtggaggttgactgcgcggtgaaggaaa

SEQ ID NO: 25399 - DNA, 1091 bp, Homo sapiens
ggcctaggagagaagaacagtttcatgggcagggccctgctgccctgcgcaacctcagtacactgctccctgcatcccagccactccagctcagccatggctaaaagtgccccagattaatctcaggcagctgatccagagggtgcaagacataagcctcagtggcttccatgtgatgttaagcctgcaggtgcacagagggcaatagttgaggcttggcagcctccacctagatttcagaggatgtatggaaacgcctggatgtccaaacagaagtttgctgcagggacagagccctcaaaggaaacctcaactagggcagtgtggaggggaaatgtggggttgaagcccccacacagagtccccactggggcactgcctagtggagctgagaaaaggggccaccatcctccataccccagaatggcagatccaccagcagcttgcaccatgcacctggaaaagccacaggcactcaatgccagcctgtgaaagaagccaagggggatgtatcctgcagagccacgggggtgcagatgcccaaggccttgggagcccacccattgcatcagtgtggcctagatgtgaaatatagagtcaaaggagattattttggagctttaagatgtaatgactgccctgctggggtttggacttgcatggagcctgtagcccctttgttttggctgatttttccctcttgaaatgggtgtatttacccaatgcctgtacccccattgtatcttggaagtaactaacttgcttttgattttacaagctcataggaggaagggacttactttgtctcagatgagactttggactatggacttttgagttaatgctgaataagttaagatttgggagactgttgagaagagaggattgtgttttgcaatgtgagaatgatatgagatttggaaagggccaagggtggaatgatgtggtttggatttgtgtccccacccaaatctcatgtcaaattgtaatccccagtgttggaggaggggcctggtgggaggttattgggtcatgggggtggatttccctcttgctgttctcatgatagtgagtgagttctcatgagatct

SEQ ID NO: 25400 - DNA, 1063 bp, Homo sapiens
gttggttctgactggagggggagggcgggaaggagtgctgtagtccacagccctaccttccgggagcctgagaagtaggatgctggtgtgtttgggtaactctgagctccccaacaagggcagttccctgggatccgggacccactatgttaagagagttggcactgagtatgtactgtgtgccaagaaatttgagctagacaccaagcctagaatcttggtaaattaggtcttccatcttaaaaaggaagaaattcccgagatcgcttagtggcagtggtgagcttggactgaaaaggggggtattccactcaaaatcaactaaggctttggaaacaatgctctttcagccagttagggaaaatgtaatccaacaacggtcagtagtgccagtggggacagaaacagccgcaggtaatcccgtgctacacgtgagtggcccctgaaacctcgcttctgaccacagcttggcgtagccacttacaggccccaacaaagccagacttgggtctgtgaaatgatgtggccaggcttgatcaagtgatcttccttggcccttgtacatgggagcaggcaggcgaatttggcaggagagaccagagaacgaggacagccagacggtagccggggctgtgtcgacaccaggcaccgtcctccaggaggcttaagtcctgctttgcatttgggtatctccacgtcatttttaaagatggtgctgtctggtcgtgcacagatactgggcatttctagactcgtgacttgaagtgaatacagctccaccaagaccacttgtgaatttcttcctggcgtgctggcccccgggagaggggattcaggggaattgaactattgggcaaaggtaaaggcagccagagtgcattagaatcacttagggtgcttcttaaaaatactcattattgccccctgaccactttccccagactctggggatggagtagtgttggagcaactggagaaccatctggaagacataaaagtatccccaactcctgctccaaaatacattccagatagatgaaagttttaaatataacagattaga

SEQ ID NO: 25401 - DNA, 1209 bp, Homo sapiens
catagtgagaccctgtctctacaaaaaattaaaaaattagttggccatggtagtgggcgcctgtagtcccagctgcttggctaaggtgagaggtttgcttgagcctgggaggttgaggctgcggtgagctatgatagcaccattgtattccagcctgagtaacagagaaagaccctgtctcagaaaaaaaaaaaatacattgaattgtttcctgatgggaagtaaatactctcatgcccagttaggagtgagtcagggtttttaatatgccactttttctttctcaggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggcattgggacgtttttatggtgtgttcattccagacagttcacgaatcccgtatagctcgctctgattctcagagaacaatgagtgggtccacccacacacaggtaggaggacaggtgagacggaagccccatcctcccatgtggacggtgcacatctgctcagcccaccccacatgtccagagttggctgcaaactccttgtccagagcctctggtggtgggacctacttaagtctgacggacctgtcctgtccaggccagtgcccagggaaggtgtgggaggccctttgagcctggcctgcagagaccatccgtgtcccctcccaccttcatgcctgtgagaagttaggaatgtatacggtaccacatttggcagtcagcttattttaataaattcagcaacagcaagtccctaccatgttgtgtatcttcacca

SEQ ID NO: 25402 - DNA, 1030 bp, Homo sapiens
agatttttttggtacaaatatttgaaatgcttagtgtgctgccttggaaaaacctggtattttttgttgtgtccttatactgccaaggtttatggaatcatgtaccttatgcctagtaataattaggatgaccaggccagtgagtggttcatatccggggcatgattagctctgcgtgtgctcagccagtgccccatcttcaactcgatgtgttcctaaggtagacagcaaattccctattttatttctcagattgtcactgctgttccaagggcacacgcagagggatttggaattcctggagagttgcctttgtgagaagctggaaatatttctttcaattccatctcttagttttccatgtaagtattcagtttacatttatgttgcaggttaatcttaagaattgtattgctaaggcttctaagtgaatttctccactctatttgcattttgttgcatttcagaggaacatcaagaaatcatgaacaactttggtaatgaagagtttgactgccacttcctcgatgaaggttttactgccaaggacattctggaccagaaaattaatgaagtttcttcttctgtaagtatatgaggcccatgctggcagtgcagctgagagtgccaggcaagtggaaaactttggcaaggtctaaggaagagcaatgaggcttacatgtcttgttatggaatgtagaaattaattcactggtggtaaattaatagtgataatggtgatactcatatcagtggctagactcaaaagagcaggattcattgtgactgatgggaatgaaggtcgctggctattggtgtggtgtgtggtgaggctgctagtgagtcacctgtgaccactcttgtttcaggatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttga

SEQ ID NO: 25403 - DNA, 1032 bp, Homo sapiens
tggaagcacagctgtgcagctacaggctctgccgttcagctgccgcgggccggggccggggcctgcggcgtcgtgcgcgtgcgcggaccagttccaggcgggcgagaccgccgcagggcggggcggggcgaggcggccgcagggcggggagggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggcggtgtcccggccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgaggtgagggactccccggccgcggaggaagggagggagcgagggcgggagccggggcgggctgcgggccccgggccccgggcacgtgtgcggcgcgcctcgccggcctgcggagacacgtggtcgccgagcgggccacgaccttgaggcgccgcttcctcccggcccggggttctcccgcggctggataagggtgatccgggcgcctcgttctgcccccgtcttcacagctcggggctggaggggcctaggggagacccacccggagaccctgcggccccgcgccggcctctttcccaacccttcggcggccgcgcgctggccggggagccgttggggaggccctggcggccgcgcagcaggtgcaggggcgcagagcccgggctcgccttggtacagacgagcgggcc

SEQ ID NO: 25404 - DNA, 1828 bp, Homo sapiens
ccagccatctcctgtcactctctcacccaccccatgaggtcatgaccacgctatttagattgtcacaccccatctcctggattgcagatgagatgatatgcaatgtgctttttaaaaagactactatggacaatgtctaacatataccaaagtagagacaaatttaatgtgcttccatattcccagcacctgcttcagtagtcaacagtagctgaccctgtttcatcctcacttctacccattgtcccattattttgaaatatttgatccccagacgtcctattgtttcattcataaatcttcatagtggcttacttgtttatggttgattcgccagccccactcccttccatagcagcctagtaagggtagggatgtgggtttggatgcgttttgctcattgctgtgtatccagcatctagaacaatgtctggcacctcgtagctacttatcaatatttattagatgaataattaggtcaagtttgatgaagcctgaagattgaactctggctttaatacaagaggggtattaaatgttttgactgcagctgtttgagaggggctgggaatgctgaaaagcctaattggaatagttgaggagagaatggggaaaaggaatcagaaatagcgattatgcacaacagctgatacaggggaacagaaaataggacatctgagatcaagagagagctttctttaagagggtagatattatagcctgtctgtgtgcccctgggaatgatcaggaaagactgaaagcgatgatgccagacagagggcagctcctggagtgatgtcaggaagtccgtgtggtggtgctctgtcgctgcataacaaactacccactacttagaggtttaaaaattaaaagcaagttagctcacagtttcagtcgatcaggaatccagcttagcagggtgattctgtccaagttcctcctgagggtacagtcatctaaaagcttgtccggggctagaagaaccctcttccaagcttccacacatggcttttggcaggcggccattgttccttgccacatggcctctccacagggctgcttgaatgtcctcacagcatggctgacttcccccagagcaagccatccaagagagcaagagactaagatgggaaccacagtgtcttttgtgacctagtattagaagttgcatgtcatcccttactctgatttgttagaagggagtcactaagtacaaagtagggtggccagacatccaaataaagataaacaaaggcttattagtataggtgtattccaaatattgcatagggaattcttacactaaataatgactttatctgaaactcaaagttaatgtatgacctgtatttttatttgttagatttggcaacttcagaaggaatttgtggacatacttttaaactacggctagccaaagggaatgggatgtagtgcatatgtagagctcaggcctacagaaacacggcagatcatagggagagggctggcggagtacttggcaaatgtagataggtaggcgggtgggtaggcagaggcagtgaggggagcaggtggacatgctcttctgattgcttctcttttctcaccggagtaagcagcaaggttatgggcaaggtaaccttctcccgccccgccatacaccttgcacagagcttacccttgactcagaccctccatgctgggggaattacctccctgtgaccatcctaggaagacacctcttggctcttgcagagtcagaaaagcacaggacatggagttgagaaacccggtttcttctttttcttctttttcttttttttgagatggagtctcgctctgttgc

SEQ ID NO: 25405 - DNA, 1029 bp, Homo sapiens
ctaatgcctgatgatctgaggtggaatagtttcgtcctgaaactgtccctccctgcatccgtggaaaaattgtcttctacaaaaccagtccctggtgccaaaaaggttggggaccactgacatatatcgtaaatgttctgcatgtgagtacatcacatgtggacttattttgaagatctcagtctttttctgtgtcaatatttggaattaataaataattcctgtgacatagagcattcttatgtgaccaccagcaccacaaattctaagtgtaacctattaaaactgggaaactctgtgaaagtattgtttgaggcagggttctcaaatgctgactggcagtggacttttcattagtccctgatgaggagtgcatatgtgatatgagtattaatatgcatgtatgtatgtttatatatggtggtaggaatttgtcagctgttctttcttggaagacggttctttctacgttgtttttgtgagtgtcctttgtctttgcaaatggtcgatgacaatgtttctcctctctcccttctcctcatttcaatttggcaacttactgttgatccccagtattattttctaaattgaacttgtttgtggaaataaaaaatctgaggaccactcagagggtataagggaaccctctttgtcttagttcataaggactttctcatcatttttgtgtgtagtattattacatttaaaataaggatgatattgctgaagtagattaaatgttctctatagatatcaaagaagattagtaattctaatccttaaatttttagtctgaagtgaaatcttactataatcaaattgttgcccaagaaaaactgttgaatgttaatgaagattgcataaggacctgctgtcttctgtttgacctttcccagggctcacccacctcattggatctcctttcctccgggcatatatgcatgggtttttcatggatataagactctatcacaaggtaaacagaaaactacagttattatgtttcaggtaactaatgcgcagtctgtg

SEQ ID NO: 25406 - DNA, 1057 bp, Homo sapiens
ttgttattgtttttattattgttccagttccagaactgatatttatatctatttttagagtgtcctgaaaacagttctataataaaataactagatacttgatatggttgttaggtggtaaaaaaaacttttatattcaaactccctgttgctgttagtaaatgtagttcttacctgtttgatttaatagtgtcattataacataaaagtttaaattcaatttctaggattgtaatagtataagatcactgaaaggtaaaaatgacaattcttttaactaaacatcttctgtgtaatcagtgaaatatattaattttatgtagcactacattcttactatttagtgtggcagttaagctttcctggttatgaaaccatagcctctcagttgttcagggccttgctcaagtgccccttgcaaagctatcttgatcggcctcagcagataaagggcttcctagaaccttttaaaaatttctgttttggcactaatcccattgtattgtacttgattgttttccacttacttatgtttgactttagcacttaacttttaccaaatgctcagttaactttttgaatgaatgaatgaagttgaagaaattaagaataatttagtccttccacataagtattgctgtatttgaaacaactctgttccttttgggtttcattctactatttttatagggtatactgtacttggaacataataaatatggaatttaataaatatgtgatgaataaaaattgaattaaaatctatttcattacatttcatggtttcagttttattcctgaaattaaaataatttacttaggtcctttttccatgtgattctttttctttctcttcttgtcttctctggtcttctttctctcttttttttttttaacagggtcttattctgttgcccaggctggaatgcagtggcgtgatcatggctcaggtgatcctcccatctcagcctcaggaatagctgggaccacaggcacatgccaccatacctggttaattttttaatatttttaaaaaatatataaaaaatgtgtagag

SEQ ID NO: 25407 - DNA, 1033 bp, Homo sapiens
gccactgcactccggcctgggtaatagagcaaaactctatctcaaaaacaacaacaacaacaaaaatcaacagtatatacacactgcttccctcccacagtcatgcacacccacatatacatcttagtgagattctaaatattatcacatgtttgtgggaatcctgtttattacctcagaggaaactatgcatacttaagactctacttaagtactgttgtggttgaccacattttattccactgagttcagattgagttcctttatgtcctttgctgtgtcagtatcatgctttctttccttcagctttatttgggggaacatatgggaaatcttattttgtatgaatttaaaatacgttcttcaggatttcctagttccgtgcatgaccgcctccccaagataatcggtaactgctaaatggtgttaatatattttttcaccttcctagaatagcactgttaaggtatagaaccttgaataaaagtgtacatataatttttttaaagttttgctcttcctttttttctgccgagtttccccccctgggtatttttacatatatcggtacccttagtttttacatagatttcaaaattaagaattagaaagcaataagaatatgcagaaaagttattaataaacacttttgcctgcaaggaagtcgagtagaaccaggaaactactgatgtgctaaggataacacaccaaaccatctgtgttactaactcttggcaggaataaaatgacaaaacaagatcttgggagatgctcattaccaggtgcatgatcaaaaagataaatacattctcatgtaaaaaaattggcgtagtgcctttagcatccttggggcatgtgtgcgtgtgcatgtgggcaagtttagcatttggtgtagttaggaaattgggagaggaaaagggtagaagtagaggactttaacattgcttagagtcattgttattgcaaagtctggaagtgaactctaggaaactgcactggaattcaagtgtaatatgatgataaacatcaaatg

SEQ ID NO: 25408 - DNA, 1021 bp, Homo sapiens
aaatgtggacttcctattttaatctaaacactttcaggtagtaacagtatctgtggcctttttctcaacaaaggatatcctccccgtttcccatcacaatttattggatcacaagaatagcggacatacagaagcattaatgtgtgacaatcaggaagtaattttctgagcatcctgtcgcattttcaaagttaatttcagttctgattgggtaaaaatgtatgtaattttcatggagatatttgatacacatatgacatatattgtgttagtgtatcagatgatgtttgtttttgcttaaatagtcttacatctggcatgtccattttcttgaaaataaatgacaacttcctattcagatgctagtttgacttcaatgttgaccaaaggccttgtctcctggttccggcatttcctccatcttggtgcttaccaagtcgatctcgttgccattcttattttggatgagatatagtcggacttaaacctagtatttcagtgtcctggttgtgtagtcacttaggtggcgatgtctttagttaacatggccattatctcttctttttttttggttttgttttgttttttccttaaaaaagaaggtagcttatacaagtaagccagaaatttagactacattcttttaaaaggcccaccttatacagaaaataataagaaagttctaggacttacaccatctctactttgattcagtgttctcaaatcccaacgtaagtttctcttctgatgcccacttaggatgtaagctccacaaggcgggaactttgtatgttgtgctttttgctgtgtccttggttcttagaacagtgtcttatacttcataggctttcattgactccatgcatgctggtttaaagtaatgaatattgacccttttaaaatttgttttatttattattattttttgagacagggtctcactctgtctcccaggctggagtgcagtggtgtgatcatggctcactgcagcctccaaactcctgggctcaagtaatcctcc

SEQ ID NO: 25409 - DNA, 1103 bp, Homo sapiens
aaaggtaaaattttaatttaacttttaaaaggaaaagtgtaaaaaaggacaaatttacatggaataaagttatattgaattgggaatgtgcaagtagacacaaaatggtctattttggactatttggggccttttccaaaggtataaactgtccaccagacataattcatttgcatgtctatagacaattattttgcattgcttccagttacttacaatttgcaaagttgtaaaataggtcctgtagaatgagaatcagatgatcttgcagggtgtactctagactggggtttgggaaactacacaccagctgtctgtttttgtaaataaagttttattgaaacacagtgagcccattcatttatgtattatctatgcaactttctgactataatggcaaagttgagtagctgtgacagagaccatatggctcgtgagccctaaaatattttctcttcgtttatttacttctttacgtctatatttccccattgtaatgtaagacatgaatgcaggggcgtcattttgtctttttccctgttatatcctcagcacctaaagcagtgcctgtcatactgtaggccctcacttaatgggtgtggaaaaattaatgagcacacaagtgagagtgacctgattactgcaatttggagcgtctttgataatggttgtgtactttgaccatggctggtttgcagtgcttcttgaccgtacttaatgccagattgaaattttgcatttgcccttttctgctactactattaaaatatagaaaggcactctgggaggccgaggcgggcaaatcacctgaggtcgggagtttgagaccagcctgaccaacatggagaaaccccgtctctactaaaaatacaaaattagctggatgtggtggcacatgcctgtaatcccagctactagggaggctgaggcaagagaatcgcttgaacctgggaggcagaggttgcagtgagctgaggtcgtgccattgcactccagcctgggcaaacgagcgaaactccatctaaaaaaaaaaaaaaaacagggagaacatggttcatgtgtgccagagtataattttcatacagtaggattagcatcagttc

SEQ ID NO: 25410 - DNA, 1035 bp, Homo sapiens
tgaggcatgagaataacttgagtctggcagacagaggttacggtgagccgaggtcgtgctaccgcactccagcctgggtgacacagactctcttaaaaaaaataagaaatacatgaaattcctagatggacgagtgttttgctattttgtctcttaatatttttattttgtcttcctatattataaaagtaaatgtaggagaccaacaagtgcttgtatttgttcagtaaggatatattgagtacggtactaggctgcaggaatatgttggtgaagaaaaccaacatgttctctattgtacactcaccgcccttgtgagcttacaatctaggtgaggggtggtgataaacagatctgtgactaagcgctgtgaaggaaggcagcagggttcagtggcttcctacgcattttccctaagtcaagggtcaggcactttgtatcagtctcttttttatgtagatattttatcagcccccttcttctgtgtagatattatatatagatttgtaaaaatctcccccaccttcatcttaaatttgaatttcagggttggagacttggtgttttctttgccttatgatcatagcacatatctggggcaaaatagtgaatgaccatatttgtcccacaatctctggaaacaaaagagaacagtagagagaatgttggccgatagagaacgtagaggttgagcctctataatccaaaaatctgaaatgcagacgctccaaaatttaaaactcttttgagtgccaacatgactccacaagtggaaaatccaaacatgagacttaacctaaagtctgtttcctgccaaaaattattaaaaatataaaatgtttaaaggtataaaattaccttcagtctgtgtgtataaagtgtatatgaagcatgaatgaatttcatgtttagacttgggtctcatcccaagatatctcattatttttatacaaatgttccaaaagccaaaaaaaaaatcaaaaatttaaaatccttctgatctcaagcattttagaaacaggctactcagcctgt

SEQ ID NO: 25411 - DNA, 1048 bp, Homo sapiens
gtgagccactgcgcccagctgcccatgctgtttctaattgcacactgctctcccaagaaagatgagaaaccctggactttataatttgcatttcatctgtaatagttgagagaattttattataatcatgggagtaaagtgaaattctggtgagttcaggaatagattgcagctgaggatgctgggtcctagttagggtattgaaatgacctacaccagggtctcggttaagtaggtaagtgagtaaatcaggtggagctgaggttggggcaagggtgacgagcagggatagtgcgactgggggagtgacagtttgaagggcacagagagttgggagagaaagagtcttaccttgggctgtacagtttggtagccactagccactcgtgggcattgacatgtactgtgagtataaaatatacattggatttaaaagacattctacgaaaaaaggatgtaaaatagatcattaataattttctattaattacatgttgaaatgaaaatattttagacctgttggattagtaaaatatattaaaattaattttaccatttttaaaaatgtggctactaaaaattttaaaatcacatatgtggttcacatgctctttccattggacagtgctggtctaaactgggagagcttcaacccttgaggatgctggtaaggtttagtagtgcttgtgcctggcccagtgtagcggggattgttgagcctggtaggctgcctcagtttttccattgtaaccaaggatatagaagcccaaagagacacctgctgaaatgagtgccaatctgttggcccccgcaggctgtgtgcctaaacagcttctccaggaggcagggctggagggtggactcttgtgggcaacttgatttctcaggtcagtttttgtgcatctcttcccccacctttaatggctgtaaagatctcttaacccacaaagggtgtgactacttggcaaagaagcctctttctgagaaatactcaggctcagactgttgaggaacccattcttgaaatgccaccactgacgacagtggt

SEQ ID NO: 25412 - DNA, 1041 bp, Homo sapiens
aacagagttggcctgttagactgcgccttaaacagtgtcacagcagattcagagtaagtagaaattaatttgcaatgtaaatgttcatcaacttttaatttaagtaatgtgtctatattaaattcaaataaattgctacaggatatctgaaattgtactttccatgattgtttttcataaagatcctctcctgtaaaagctcactagtgagtaagccagatagaatttctttccaaaatactatacagaaggccttatttctttagttgctgtacgattttattaaaacaattacactacaggaatttgtattccaattttgtagaatctagtgatagaaccaggagtccaccacaaagtccacagaggtgtgctttgaattctaaggtggaaggaagcaagtgtttttttaatattttcttgttcctgtttgcctaatttctacatttaaaccaatcagaagagttttcactattatacatccatttacagttttatgattatttcctgagaaatgatacctagaacctgaatttctggattaaatagcatacatgttttgaaggtttttggtacattgctaaattgccctacagaaaacataacctcaggttaaatgtctccctgcatgcccagagcatacattgctcactctcctcagcctgggacgtccatcacagcactgctaataataagtcttagaaagagcctgaggatattgattaaataaagcttagtagaaatagtagctgacagatagtgctttctatttgccaggtactgggtctaagttctttacatatattaacttatttaatacgacagccctttgctgtaggcactgttattgtatttattttatagatgaaaaaaatattcgtcaatggcatacatgttactcagcctttaggaattatgttgcagaagcatatttattactagggaaaggtggtccaaatgcgcctgtcagtggaaaagcgagccatactgttgactatagagtgttaccacattgttatcagaaaaacagtgaacacaagc

SEQ ID NO: 25413 - DNA, 1090 bp, Homo sapiens
tgccatagaatgtaatgtaatcatgggagcaatgtcttatcaattcacagtttctacccacactctcaagggaagggggttatacgagggtaaaggtcactgggggtcattcttagaattttgaatggcactgaagtcaagttaaaatgggaaagttcaagtgcttttatcagttggcctagaatttgggattgaggggaaaggagttaatgggatatgtggtctgtggaattatatgcatagtctcccaacttgtttcaccctttgttgtttttttttttatttttactttttagaaacaggatctttttctgtcacccaggctggagtgcagtgttatgatcacagctcactgcagcctcaactacccaggctcaagagatcctcctacctccgcctcccaaatagctgggatcacaggcatgcaccaccatgtctggctaattttttttctgtttttttttttctttcccatagtgatagggtcttactatatctttgtttattgaaaacaatagaaactctgtgtgccactaataatggctatttttcgctctttttctttatcaggtagactatgaatgggtaaaaaatgacatcttttttgttaagcaacaatttttttgttctttaatgtatatttgaaagtctttaaaattattttgttttcaacatctcagagtgtcagaatttagaagtcattatattttgtgaatttgcattcagttctacaagaaatctagttgatgtgtattgagaaattatgaggcttttaagtttttgttggtgttttgggacaatatactatgacaattttcttcttgtttcacgtagaggcagaaaaaaactggtatgtatataatttctgtgttgaattagaatctttgcatcaggtttgcgttgttactaagaatattgtttgataattgtatttttcctatttcttgtttttcagttgtcacctttgaaattttgtctgatgactactcaaaggtatgttttatagcattggtttgtactgactagacccaagaaatgagtgagtggaatttattttaatgataagcagttttataatatttttattgtt

SEQ ID NO: 25414 - DNA, 1591 bp, Homo sapiens
gaaatgtttcacctgagttctgagcttttccatccgtataatcataggtacgaaggtcagggtaggagtcagactgaggagaacctggattgtagcaggagtagctccagagagtcgctcttccataaaatgagatgttgaccttccagggtgtccccttctgcagatctaacagtggctttctgtcgtctcccagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaaatattttggacaatgccgataaatgtatgaagttagtatccacatcataaattcagagtgatgtttagcagtaaatcaatattttgaagtgatacacagatgtctttcctccccacaaacttttttaaacaaaaaacaagacctcttttctttagatggtgccacctatgcccaccacaacagagattttacatggaaaccgggctcagtgagaactgatttcctgcccaatatttgtctttgggctgtctctagtgactaattattaaggaatctagctggttatacagttcaaggctttctatgttgttaatgaacctcaaaatagccgttaagacatgaaatacagcagcaggttaccaatgcgaacaggtagttcgcatttatgtaaaacattcagaaaatgaagttttgaatttgttggaacattcaaaggacttgagagcattttattgtaacttaaaaaaataaatacaactgtcactaacttttgtgagcaatttctctgaaaaagatcttagttctgtaagacatttgaaccattctctggctaaaggaaagaggtgtctgtaataatctgcacgaacatgagacagaggtgccagctggcctttctagtcaagaagactaaggtcaatatggaagtagacataaggaaaatagtcttggttattgagttgcagtcccgggatctccacagatgcctacaaaagaagacatggtaatgctctaagtgcataaactagtttcctgtcttatccttttagttttgaggaagctcgccaggcactgagcgtacgttctgctctgcgtagctgtggtccacccctccaaccctctccttgctgtgctttaatgtgtatgacatgtagattttcataacaggctgacagatagttttgctttgttttgtttttgagacagtttctgtcacccaggctggact

SEQ ID NO: 25415 - DNA, 1047 bp, Homo sapiens
ggcgcacgccaccatgcccggctaatttttgtgattttagtagagatggggtttgcaccatattggtcaggctggtctcgaactcctgacctcaggtgatccacctatcttggcctcccaaagtgctgggatcacaggcgtgagccaccgtgcccagcctccttcctatttatctttttgcttcttgtcctcagtatccattgctttccccaggtacctagcgccccctgttgtccctctctcgatgaccttgctcctcctccattagtccagcaaatgtttattagatgcctacagaacgcgagaacatgcttaataacccaaatgatattggtgggatttcaggtaaaaagggaaaatccatatagaaactcatcttttgtttttatttgtcattctacgaaatatctgaagcgtgatcttttgttctctaagatcttctagttagatcgtaagcaatttaaaagacatatttgccctaaaaaccagtctggttttctaggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcaggtaatttgttttcttaggttgtttgttgttttgtctgtttgtttggttctgttgtaggtttatatttggaactaggtatatataagccaggtaataaatggaatttaaaatgcaaactaattccagagaattgaatgtttatacattagagtttttaaattgtctccctgttcgttcttttttccatggaatactctgcttgcgggatgaggagaaagcattgctaccctcgggccgccctgtgtgccattctgtgcatctggccctgggctctttctcattctcataaaggtctcatatgggctagaggcagccctgtctgtccatcctcaccctcatatgcattgtaatcttgaccttggggaaatgtggtttccatttctggg

SEQ ID NO: 25416 - DNA, 1059 bp, Homo sapiens
aacttaagaagagaaatcgggctggacacggtggctcacacttgtgatcccagcactttgagaggctgaggtgggcggatcacttgaggtcaggagtttgtgaccagcctggccgacatggtgaaatcctgtctctactaaaaatacaaaaattagccagaaatcactcgaacccgggaggcggaggttgcagtgacctgagatggtgccactgtactccagcctgggcaacagggtgagactccatctcaaaaaataataataataaataaaaaaggaaaaggaattggttttccaagtgttaagtttagtgcaaaatgcattgtggggagaaagtgtgttctgtcagagatacacgtgtcagaactgtgtcacacctggtgaagccgacagtgaggtaaagacacagtcttgggccgggccagatgaggcacttgctgaaggccgggctgaggaccgcctaccttccgtctcctgtaggtggcagaactggtgaagccattgtagatgctgcgctgagtgctctgcgccagctcgtgaaggatcgcctcgggggacggagcggaggatacagttctggaaaacaagtaagaccataaaatgtcagtttttaatgtgtcataattttgaagccagagtggataccttgtataagatagttgttttttaacagtatgttaaagtggtgaactctcaattaaagaataatagaggattggatccaccgatcccagagggaaccagccctccagcctgctcatttggcctcctcagaattgctgttgccaaagccagtcagtcccagggcctcttgccacacctgcagtccaagtaccaggcccaggagccacgtgctggcatcccatggcacttgtaggtccagagtggggatgggatggacgggttttcctctaggtaggctttggcaaaccgtgatgagattggattacctcttggcctgtatctgtggcagtcagccccaaatccatggaaaattctacacaaatggatagggaagaagagagagagagaggagcagattggtgttttagatgccct

SEQ ID NO: 25417 - DNA, 1049 bp, Homo sapiens
tggtgagttcatccaggttgctgatcctattttacttatttatttttatttttattttttgagacagaatctcactctgttgcccaggctggagtgtagcggcatgatctcagctcttgcaacctctgcctcctgggttcacgtgattcttgtgcctcagcctccccagtagctaggattacaagcgtgcaccaccacgcctggctaatttttgtatttttattagagacggggtttcaccatgttagccaggctggtctcaaactcctgacctcaagtgatcctccctcctcggcctcccaaagtactggagattacaggcgtgagacaccgtgcccggccttgatcctgttttatttgtgcttgtcctctttgcaggcatctcattcaatagaccattgatggggttttttaattgaatttttgaattttttgaattgagaatcaaaggctttaatggttgctttgtgttgtcttcccccaaaaggtgtggtcactgtcaaagattaacaccagaatggaagaaagcagcaactgcattaaaagtaagtttcttaggaatgcaaaaggcttacaaaacttttttttacagtaagtttctaagatgtccatattcacctgtgtatgtttaagtaataagtatgcagatggtttaatgttcaatgggaagctagtttgcatatcagagttgaaaatactggttctgttgtcaaaatcatactgagaacaaggggataatacacatttaaatgtttacattgcctgtttttgtttattgtttttcccagataaatgacagttactctcagccctgccaattctgtgagctgcagagttccctccatgggctttgatttcccccatcattccatttagattctcttctggtgttcaaggctaaagcccttattgactgattgcaaactgcaccctgtgctttattacctttttctgagtctatgtgaagcagataatgagttcttgtggagtctgctttagcggaaggaaaaattgttatttcttttacatttccacaggatgttgtcaaa

SEQ ID NO: 25418 - DNA, 1050 bp, Homo sapiens
aggaatgattactacgtgattgcccagggttacacaggcagaagtgacctcccaatttttcagcgtccatgccataaaatgacagtagtactgcctcatggagcggttgtaaagaacaaagacgttgatacatgaaagccactaagaataatgcttcagcctttttccagtgcagcccaaggagtgggagtggggaccgtccgttcctttcttgctcagcgttgcagcaatgggagtgaaattccaggggctccaactgcagcaggaagggcagaggggccagagctaggccgtcctcctgtgtgaagggccctggtcagttaaagaggactctggttccccagggtttccagtcaaagcatgaacagtgctgttaatggtgcacttttgtttttatcttcaggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtaagtattataaaatagttgtagattatttatagtactttctgaaattggagaaaacgctgtataaaaatctgattttattaagacatctagtttagcttagtgtttgtttaaaagaagtagagaagagggaaatgggaaatgcaaagtatctagtctgttgttaaggaagatctgtcttttgatgaggtgatgcgtgtggaaggaaaactgcttttatgaggaaggaatcttgagcaaagaaaatggaggggccagtgattaacttcactctgtttcttgaagagaattatttcctgaaaaaatgtagttagaaaatctggtttaatttaaaaattcttttcttaccttacattcaatgctggaagaacccttgtggggtaaaaatgtaatcaccattgaaactaacagcacaaaattatatacagtcaaaagtacaacattgcactagttatttgtgtgattaaagcatttaatgcaaaaaaacaccaaatagaagagtgga

SEQ ID NO: 25419 - DNA, 1027 bp, Homo sapiens
ggaggcgcgggcctcggcgtccggaggagctgctaggttgccccggcggaggtgcgggtgcgcgggagactcgggcgcccgtggggaggggcttccgcagccgcggggggcgggagcctcgtgcgctggagccgggcgcggggtccagggccgggcgggagagccgcggagcccagccccggccggatcccggggagggggtctgtattcccggagagtcgcaggggagcttgttccgggctcttctcgaactcgtgcgtggggacggaggttggcgggcgtcctgcactgctgcttgtttctgccacctgctttatgcagctcctacttttaaaaactgaaatgttaagccgggcgcggtggctcacacctgtaatcccagcactttggaaggccgaagcgggtggatcatctgaggtcaggagttcgagaccagcctgaccaacatggcgaaaccccgtctctactaaaaatacaaaattagtcgggcgtggtgtcgcgcgccagtgatcccagctactcagaaggctgaggcaggagaatctcctgaacccccaggaggcggaggttgcagtgagccgagatcgcgccactccagcctgggcaacaagagtgaaactctgtctcagaaacgaaaaactgaaatgttaaatctcagtcctgaaataaggacccatagttcccttagaaagggacagtgccttccaaaagctgggcttaagacgcaggggcgcttcgcatgtgatcggactccttaaaaacgaaatggaacgcggcgtcttaggaattctgtaaatgtctgcttcttagtgggcgaggccgagggtcctgtccttgccgggctcgccttggtcacagccttggctctgacagtccttaacctcggctctggcctcagaccaccttccccctatttactggctctgtgacttggagcaagttacttaaccactctgtgccagtgccttttcaacggtgttcaccattttagggactgataatagtactcccttagggttgtcctgag

SEQ ID NO: 25420 - DNA, 1019 bp, Homo sapiens
aaactcctgagccacagggaggatgggtactcgcttcctatgcccatcagagggagggagtaggatgatttcaggtaatcaagttggtgtactttgaaaatcaacccatgcagaataagaaccttcctggagaagagaccacacccccggtgggcctccgccaaggcactcagttccctggcatcggtgagtgctcggtggaatggtggccacttccagcactggtcgcaagccaggcactgtgctaagctcggaggcctccagcaccacccacgaggagggtccatgctctgaaacctccacgtgatgcagccaccagcatcacctggaggaccctttaaaatgcagattgcagggtgcccccagacagggctgccaaacttaacaaacaaacattcaggacatccgattaaatttgaatttcagataatgaattatcatttaatataagcatgacccaaatattgcgtggataatattaatcatctgtctgaaattcaaatttagcggatgacctgtagtttgtctggcagctctaccccccgggtttctgaaatggcaggtctgtgctggggcttgaggatttgtatttccagtaagttctcgggtgatgccgatgctgctggccaaggccacacttggagaaccaccgaggaaggtaatgttatgatccccactttatggtgagtcagatggggcacaaaaaggctaagcaacgtgtccaaggtcacagctctggctgggacccggggagcctggcttccaggtctgcttgttagccacggtgccaccccaccccaacgagaggtgcttctcagaagtggtgcagcacccccaccctcacccccacccccacctccaccctcacccccacccccacccccaggctgtctcctcacatgcttactcccaaagtattctggaggtaaagccaaaatggttattttattttatttttttttgagatggagtctttctctgtcacccaggctggagtgcaatggcgtgatcatggctca

SEQ ID NO: 25421 - DNA, 1044 bp, Homo sapiens
tgacttggaacaaaatgccactccattcatgttcatttttgtcctggagaggatttatttcctaaaagattctgaaagccaacaaatcaatgtagttcttcatagagaacttaagagtaaggctcaaaatggcctcaaaatgggcttcttggatgacttccaacagtgactggcctcaacactgcagatgtctgagcactaccataacctaacgaagtgaggaaggaggaggcaaattggtatttttaaacaagaatttaagtggctctttctttcaagtctaaaaaaacctttggctttaaagattataaactgatttactaaatttataaaagaccttaatttagcaaagagcttctttttcctttggttcagttactcaaaatccactgtgtgaaggaataatgtatccatcattcagcctttatagcggtcttccggtagcgaagtactgtcactgttacccatatatttaaagccagcatgatcacaaaacgtagaagaactgaaataaaaaaaaaagtgtattaaaaactgtctttacaatacagaccaaaaccacctcctgctcaaagtataagcctaaataaagcttcacccccaacctccgaaatgaacaattttggttccagttatttctggggaaatgatctccctatcatgacaatttttggccccttggcccaacttcataaataataatttatcatcttaagtgctcaattgacagtaatgtggctctggctaagaagggttataacttttaactttttttttttttttttgagacagtcttgccctgtcacccaggctggggttcagtggcctgtcttggctcactgcaacctccaccttctgggttcaagtgattctcccgcctcagctccccaggcacctgggatgacaggtgcccaccaccacgcctggctattttttgtatttttagtagagacagggtttcaccatgttgcccaggctggtctcaaactcctgacctcaagtaatctgcccaccttggcctcccaaagtgctgggattacaggc

SEQ ID NO: 25422 - DNA, 1060 bp, Homo sapiens
ctactgtattaagaaattagcattaaattaaaactataacataaaaccatttttcacctgccaaactggcacgggttaagaaacgaaatgggtacttttgtggactgctggtagaactccaaattaaatgcactctttccaaagcatctttgacaataagtttcgcaggcctgaactatatccctgttaatggtggagacagtcaagcaacaggcaattacagtactatgtaaaatgctgtttataatatagggatgaacagagcgcttggggaaacgagggaagcatggagaattctgcctgaggacattaagaaagatctcaaacaatggaggatggataattttacaagcagacaaataagggaaaatcagttccaagcaaaatgtcatgtgcagaggtacaaagtcatcagaattacttatgtatttgtaattttgtgttggcttggcgttgggagaaggcaagggtagggagtggtaaaagatgatgtgacactagagagaaagtctgaacccaactgaaaagctccatgtacactgtgctcaggagttttgatttataagtagaagtctttcagtaagggattggtattcaggcttaatgagatcctgaactgagtacttgacaatgaaaacgaagaaaataaacctggatttggaaagatttcttcagttgaaataactagaattagatgactgattcgaagggatgagggagagggttgtaagggaagtctcgtcatacactacagtcgcatctagcgattagacttaaatttgagattgtgacactggcacacacttcaaaggttttgaaagggtatgcaatgcagctttctcctaacctatgctaaagctgaggcttggatgccctggaaggcctgctgatcacaatctcccaagcagtagagctgaaactatggctataagttacattatatataagtctagagaagtgagtgtgtgccaggttgcgatatgtgttcagtgagtaattatatctgtttgtgtgttttctcaaatgttgtgctgtgtttagcacattttaaaagagtaat

SEQ ID NO: 25423 - DNA, 1050 bp, Homo sapiens
aaagtgtttctttgtagccctgtatgtagggaaggagagtatttgtgattgtataacttgttgctcttgatgagatactgagaaaccataaacgtaatttattttatttatgtattatatttatttttacattttttaaggctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcagtaagaatactttttggactctagactgaagacttctttttaagaagtagaattattttcatgtctgtgttttactggttatagaccatttctatttaataattattattgaaccaagaagcaaaatgttgagttatgttgcatccaattaacttattgtaattaaatttcttatagcaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccaggtatggatttgttttcagcactaatatttatcttaaatataaatcagttgattgttttaagtcttgcgactgactgctctgaaggaaaaatgtttgtaatttctttaagggaaaacctactccttggagtaaggattcaagtaacatttcaaacttattttatttattgattttttttacaaagtttttcataaacatacaaaagaaaaactccacatgtctagtttttaaattattatattagctctatttttaagctttcgtttcattttctcttctttctgcattcttacttccttttatgttgggtgtttagttcatatcactcagtcacacactatggaatccatgtcattcacctaccagcgttcctctacttctctc

SEQ ID NO: 25424 - DNA, 1046 bp, Homo sapiens
aggcaggcgaatggcgtgaacccgggaggcggaacttttagtgagcccagatcgcaccactgcactccagcctgggcgacagagtgagactccgtctcaaaaacaaaaataataataattattattattattatcatcaagggttccaaatgagtttttgtttacgtttgttatatctaatgatttgtattgtgttagaaattaaaactgagaaaactttaaaacacaggaacacacaaacacgttattttagccatcagaatgatgtaattacaagtcatgtggcctcaggaaaagtacatacggtatataacgagggaatgagagttttaaaaaaaaccatggtgctcagtattatgaaaatgatttgaccttatgggttctgtggaagaacctcagagactcccagggcttcccccagaccatactttgagagctgctcgtttaaaatatgtgtaagttatttaaacctttgattcattgtcctcacagagaacgtcaggatgcagatgggcaaatgaaagagctccaggatcagctcgaagcagaacagtatttctcagtaagttcaagacacattaatttgcaaatagcaaacagagttttggttgggatattttatttataccatacaactcatataaaaagagcagctgggcaaaagaatgtagatagtttaagagaaatttattatcattgctagaaaaataattctaagcacaaaacatacctggtgaagctgattaacagcattgttttcaggaagaaaatattttcataatgcaagaaataaaattgtaataaaattatcattttaatagttgtgctttttttgagatcagttttaaaaatatgaagtagaaactcctgttttattgatttaagccaataacatttttttgtctaaattgttaatgtttttccttgcctccttattcattttacctatctgtgctattaaatgagaaatatcactgtgatatccagttgaaaatcatgcttcttaattattacctgaacttgtattagttaattgatgactagaa

SEQ ID NO: 25425 - DNA, 1033 bp, Homo sapiens
atgaaagtgaaaatattaaattgaaaattaaggccaggtgcagtggctcatgcctgtaattccagcactttgggtggccgaggcgggtggattgcatgaggccaggagtttgagaccagcctggccaacatggcaaaaccccatctctactaaaaatacaaaacttagctgggtgtggtggcacacgcctgtaatccgagttatgtctggaggccgaggcacgagaattgcttgaatccaggaggttacaaagagctgagattgcgtcactgcactccggcctgggcaacagagtgagactctgtctcaaaaaaaaaaaaaagaaaagaaaaaaagaaaattaatagaatataaggcagcatcatttattataatttttattagtatggtgtcatttaatgtgcttttacttacaaatttatgatatgcttcttttatttgtaaatttatgattgtgtccatttttattatactagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgtaagtattaagtgtactaatgattaataataaactaatgaattaataggtttattcatgaaggtctagtgatggtttcataattttaaagtttttcttataatagtctgcaacctgttggtttaactaaattttgatgatatactaaaggaatcataatttaaacatttttaaagttatatttaccttattatattttatttaaaaaatacaattataatattattagaaatacaaaaaaaattttagtatgaaatgaattagctacctaagggtaaaaaaatctgttttacatcaccatattttataccaacttcattgattagaaaaatggaaataatttacttatataccaagtacacaatttatttcttaggttagaaacctgacattaaa

SEQ ID NO: 25426 - DNA, 1048 bp, Homo sapiens
tatgagtagcagtcaaagatgagtcccagatttgtaggttgtgacaagatatatagtgatgctgttaataaagaataaaggaaaaatagctcatgagacagtgataaacccactttagtcctcttaagtttgagggtacctatgggacagccaaattagcatgtctgcactgcagtaggctatagtagtagaagttagaaatatttgagtcattggtatgtaagtagctgaaatcatgtgagtggaatagcccatctgggaaaagactgtgtgaagtagtgatttttttttttcttttttaggacagagtagattactctgttggtggattatgtggtttgagaaatcattttttgtatgaaaggctttatttggaaaaaagcctttatcatatttatgatatgaactataaaaatcaaagaattagaaaacctttggggtttatgtagaaaataggaggagtattggggcttagatcaccaacatttaagggacagctgggaaagcttcaggagcaacagaaaggatgcaagcagaatggagagaaccaactaagtacaaggtcggcaatgccaagggatagttttaaggggggcagtgagttcaaataagactgaaaagggtctttagaatttgatattgagaatagcattggtctttttgttgagattaagtgagcttgatacagatctcagaacagcagagtggtggtgtagactgttgggtacagtgggaagtagagaagtagagtatatagattactattctaaaaggtttgagtgaagacgggaggggaaatactgaacattctagttaagcctgttaaaaaacaagttaaggttgagcaccatggcccacacctataatctcagcactgtgggaggctgagtcgggaggatcacttgagcccaggagttcaagatcagtgtaggcagtgtttaatgagaccttgtctctacattaaaaataaaataaaataaattagccaggagtggtgacaaacttctatagtcccagctactttggaggccaaggtgggaggattgct

SEQ ID NO: 25427 - DNA, 1082 bp, Homo sapiens
taagctagtcacagtctgtctctctgggcctgacttcctcttatgtaaaataatagagctggtttaactcttgcagcagccctgtctggcctatcatgatgtaaatgatttaaatctgtgctgtccagtgtggtgaccattggttacaacatgacttaaaatgtggctagtataactagggaattgtgtttttcattttatttaattcattttaactttaaattgccacctatagctagtggcaactgtgttgtataacatatctctagagaatgatttcaaaatgctgatccagcccaagcattaaaggaccctgactgatctgaccccacataggaactctttctcttggactattcagtaaaacatttcctctcttaaattaaaaaaaaaaaaaactcaacaaattcgggagttatcattgattttattttgcttttaagggatgagggatcattggtggtgttaaattttaaatatattctttgatttagaatataacaatatgtctgttgttttgactgggactctgtgcccgtagaatatttgttcttccctgcatgtgacaaatttaaacttaacatatttaagtactaggtgaaaagtgtttcctttgcattctctgttacattcagtatcttctttcttgaaattttaggggatactccattttatgcggattcacttgtaggaacatatagcaaaattatggatcataagaattcactgtgtttccctgaagatgcagaaatttccaaacatgcaaagaatctcatctgtgctttcttaacagataggtaatgtacattgaatttctttgtagagaagccctttatgttaaatttatagaaataaaagcatgcctagcttattaacatatgaaatcagtctgcctctcattacccaagtagcatctaattctgggttagccttttccttctgctaagcctggtgttgggctaccttgttgttatgtgtgtacagcccagttgtaatcgaactctaaccttaaccctcatgtctaaaaaggaaaaaatagaacgtggtaaaacaatggatttgaaagaaataaaactttcgtg

SEQ ID NO: 25428 - DNA, 1051 bp, Homo sapiens
taatgttccttattcctgtttgtttctttcttaaatgtttctatttaaatagtttcttttgtattgtgttctccatgaggggaaatattcatttatgcttgaataaggtacccatataaaaattttgtctgatactgtttatccattacatacgcctgagtctaaaataaaagatctcataaattttagttttggttataaaatagtttgcctttttcaatagtaataatagttttttaaatttttgttctgattatgatttttggtttgggtttttaaaaatttttccttttccttttgttttccagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaagtaagtaagcaaattatttaaaacgatagtgttttgagggacagaaataaatgaaatactttaagtcaggtcttcatagttttgaacaaaggtaaatttagttttcataactgtatagcacccaaacaagatataaccaacttaaaacatttccttaaccaacttaaaacatttcttttgtaatcatttatgtagctgtagagtacttatcaagagaaataaaaacttagcttagttatcttcctcatagactgttgacaagcatttgctaccaatcaaaaccggttcatatgtataatttaggtgaagaaggacacaaaatctaaattaaggtaaataggtattttcaccaccattgttacttctgcatttttttctttaagaggaggtaaaagtaagtaaagaaatttatgttacaacctcctcgtcactccctctgcatcaaccacacagaataaatttgggaacatcatctgttccga

SEQ ID NO: 25429 - DNA, 1194 bp, Homo sapiens
tctcgtgcctcagcctcctgagtagctagtattacaggcgcctgtcaccacacctggctagtttttgtgtttttagtagagatggggttttgccatgttggccaggctggtctcaaactcctgatctcaggtgatccgcctgcctcagcctcccaaagtgctgatattacaggcatgagccaccactactggccaaaacaaagactttaaaacagctatccaaaagatgctcaaagaactaaaggaagatgtagagaaagtcacgaaagtgatgtatgaccaatatgaaaatatcagtaaagagacagaaaacctaaaaagaaaccaaaaaatttctagagctgaaaagtacaataactgaaataaaaaacactaaaaggagtcaaaggggcagatttgagccggcagaagaatcagcaaacttgtatatagtaaaatgaagattactgagtctgaggaacaaagaaaacagattgaaaagtgaacagagtctaaggggtatgagtaggacacattcaaatagaacaaaatagatactgtgggagtaacagaagaagaaagagacaaaatatttgaatgggtgtaaactcccgaattttgatgaaagccatgaatatccaagaaagtcaacaaaatccaactaaaatgaacttgaactcaaggaaatctacaatgagaaatcttacggtcacacttgaaaattacaaagagaatttgaaagcagcaaaagagaagtgatttgtcacatacaaagaatcttcaatagattatgaatagatttctcatcaaatatttcagaggccaggagacagtgggccaatatattcaaagggctgatagaaaaaaagtcatctgtgaatgcagagacacacacacacacacacacacacacacacacacagtgcaaaactgttaaatacacacacacacacacaaggaaaaaaacacacacacacagtaaaactgttacatccggagggctgaccttaagaagcgaatgctgtggcatatttcaaaatgttcctttccctttaaccctcttggaagtgtgaggggatttttctccaatatttactgtgagactctggttgagctcttggatataaaatctgtaaaggtgtggggtctcacctataactgggtccctttcaaagtttttaattttctgacttgaccaccacttagcccccagca

SEQ ID NO: 25430 - DNA, 1090 bp, Homo sapiens
ctccatttgcttagttctttgatttctgtcatcagagttttgtagttttcctcatatagatcttatacatgtttagttagatttatgcctgttttatttttgtaggtgctttaatgtaaatggtactgtgtttttaatttcaaattccactttttcattgctcatatacaggaatttaatttcatatacattgctcatatacagaatttaatttcaaattccactttttcattgctcatatagaggaatttaatttcatatgtattgctcatatacagaatttaatttcaaattccactttttcattgctcatctacaggaaagcaatgaacttttgtgtattaaccttctgtcttgcaacttggtataatgacttgttccaggaaactttcgaatcctctacatagatgatcacatagatccttcccaatctgtatacgctttacttccttttcctgtgttattgcattacctcggactttcagtacagtgatggaaaggattggtgagaggaaatgtccttgcttttgttcttgatcttagtgggaaagctagtttcttaccagtaaacatgaagtgagctgtggattttttatagatattcaagttgaagttcctctattcttcatgtactgaggtttttttttttttttttttttttaaataatgagtgggtgttggatttgtcagatgctttttctgcatctatgatatgatcatctgtctttcttttttagcctgttggtgtgatggattacaataattgattttgaaatgttgaaccagtcttgtatacctgtaataaatcccacttggttgtggcgtataattcttttacaccgcataatacattgttggatttgattggctaatattttgttgaggatttttgcatctgtgttcattagagataatggtttgtagttttcttgtaatatctttgtcaagttttttgctgacctcgtagaatgattctggaaatattccctctacatctgtcctctaaaatacattatagataatttcttcctttaatagttggtacatttcaccactgaatccatctggacctcatgctttctgttttgga

SEQ ID NO: 25431 - DNA, 1049 bp, Homo sapiens
tcagccctccaagaagctgggactataggcatgtgccacacacccagctcattttttgtattttatgtagagatggggtttcaccatgttgccgaggctgatcttgaatttctggactcaagggatctacctgctcggcctcccagagtgctgggagtacaagcatgagacacctcactgtgcctttcttgataggtttattggacttgtagatcagggtagtgcaatttatgtaatacatatccataagaagaatattattcttctgaagaagtctgacacacttgaggataatatgatgaaatggcacagtaataattgtatgggtaggcaagctttataactaatgtactagttttattccaaggaggctggtgaaagcatggatggtacatgggacagagacctccaagaaaggtttcagggtccctcttctcctattaaacatttttttttttttttttttttagacagagtttcactcttgttgcccaggctggagtgcaatggcgcgatctcggctcaccgtaacctccaccccccgggttcaagcaattctcctgcctcagtcttctaagtagttgggattacaggcatgcaccaccacgcctggccaattttgtatttttagtagagacagggtttctccatgttggtcagtctggtcttgaactcccgacctcaggtgatccgcctgcctcggcctcccaaaatgctgggattacaggcgtgagccactgcacccagcctcctattaaacattttaatgacttgtttgggagcaatggtagcacgttgaataattttgcaaatgagttaaacctgaagtataatgaggatgattttaggtgatgagccaaaattcagaaatcatcaatgggaaagaacattggccagatagaagtgaaattgaaccagaatatagtacttggatgtgaagaacacagggaatagttgcttaacagtactgtcttaattaaagaaccattttccttggattgtaagcaggcaagagtcattaatgatcagactacctaaagtagtaaaga

SEQ ID NO: 25432 - DNA, 1033 bp, Homo sapiens
agggtcaagggattttttcttaagggtaagagaaataacaacatgtttccatgccaatggcagtaatcaagtagagaaggcggcgagaagaaatgaagagatcatgggagaattgctgttgtggtgttaatgagcaagagggaatgggagatttagtgtgtaggtggagggattagctgtagctaggactgtacatccataatagcaggaaagaaagtaaaatgtgtgggcacagatgcaggaacgtggatagatttggtgatgaaggcttgtacaagttctcagtgaggtaagaagcaagatttgaagaattctgcacttgaggaatttacagctaatagatgtgagataagctgtgtacaaaaataacttttataaggacaaagtgacatcttctttgaagaacatgtaatgtgtaggagttaggaaggagagatttttatcctggaggatcctgaagatttcacagaaataagttttatctgaactaatctttgaagaatagataaaaatttgaacaagtagacatgactgaagaactttaactttttaatttttttattttaatgcttagcactcagccttggtacatggctacccctcagcaaatgaatgagtgttgaatgttctgtggtgaaagactgtgaggaaagtgatggaagtagaaagaccaaggtgaaaggtgaaagtttgggtggtccaaactttccagtggatactgttcaatagatatataatgtgagccacatatataatttaaaatttcccaggagcctcattttaaaaggtggagggaaacagatgaaattaatttcaataaatatttcatttaacccagtataacaaagtattattttaacatgtaatcaatattttaaaattattaacgagttattaaaacagttatttcatattcttattagtactaagtctttgaaatccaatgtgtattttacatttaccagagcatctcagttcaagctaaccacatttcaggtgcttggtagccagatgtaactagtgccttctctat

SEQ ID NO: 25433 - DNA, 1060 bp, Homo sapiens
tgtgagcttttctgacagaaggaaatagtgagtccaaagtccctgagtcaggaacatgccttttgtggtttttaaaaaacttcttattttgaaacaattttataaacttactgcatacacaaaacatttgatttgtcaactgtccaaataatgttcttcatagcaaaagaatctgacccaggatcatatattcatccaactctcatggctctcgaatctctttcaatctggaacagttccccagtcttgactctcatgctcttgacagttttgatgattacaagccatttattttgtagaaattgttccagatttgccactgggagccctttcatactggcttatgtgtcctcttgacaagtcaccatcagtccttgtacacttctttacttatttttaaacttttttcttgaaataattataaattcacagtaactttgcaaaaatagtacagaatggtcctgtgtaccccatttcccatagtgtttatatcttacataactatagtttattctcaaaacgaggacattgacattgatacattgtgtatgtatagctctatgccattttatcacctgtgcacttccttcctttttggcacaagatgctacaagctcatcttatcattttcctactccagccttagaatcagctatttctgcaaggagccctagttccttttagtgaagagtagtattttaaaaccaagatctgagtgctagatgagctcattgctatgggagtatctattgtacaccaggccctttcagtggtcacatccaggaagcatgtgcatgcacgtaagtgtgtgtgtgtgtgtgtgtgtgtgtgtgtgtgtacacccacacagacatttatctacatctatatttctatatccatctttattttttttaactttatttttgagacggagtctcgctctgttgtccgggctggagtgtagtggcatgatctctgctcactgcaacttctgcctcccgggttcaagcaattctcttgtctcagcctcccgagtagttgggactacaggcgtgcgccaccatgcccagctaatttt

SEQ ID NO: 25434 - DNA, 1050 bp, Homo sapiens
agtaatttatagtgataggaaaacaaatcattcgttgcttggagaaagtgggggcttttgaagaggggcaggagagggggatttttaaggagtacaggaaactttgtgggttgatggctatgttcattatagtgactgtggtgatgattttatggatgtatacatattgacaaaacttatcaaattgtacactttaaatgtgtgcttttattgtacgtcagttttaccttaataaagctcctttttaaaacgaagcttagagtttaaaagaatataaagtatatgctaaaaactgagaaaattttaaaatatgaatttgttaatttattgagaataactgtaataaagccatttaatttcacctatgtagtacttaatgaaaaatatgtttttcaatacaaaaagtttagtgagaagagtggcattgctctgtaattttgcaaatctttagtgtctgactttagtatgaaacgacggctggattctcatctgcttcttcatgtcatcagttgtgatatgttgtatttgttgaagtaaatgaggaaaaatcatcattgtacatatttgtagttggaaaagggagggggatagtaatagcctttctagataattctggatattcttcaagttctctgttgaaatcccccgtcttgatatctcaaacatattaatagcagtgattttgaagtttatgttaagtttctggatctcctataggggtgtgtgtgtgtgtgtgtgcacgcgcgtgtgcgctttctctcgattttatgatattttagttttatcatctggtatggctgctaatgtttgactgctgggcattgcatgtgaaaaaattgcatagaattaggtaacattgtcttcaggaggatttacgttttcttctggcagttactgttgaggcagactaccttaatctattcagtaattgaactgatttgaggcagatttttaatcttttgagggttggtctagtttttatttttccttattacttctaggatatagccctttagtagactccattaaaaaccctggactttttcttct

SEQ ID NO: 25435 - DNA, 2046 bp, Homo sapiens
tcatgagtgaattcccattcacaattgcttcaaagagaataaaatacctaggaatccaacttacaagggatgtgaatgacctcttcaaggagaactacaaaccactgctcaacgaaataaaagaggatacaagcaaatggaagaacattccatgcttatggataggaagaatcaatattgtggaaatggccatactgcccaaggtaatttatacattcaatgccatccccatcaagctaccactgactttcttcacagaattggaaaaaactactttaaagttcatatggaaccaaaaaagagcccacattgccaagtcaatcctgagccaaaagaacaaagctggaggcatcacactacctgacttcaaactatactacaaggctacagtaaccaaaacaacatggtactggtaccaaaacagagatatagaccaatggaacagaacggagccctcagaaataataccacacatctacaactatctgatctttgacaaacctgacaaaaacaagaaatggggaagggattccctattcaacaaatggtgctgggagaactggctggccatatgtagaaagctgaaactggatcccttccttacaccttatacaaaaattaattcaagatggattaaagacttaaatgttagtcatttaaaaccgtaaaaaccctagaagaaaacctaggcaataccattcaggagataggcatgggcaaggacttcatgtctaaaacaccaaaaggaatggcaacaaaagccagaattgacacatgggatctaattaaactaaagagcttctgcacagcaaaagaaactaccatcagaacaggcaacctatagaatgggagaaaatttttgcaatctactcatctgacaaagggctaatatccagaatctacaaagaactcaaatttacaagaaaaaaacaaccccatcaaaaagtgggcaaaggacatgaacagacacttctcaaaagaagacatttatgcagccaacagacacatgaaaaaatgctcatcatcactggccatcagagaaatgcaaatcaaaaccacaatgagataccatctcacaccagttagaatggctatcattaaaaagtcaggaaacagcaggtgctggagaggatgtggagaaataggaatacttttacactgttggtgggactgtaaactagttcaaccattgtggaagacagtgtggcaattcctcagggatctagaactagagataccatttgacccagccatcccattagtgggtatatacccaaaggattatacatcatgctgctgtaaagacacatgcacacgtatgtttattgcggcactattcacaatagcaaagacttggaaccaacccaaatgtccaacaatgatagactggattaagaaaatgtggtatacttttatggaatacaatgcagccataagaaaggatgagttcatgtcctttgcagggacatggatgaagctgggaaccatcattctgagcaaactatcacaaggacaaaaaaccaaacaccgcatattctcactcgtaggtgagaattgaacaatgagaacacttggacacaggaaggggaacatcacacaccggggcctgttgtggggttgggggagcggggagggatagcattaggagatatacctaatgtaaatgacgagttaatgggtgcagcacacgaacatggcacatgtatacatatgtaacaagcctgcacgttgtgcacatgtaccctagaacttaaagtataattaaaaaaaaaaaaaaatatatatatatatatatatatatatatatatatataaatgtgtagatcagggcggctttaaaaaatagctttttgaagttaatagctgtttatgtatatgcctggtgttttacagacattttatgtcctttatttccttttcataacaatgctgcaaagttatgttattatctctgttttattgatgctatgaggtttagagaagttatgtaacagttgcgttggtagagttaatattcaatttcaagttcgtctgattccaaatcac

SEQ ID NO: 25436 - DNA, 1056 bp, Homo sapiens
gtgctgctgcactttagcctgggtgatagaatgagaccctgtctctggaaaaaaagtcatttctttttagttttatctgtacctgagggaagtgacaaccaactatggctgagagggaaacatagattttattttttaaagtgaagaaagatttgtcattttttaaattataaaaataatatgctctcgttgtagaaaatttagggagcatagaagggtataaatgctaatagcacttatctacaatctccttccttagagataatcactgtttaaattaacattttggtttatatatcttaacttatatgtatttaaaaattacagtattcatgtgctttatctttttaaatatttaatgaatagtatgagttttatatagtcacaattatcaatcgtttcactgtaaagtgatttctggcttagtggtcatgtttaggaaattctctgttaccaggattatatcatcatatacctgactttttgttctcacatggctttatttttattgatattttcatttcatttggaattctgatggaaagtatgaagtaggagttcaaagattatatcaggagattgagatttgtctaggtattaaatttcccaaaatattaattgggagtttctgtttacatctctttattatactttctatttggagagtggtgattggggtgagaaaaaaggtttaatgattaaggtctaatgattataggttaggtctctatttgggcctcttgaatttcttcatgaaaatactatacaactatacttaaaactctaatttgttagtgataaggattactggtggagagaatgtggatgactcagtgcaacttacagcttttaaaaataataaaagaacattttcccttggtggactagcatatggagcttactgtttaataaattgatgtgaaatcatggtgcatttggggctcaactaaaactatactcactttatccttaattggagtcatttttctttcctctcatctgtactcctgcccccctttaaagtattattaaattatatagatattcttgtaaatt

SEQ ID NO: 25437 - DNA, 1031 bp, Homo sapiens
aagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctggtaagctccgggacgggacggggacgggcggtggtctcccaaatccggccccctcctccccgcgccgccgccaaccccgctggccgtcgtctgggtcgtctgctccccctgggccaggcgctgcccatcacgtgctgcgaactgcgctctcccgccttctgctttcagcatctgctcacagacgtggtatcagtcttctaggcttttacatcggaacttcagagcactgttggagaaaattgctcaactttgcattagagagtccatgtttatctccttctatggactctagctgtatctctgcaacctatcatttgtttttctgcctcctctcccatccttctgctctactgcagccgtttaaaaccttgtccacgctttatatttcccacgccacagctcccattcatcaaattatctccccacctgtttgacagagaaaatggttaggaaatttggctccctttcctgcaaaggctgatttcttctcttgttcaggaccagatgctgtattccccgcggttatcagggccctcaacaaatgcattttctttttcttttctttcttttttttcttttttttttttttttttgagattgagttttacttttgttccccaggctggagtgcaatggcgcaatctcagctcactgcaaccc

SEQ ID NO: 25438 - DNA, 1111 bp, Homo sapiens
acagaagaaagaagaaaattcaggaagcttgggaggtagtcacaagacagcttgagtgactcataaaagctcagtggtgcattttctggtgggaggctgttatcgcgagaggacagccagatcccatgggtgtttccaagcatgtcactgctgttcccagcatgtgctttcttgggcattgtccagggtccattcctgcttgtggaactgtccttccacagcacatttagtcttttttcaaggtcaatgttttcaggagccatcactgaaggagagagctaactctagtctgattcctggtagagatgaaacttgtgagggctgtgggctgtgtatttaaaaatgatgaattaagtttaatgaatatttccttactagatttctatccctattaagtattttgcaagatttttattacttcctaagaatctaagttatttcccctcatttttcttgcaaaggatgagttcagtatttcagctgttctcatttattgttaattctcttttcctcgtcatttattagaagatccatttttctctgtggtttatctttttatcccttaaagtgtttataaaatcctctttagctcttttaccacttaaaaaattacccttccgatttttttttttaaaattacctgagtctttctggtttggcctttagctgaagaataatcaaattttctcctttattctgattcttttttattactaaactcctttaaacttataattttttgaactctctctgctaaagctataatgacagtttctatttttacccagtctggttggaatggagctgcaattccatttgattatggaatatacttttattgagcacctactaactaatccatgtgaagtgactgtcacagtgccaggcacacagttagcactcaatatatgctgacattattgttatttccaggcaccatgctgttgaccctagggttacaaagatggacaagaaatgagctgtgcctgtgcttaaacctggcagtgactttccctcacctccatgggaatttcaagtccttaagatagaccccaaggctgtcagtgcaagtccctatcttgtggacctcaagtatcagccactacccccg

SEQ ID NO: 25439 - DNA, 1030 bp, Homo sapiens
ggtctccaggcactcgactatgggctcagtcagcaatgatgaaggtagctgatagctcaatgccgcagtgacatggaaatcacctcagacttcagatgggacttgggcttactagacagccaagaatcagcctctgatgttattggaacacaacttgtatttctgtcgccaagtcccagtccaagtcaaaccctgggagagacaccttcacaaaaattttatataggcggatttcccttatatcctttagatttcagcctccttcaaattagcatgactaaaacggcacgttatcagcagaaagggcacactggtttgcatggtttgccattgattctgagaaacactaggtcctattctgctcaacggacttttttgttgttgtggatatgttagatattccatgatcagacttctgggttttcaatgccaaacttcaaaacttttgtatcagataagacaaagcaaacactcctatcttttcaacttctactgtctgtgtggagtggaggagagcagctggaacaggctacaaggctcaagggctcgtgtgcctaatagaggtagttattagagcaggagttgttcaaatagaggtgcttattttgaaaaggtatggctcttcaaagtcactctgcctcaaataattgtttggagactaaaggtggaggggcagatttgtaattctctatctttaaatatctctctgtattttaaaagtaaaaacgtgttcattttgtttgaaaaacttcaattagcacaaattcatacaaagtaaaatgtaaaacattcattgtttccaatttttaccaaccaacttcattcctagaggcaaggactatgtaaggataccgttttctgtgtatccttctgggctttttctgtgtgtatatgtgtgtgtgtgtgtgtgtgtgtataaattttggggggatcacataaatggcatcatactacacataatatatcaggatcccaataggaaacaaatggcatgttggaattaggataatttaaaggcagtttagttggt

SEQ ID NO: 25440 - DNA, 1051 bp, Homo sapiens
taaatcagtgagtgtccccctcctcctttagaaagtaaagatgtctgtctggcattactgattgaaatctattttgaaggacaggtgcatttgatgggggaaaatgacttataattgtaaataacctcttgttacttggtgagtgaatgcagaagtattgtgtttagaatggaaacaccaacaacttctggaatgttacaaaactatgcccatagtttaaattgtctcttaaattattgtttttcaaaaattgtcttacctttcactagagtagtagaaagatcagggcactagtgggcagatacttgtgtgtgtgaccatcctccctctaccactagttttagaatttgggggaagattcttcatctgtgtgcttggctgcttggtgtataaaatggaagcttcaactagaggagatagaggatgttgtgctcccctcatcatttctctcacacacattaaactccactcttcatctccatatcccaaacacctagaagatccccaagtattgactgtatgagctcttgtttttttcattttctctctatccccttcttcattctcagagataactttgggtgatattaaggatagagacaagttcttacagagtaaggataagaatagataatgatattgcaatgttcagttaccaaaaaatgtgtgactgctactttcactgtggctgccaaccctcttaggcagactttgcatacatcagagagagacttaatatttaattatcctcgaggtgcccaaagtagtggccccacaaatcagtgtgttgctgggaaaccagccagctcctgcaaaattaaacacagagtctctggttcttgctacctcactggttctcggagagacagtaatttttagttttctaatgattagttaacagaattaaaaattcagaggccttcatttttcaacagtttgagaggcttttatttccattccagaaatatgccccagcttggggtgggagggaaaaagagagggacatgggggcaggggagaggggatgaatgtgttgtgttaatcctcatag

SEQ ID NO: 25441 - DNA, 1072 bp, Homo sapiens
actcagatctcctgatctttctaatagaaaatataaactagctacttagagctaagttgatagatctttgcgttcagacatatagagggctatgtgtgtgtgtttgaaagtgactctatgtttacattggaatgaaccacttacctactttctttttttttctgctaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaaggtaaacaaaaagatattttaaagtggtttgagcacagtagaagaaatgaaaatttctcctacattctgtagattttatttttgtttcctttcttgaaaataattacatgttggctttttaaaaagtttttgttcatttgctgtgaatgaggtgttttaattaggaaattttttttctctattgtagatgtacaaatatgctaaaatagagatgactattctcatttacacgtatacttagtacatgttacagttctcatgtcactttatagtaaatatgccattctgttctttccagttgacaaatgtaaaggagctccagtgcccagcccagattacctgcattcggaaaccaggctaacaacttagcttgggttagcctgagtctttaaaaaagttattggccgggcatagcggctcaagcctgtaatcccagcactttgggaggccaaggcaggcagattacctgagatcaggagtttgagaccagcctggccaatatggtgaaatcccatctctactagaagaaaaaaaaaaaccaaaaaaaaaaaaattacctgggtgtggtgg

SEQ ID NO: 25442 - DNA, 1005 bp, Homo sapiens
ggtctgcctctcccagtccactgactcaaatgttaaccttctttggcaacaccctcacagacacacccaggaacaatactttgcattcctcaatccaatcaagttgatacttaatattaaccatcacatctatcaaattgtctcttcctttgaaagtgttccttggagctctcctgccctcatgctatctcttgttctctaattcctggttgtcacactacccacccaccctgtggcatagttccagccacccaccaccattccctttctgggtgcaacaacatagggtagccgctgttcagagtcattgcttgaggaagcagcattaatcctgtgggaacagaagccagtacagtacatggggcccagtgatgatgcctgaacaccggatttctaacctttcagctgctccagatggaaagaggtgctctctggtagcctgagatagcacatgggcatgagtcagctagttctccagggacttcttggcaacttctggaaagcatccgattgtaggtctaaaagtagaagtgaagagttagagagaatccaggatgtttttcctatcaagatgcaaagcctttttgaatgtcttccagacagacagatacatcaccagtgagtgggtgagagttaccacctctccatttgtttccatctctccaccctgtgttctcaccttaattcagtctttcatagttcttcacctaaacgtcctgcgacagcctcgtgaacatcaccttgtcttcatttatttacttctgtattttcccccaaacaactgccagagtagtcattctaaaatggaggtgtagacatcctcctctccacccaaaatccttcaggatctcccgttgccccagcatgctctgcacatcccatgattggcctctgtttttccaacttcatccttccatgctgcagccataccaaaaactctgcctttaatgctttttgctaccatttctttgcttagctacttggttcaggtgttacctcactcag

SEQ ID NO: 25443 - DNA, 1049 bp, Homo sapiens
agtctaagtaagacataattgggagggtaaatcttctggaaaaatcatgtggtgcatttccaaagtcaaatatcatttccgttgaattattcgtatactatccccttcattagtgccgatcatgagcatctgtgttttttaaaaataaaggattcatattgtgattacatatgactacttagtatttgctactgagatgctaaatgaataggatacatccttattgaaacaagctgtgtacaaacacagaccgtattgacaatgcatactcttatgttaaagctatgacattggcaagttgtggtttgtgtaaaaatttatgtgaaaaagacaagtttttaatggttgggatattttaagacatacaagcaaaatgaaagactgattttctttttgtggagcgtgatgaggaggggtgttattggaaggaacaaaatcatattatcatcattgtagtaatcaaaagatttactctaaatttgcactcctaaagctattttattgctctgatctttagtactcatattatcaccctccatattagctaacattgatacacaattttgcagcatggtctgcatctttaaaaccaaaatacccagctctaggaaaccagcctctctcatgtctttgcacttaacctttgcagctgccctgacagaatttcctcatgtgtaagtaaccaatagtatactttttctgaattaaggcaaggttactatttaacacagttccatatgatctgtttttagatggtgctgaacagcctttcctaaaaggtctctgccactaattatttgttgaaatcttatggggctgaaaacatggcatttaataactatgaatatcatatgcaacctcagtaaaataatgtttctttttctgcattcagttctcttgcaactagcaagtgaagccttgccaaatgacatgaccttggctcttgcttaccttcttgccttaccacaagtaagtttgcccttaccaatgaagaatttaaaatgactaaatggaaaatgtatgctgtgaattttcatcggtaaaattgt

SEQ ID NO: 25444 - DNA, 1041 bp, Homo sapiens
gtgattctcctgtctcagcctcccgagtagctaggattacaggcacgctgcatgcccagctaatttttgtattcttagtagagacggggtttcaccatgttggtcagactggtctcaaactcctgacctggtgatccacctgcctcggccttccaaagtgctgggattacaggcatgagccaccacgcctggccgcaaaataattttattgaatactagacattatgaatttttccttcttgtatgctatcatatttttgtatttttataaattttcttttttaaaaaattaagtcttattttatatatttaaagtatacaacaccaagtgatgggatacatataaatagtaaaaaggttactatggtgaaacaaattaacattcatcatctcacatagttatctattttattttgtttgtgtggcaggagcagctaaaatctactcttttagcgtgatcccatatacaggacaattttattacgtatagttctcatggtgtacagtagacctctaggcttgttcatgtacatatctgctactttgtatcctctaatctgcatctccttatttgtcccctccaaccctttatagtaaccactgttttggtgtctatttctttatacttgatttttaaaaattttacatgtaagtgaaaacatgcaatatttttctatgtctgatttatttcacttagcataaatattcttgtacttttttctgggacatggttaatttacttgcaaacagtttaatctttttgctttttgcagttgggatggaggaagagctccttctagggctaattattccccataactgagctaagactctgcttaatgcctgtgtgtcttgaggttttccagcatgtgtgagcttgacatgttttctttttccccttttcttttcctagcctcaggcagttttattgtaggcgtttatggcttctacttgtctgaatattcgtggggacccttcgtagatcttgggaatttcttccagttctgctatgtcttccctggtgcttcatcctgcatgtgc

SEQ ID NO: 25445 - DNA, 1066 bp, Homo sapiens
ctgcctcggcctcccaaagtgctgggattacaggcatgagccaccgtgcccggccgggtaatattctttaatatataatgaaataaaataataaaacctgttaccctacagattactagtttttcgtattctggctgactggaacttgaactattcctggccctatgtgaggtccagggatgttctttctgctcctttggttggtttccccatccttgtgtgatttcatcacaggtacacactgagcagtgcttagtcaatgactagagggacccctcccaggatttttggagctttctttctcagtgcacgttcttctctgatccattgtctgtaaattctagctactctggctctctgactttcaaactctgtctctgcagcccagaaggcctgccaggctctgtttagagttccctttttatgctgcagcctgtcacttctcttcaggcagtgagcgagggcgctgctgggctcactttgtttttttcccttcccttagtgtcgttatcctgcagtgcctggtgtcctgctgtctatttttgttgttgatcgtggtggtagttttttagattaattcaagagattcattactgttcctgttactccatacttcattgttgttcaaagcagaagttctcttttagtgttttaaagtaattttcctgagctgatcttttattagtctgttttgtgtaggtttgttcatctcattagttgagttcttatccctgttgtcatggagcctattctgtcttttcccataacatatgatttatttaatcaaaatacgagctccaccagccacctcatggtgtgtactataaggttaatgtctctatgcagttgattaaatggatttcagaattaggaacaggtgaaaggctttccttaatctggaaattacagaaagtgatcgagaaatgtagttgaaatacagtatattttaacacatggacttttcattactgcgaacaacaaataagcaaagctgcaatgtattgagccagagatgttctttttccaaattgccatcccagaggttgactgtcagccgcaggtgttt

SEQ ID NO: 25446 - DNA, 1050 bp, Homo sapiens
aaatagtttactagtacttcatgtataatgtaagaacttaaaataatgtttttccattttcctccttctggcttttgcactattgttgccatacatttaacttttacaagcatgtgttatgaactccgtaatacatttttgttatttttgctcttatcagtaattttttaaaattgaaaatgtattttgtttttacacacatatttaccatttccagtcctcttcattgctttgtgtagatacaatttatatctagtgtcagtttccttcagcctgaaacactttctttagcatgccttgcagtgctgatgttgaattctctttgcttttatggatggggagaaatctttgcttagttttggaagatattttattgagtatagaattctaggctaacagttgtacttgtttagtacctcgttggagctaccctgctgtcttctggcttgtattgctttaagcagaagtctgctgtcattctttatctttgtttctctttgcatgatgtgtcttgttttctttgcatgcttttaagattttatttataactagttttgagccattttattattatatgccttggtgtgttcttctttgagtttattcttgttggttatcaagttccttggatctatggacttcagagtttcaccaaatttaggaaatttatggtcattatttcttcaaatatttttttcccttccttgtttctccttcccaatacacacacttttttttttctgggactcctattatatgtatgttgaccatgtgatcatatcttacagcccattttaaaaagtttcttttttatactgattttattttggattgtttctattactgtgtccttaaatttgctattcttttcttctgacttgtctataattgatgccttcagtgtattttttttttaatctccgagactatgtttttcattcctagaagtttgatttgggtctttaatattctgtgcctcttgttctcatgtcattggtgtttcttgatctgtttcaagaaattgatttttgttctggttataagccataa

SEQ ID NO: 25447 - DNA, 1029 bp, Homo sapiens
tggaatacaaacttatgtcttcattgtcattttattttctttttcacacatagtaggtgttggactaatcttaagtagatgaatgaagagtaagtgggaagatggcagttgatgcgatgaatcttgatataatccacagctgttttcacaatttcaccagactgtgagttctttgagaataggcactgaatatgtatttcatcacagactctcttaggcttaacataataaataataataaatatttgtggaatgaataagcctttgaaatgttgcttttatgttgttggaggcagggatttcattatatttagattttagtggtaaaaacaattagcaaataaaattctcaagtctaaagaaaacattactttagccgtaataggttttctgtacaaaacctataactattcttagaacatcctcctttgggttatggctgcagtataaaatgatggcatattaggctgttttcagtaatgtggtagcatgaatatgtcgggtggggagacatgataccttactgaactcatcataaggatcacagctgacagtcctataacaaaagacaggttaacaagagaaaagcataacaaatttatttaaaaacaaatgattttccttgctaacttgaatttggaatggaagatgtaaagataaatttttaccttctcttcttgaccaggcactatagttagagatccaggaaagctgactttgtttaaaaaaaaaaaaaaaatcaaagaacttcttacctttctttgcttgccttttgtcagttgttccaggattttgtctgcaggttccagagcaagtcaggtgtctcagctgccccactttgggtgccagaaactgttggggtggaaaggtgtgatacctcttctaacccatcataagaggacacagccatcactcctataacaaaagacaggttaacgagagaagcatgacaaatttacttaatcaacattttacatgacacaggcaccttcagaaatgaaggctctggttgggtgcggtggctcattc

SEQ ID NO: 25448 - DNA, 1094 bp, Homo sapiens
catatacctctaaacctaaaataaaagtaaaaaaacctaaaaaacaaaacaagtttcacactaaactttttttttttggccaaaagatgaatatacctgtgcaagaatttctctatagtttccttggagcagtttgtgggatagttagttgtgtgcatttatttgatattgtcaagttgctccaaaatgattgcttcaatttgcaatctcgctagtagtttttaagagttactaggcccctaaacattctagagggtgattggtgtaaatctgtgttgttttaatctgcattattggcttttggatttctttttttgtgatttgctgttgcttatcctttgtctactttccttttgaactggttttgggagatctttataaattctgcctactaatactttgttagttctgtgtgttgtaaataacttctcccagtctttttttttttttttttttttgaaatggagtctcactctgtagcccaagctggagtgcagtggagcgatctcggctcactgcaacctctgcctcccaggctcaagcgattctggtgcctcagtatcctgagtagctgggtctacaggtgcacgccaccacacctggataattttttgtattttagtagagacggggtttcaccatgttgcccagggtggtcttgaactcttgagctcaggtgatccacccacctgggcttcccaaagtgctgggattacaagcccagtcttcattttatggatggaaattttaaattttaatatggtcaaatttgagtgagaatgtcttaatgatggcagggtaggaaaatgtttacaggtcaagatgcacaaagcccagctcataagtgaaagcttgatgagcatgaactgagttggctcttcttagaacttattttcttatgggaattctgtgtttttctagtttcattaaatcagtttgttcagttccatgaaaaattcttacaggatttatgtgaaattgcattcaatttgtaaattaagaggaattggcatgtttaaaatacccaccaaagaagatagtatctctccgtcttcattcatgtaactctcacaagcttgaaattttcttctcga

SEQ ID NO: 25449 - DNA, 1023 bp, Homo sapiens
gctcgacagcttcaagttgagaccatgaatgttctcaggcagcaatccgcatagtggtatgaatttctccagaggtcctagtgaatctcagagacagttgcatcaatgcagagttcaggctgaggaaaatgcaacaaaaaaattagcaagagaaaaacttaaggacatgacagagatgcttgaatggatggaccctaaagcccaggttgaaaaaggaagaaagaaggaaagaaggagggagggaggtggggagggaagacgggacggagggagggagggagggaaaagggaaggaaagaaaaaaagaaggaaggaaggaaggaagaaagggagggagggaggggaggggcagggcaggagggagggaaggatggcagaatgggtttcataagggtagcagggtcaaggcacagttttgctgcacccaacgatgaggggtgaaggaagaaatgagatgtgtgaaatgcagaaggctatgggctaagagttgtgtgttcgaattgagaacttgaaggacagaagctccaattgatggcaatatccaagtgagactaactgtgaccctgaggggcaaggaggatgctgtcttagttggtttccctagaagcacagcctgagaccaggactcctaggaaagtgattattgagggagtgctctcagggtagtgaatcaagcaggatggggctttgcctggacccaaacttcagttccggagcccaaattgtgctatgaaatgggcacagttggctctgaggcagggacaagccttttgcagccccacgtcagccctctgtcagtcactgccacaagctggccctgtgtggtcaagggaagttctggagaaaaagggccagctgtgagtagttgctggcccacacttacagcactttgggattgtcacccagtgtggaaaacggatctaaggaagacaccaccagcatctaccacagatgcaacccacccctaatctgacacaggtgggttcagggagagtcagcagatgccacaaaagaagcagctgg

SEQ ID NO: 25450 - DNA, 1035 bp, Homo sapiens
acaaattgggcactgggctaacttactacagaaaacctactctccatctgctctaaaagcttaaaattataaaactgcctcgaaaagatcacgctaatttacatataacttacctgcctgtcaaaactaatctcagcactctataaatgaagacaacaaaatacagacactctaatgcaacattcataatgtccaggaaccaataaaaattattacacgtgtcacgaagcaggaaaatgtgacccataatcaggtgagaaatcaatccataaaagctctgaatagaagaaaggaagagctagaagtgatggggagaaacgtggaagaactaagagaaagaaaagcagccgctgacagccaggaaatggcccggactgcccaccgggccttggtgctgccgggagctggcccagccctcacagtcaggtctcacaccaaacataaccaatgtcacaaaatgccagtgaccatgatggagcaaggcaaaaacaagaccactctgtcattaagtctgaacacagacacaaaacaccaagcatccctgcttcctgctatggtgagtgaccactgcttcttcacccgttaagagcattgcattggtctgtgtgccctcctcctaggtatctaatcatagaagtgtccccactccctgacagtaaccaatccacagtaaacctctgcttctccgaaccctccccaaatcaccctcccaaagtccagatcctagaagtcctttctaacaccctcctgctgaattgccccaagattccctcactgcaagcagtaataaagtcaacttgtgtaagtgtgggtatgtccttggggactttggctgaagggcattgacaaggattagagagaaaagttttggagaggaagggttttggtggccaatgaggggaaatgacaagaagtcaaagaggagaaaaaacttggaaaaacctactctgtagggagcttatagagagaccttggagggagccaagttaagtgtggaagatggacaaaagattaaagagtgagaaagatgagaaa

SEQ ID NO: 25451 - DNA, 1027 bp, Homo sapiens
acaatgtacagaacataagcgagcaagaacttttgaatttccagttaaaaagcataggatttgagacctacctctgacaggcaaaatatctctacttattgggtctcaatttcttcatctacaaaacaatattattaccaattcctacctctcatggttagagtgaggctcaaatggtgtctttcatacattatacttactgtggttcaggcatatagtaagttctcataaattagcaattattttcttcttcatatctcattgtttgctcaatctactgtaatctggatgtagatgacactactctagcaaaacttgtttagcaaaggttataaatgagctttaatcttaccttattttttgaagtatttgacaccacagacctatcctccatcccttaaaatgtcttcttaccagctgccaccctctctttcctggttttcctgtttttctattatttgttcttaatctgccaagctgcctcccctaattctgttgcccttaaacgtttgagatctttgtttgcttgttatagtgttgttgattttcctgaattccatatcctacttccccctacaaatatacacatatcacagtccccaaaactactacctgcgtatggacagatacctatcaactcatagcaccacatcctgacatctctcctgtactctagacccagatgccctactacctattagacatcacctggtaaaccaccaatatctgaaattcagcagccccgaggttgaaagtgccttcatctcaaagcctctttcttttcctgaattccctaccttgattaatgcaaactgtcatttccagcgcagtcacctacctttgacatctgtgatttacctttgattcttccttgttcaagtctgacctctgtccgcttctcctttaagaccgctctttggtctctgccctcttctcctttctcactgatattcttcctctcatccccttatcttcgcctcatacctgtggtgatagcctcttctccggactcccaggcttgcatgtg

SEQ ID NO: 25452 - DNA, 1096 bp, Homo sapiens
tctagttatcattttgtctaaccattttgtctttttttttcattttgcttgattttctcatttatgttctttatttccatctatgtgttttccacatttctcttttctcctatgcatcttctcattttgtcttcatatctgtgtgtgttctttttaggaggaggttctagccctcctaccttcccgtctgtgggttctcttgctttacctactcctcttgtttgattattaccttcttttgtgtatctattctttcagttcttttatgtctgctttgaggtattccttcctggtagcacttgtctaatgttcgtgtttgtttgtttgtttgtttttattctttaagacaggctcttgctctgtcacccaggctggagtgcagtggtacaatcatggctcactgcagccttgaacttctgggttcaagtgatcctgtgcctcaccctcctgagtagctgggaccacaggcacatgccaccatacctggctaatttttattttattatttgtagaaacagaatcttgctatattgtccaagctggtctctaattcctggactcaaacgatcctctcatcttggcctcccaaagtgctgggattataggtgtgagccaatacaactggcctcttgttttgttttaatttatggtgttcaattataattttcatctgctttgtggcaacactgttctaataagttttctttgtctgtaggagagttttgctgttctttttcatattttccccataaatatctggatgctgtgccagcgcgttttttgttacttatttttttaattagttgaattttcctgggccagttatttgaaggagaatgggaagggtagctgtgggagcctcgaccagggttgcctttcatgctaattcagttataggcttgccacagtaataggctgttgccttttgtaatagcactctgagtagccatgccatctctgcctctttgatcttatcttgtttaggacaggggagggtggattctaatgctggcttgagttctttttttcttttattggcatctgtcactgaaggaaacctttcttccagtgtgaccccttccctttttgaaggtgt

SEQ ID NO: 25453 - DNA, 1051 bp, Homo sapiens
cttaggtgatccacccgtgtcggcctcccaaagtgctgggattacacgcatgagccactgcacctggccaactaaatttcttaaacatatggataatatcttatttatgtttgtttacttagcatctaacatattctctggcacaagatatatattgtatagtttggaaaaaatgaatagaatgaaagtcattctttttgattatgatcttaagcagaatattgtctcctaaatatcatcccttctgatttttcagcttgttttcctctacttcctaatttaccattaagagtataaaaatattctagtgttctatttgtatttgatctgatttgcatatagcctatagtttctcctctctcagaattatttttatgtttcttctatttgaaaacttaaagtattttaattaaccttatatgctgtttaaattttatcaggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagctagcagacccacttaaggtatatatttttggtactgtgttacgtatgtattttatgttttagttttatatccacatgtactctatggatattggcctaaaagaatttttggttaaatgtaaatagcataaaaattgaatataaagaatggtgggaaccaaactttcatcattagatcaattagtattaaacacttctgttcatggctttaggagaataaatcaccaaatttccatttctcctagaggattatagcttttttttttcacctttttatgatttttaaaaatcagaaccaggagcagagacgtctcgtacgtgtacaatgtctctgtgcttgcttgttgtcccagctttgcttcaataactcaaagattagttgctgtaaaagccaacttgaaataaagtactactcatctcttgtttgtcagctatctcagttatgtttcaggctgaat

SEQ ID NO: 25454 - DNA, 1050 bp, Homo sapiens
gccaacatggcgaaaccccgtctctactaaaaatacaaaaattagctggatgtggtggtgggtgcctgtaatctcagctattggggaggctgaggcaggagaatcatttgaacctgggaggcggagattgcagtgagccgagatcatgccactgcactccagcctgggcgacagagtgagactctgtctcaaaaagaaaaaaagaaaagaaaatttatatagcagtaggatatcagtgcttctgaagttctcactgtactaaagatagtttaaatacaaggagtagctaggaatgaagataataaagtaggtgtttggtaatcaagagaggtgtttgataattcagagagcaaatatatgtagtcatttaagaaatgttttcatgaggtactgtaacttaatgccaagtaatcatactagctaatgaaataaaatattcattagctacattatcagaggccagccgcccttcccctcatacttcagtggttctcaaccttaaccgttcattagaatcaacttggggagcttttaaaaaatcccattaattgatttttctgaggcataatctgtcttaattaggtaatattgtttttatagaaaaaccacaccaatttattcaaggtagctctaggaaaggatatttaccataaagatgcagggatatatattcatgaaactgcagagaggaaatactgcggggtctcttgagggaccagactgagaccctgtaagaactgagtcacttctctctctggggctttcttttaattgcatctctggctgtctctgtgtgtcttgtctctggacctctgtcttcctctccctcccattggtttgttctgcaactctcctctgtgcacctccctcacaatcctaacttaattggctgtacttctgtgtgtgtgcactatgctctcctgtctctccttgtgaaaagtgtacaggtaagtgagtgtgtttctctccatcactgtctcaagtatgtgtacttccttattttttgctaatctttgttgctgtgtgtctttgcatgtgcaggcatttata

SEQ ID NO: 25455 - DNA, 1032 bp, Homo sapiens
ctcggctcactgcaacctccgcctcctgggtttaagccattcttctgcctcagcctcctgagtagctgggactataggcgcgcgccaccacgcctgactaatttttgtatttttagtagagacggggtttcaccatattggccagtctggtctcaaactcctgacctcgtgatccgcctgccttggcctcccaaagtgctgggattacaggcgtgaaccaccgcgcccggccattaatttttcttcttgaacttattattttattgataatcttcattgttcctgcttgtatcctgtaagggagaaatgaggtgttctttaattctgttttttttaaattataaataagtaaagaaatattaaaaactatgacgagctttatggataaattgaaaatcccagaggaggcttttttctcctttttttattccagcataattaaaatatttttctttgcatctgtaaatatgtttctttagccttttggaaacaattttactattttaatctgtatctgatgctctagacattcgaatctgtgtttgaaaatccatcatcattaaattacaaagtgattcctattttaaaaggtaggatccttcagtgtctgttagatgcaagttaccgtggcaacctaatagcaaactgcaaatcccaggtcatgctcagcaaataaaaaacattctcagcaaataaaaaacatcgtcatcacgtagtgtttgggtgtactgtcttctatatagaatctcacattccttgtgagaagcgtatcacattttccctagtgcgttatccattagcttatgtctgagtgcttgctaactgcatgatcatgtgttaggcattaataaaaacagtttctaaaagggcattaaatgttggggacaccaaaaagtaatgctttctgtttgctcttctataataaataaattactgctcagtaactgagaagggaatagagggtggttagcagagaagaaagtgttggaaaaataatggcctggtagtatctcagggaatttaaattaataa

SEQ ID NO: 25456 - DNA, 1076 bp, Homo sapiens
agtgattctcctgcctcaacctcctgagtagctgggattacaggcatgcgccaccaagcccagctaatttttttttgtatttttagtagagatggggtttcaccatgttggccaggctggtctcgaactcctgacctcaggtgatccgcctgccttggccttccaaagtactgagattgcaggcatgagccacccgcccagccaataatagaatcttttttttaagtttaatgaaggatagacgagatgaaggacagattaatagccaatttcactctctatgaataattaactgtcaaacttcagtttatgccagtaggaacctgggcgttaaagaggtttaactgggttttgacaaacctggatttggatctgagctctgctatgttagagctatagaagcctttgtatgttagaactaagttgtagctacataaattcaagtcatttacttgtgcctcagtctctccttttgtaaaaataagggcaatatttatctcataaagatgttggggatcaaaggaaatagaaagtgttcatctcaaaagctaagtatgtagttattcagcagatgttaattctactcacccatttgtactcaccaattctactaattcagtcttttaaatctcttgttttatctcttccctttgtccctgatattaccactgcttttgtttagcaactcatctcttctgctactattcttactttctgtttcatctatcttctatattgagccacaggatgttttcagtacagaaatctaagtgttcagattttattaactgaaatgctgtgctttatacttcccggttttgctgatcctgaaattttagatgggtggacttaatgaataagtctcatataatttcgtgatatattccaagcagtgtacttaattaagcacattcaaaatgaagttgtttaccatagaataaatgtctgttgtgataggcagagtagaattgaggatgtggtaaacacaggccagggcagattcagaagtagtagtaatttgcctttttaaaaaaatgataacacttttttattaaattctaattctgttatgtgtg

SEQ ID NO: 25457 - DNA, 1077 bp, Homo sapiens
ccttctcctttgaattatgaatgttcttaatggcatctagaatggttaatactttcgcagaagattgtcaatttattttgcccagatccatcggaggaataactgtggcagctttagccctaggaaatgttatttcttaaataataagactttaaagtcaaaattactccttaatccatgggctgcagactagatgtatcagcagacatgaaaacattaatcgttttatacatctccatcagagttcttgggtgactatgtgcattgtcaatgagcagtaatattttgaaaggcatcttttctaagcaataggtcttaacagtggacttaaaatttcagtaaaccatgctgtaaacagatgtgctgtcatccagaccttgttgttccccttatagcacataggcagagtagattaaacataattcttacaggccctagaatttttagtatggtaaatgtgcattgacttcaacttaaagtcaccagctgcattagccccaaacaagagagtcagactgtcctttgaagctttgtttccatgcattgacttctctctagctataaaagcctcagatcgcatcttcttccaatggaaagctattttgtctgcattaaaaatccgttgcttagtgtattagtccattttcatgctgctgataaagacgtacccaaggctgggcaatttataaagaaaaagaagtttaatggactcacagttccacgtggctggggaggcctaacaatcatagcagaaggtgaaaggcatatcttacatggctgcagggaagagagaaaatgagagacaagcaaaagaggtttccccttataaacccaccagatctcttgagacttattcactaccatgagaacagcacaggaaagacccatccacatgattcaattacctcccacgggtccctcccacaacacatgggaattgtggaagctacaattcaagatgagatttgagtggggcacagtcaaaccatatcacttagtgtggccaccttcatcaatgttcttagctagctcttctggataacttgctgtagcttctgcattagcacttgctgcttc

SEQ ID NO: 25458 - DNA, 1077 bp, Homo sapiens; identical to SEQ ID NO: 25457

SEQ ID NO: 25459 - DNA, 1013 bp, Homo sapiens
acaaatgtcaccgtcaatgtgttgcatcctggtattgtacggacaaatctggggaggcacatacacattccactgttggtcaaaccactcttcaatttggtgtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaagaggtacatgtgggtattttggagttactgaaaaattatttttgggataagagaatttcagcaaagatgttttaaatatatatagtaagtataatgaataataagtacaatgaaaaatacaattatattgtaaaattataactgggcaagcatggatgacatattaatatttgtcagaattaagtgactcaaagtgctatcgagaggtttttcaagtatctttgagtttcatggccaaagtgttaactagttttactacaatgtttggtgtttgtgtggaaattatctgcctggtgtgtgcacacaagtcttacttggaataaatttactggtacaaattcttaactgtgcatttctttggaggcttcactgaatacagtcctttatcatgtcaccattagcctatgctgatcttggtctgcccagtctcttcttgccacgtatcttgtacactgctctgagagataatattcctaaaacccaaatctatcacattcctgcttaaaaaacagtgggttttgagccttaaaaaaaaaaaaatttggcagaattctttcttcaaaagcggtgtttcactgaaacgtagaagc

SEQ ID NO: 25460 - DNA, 1059 bp, Homo sapiens
aattagatgtggtgacatgcgaaaagcacaaagcctggctcctatcaagcttctgcatctatttttttttctatttttctctcaattattggaagctcatagaagcattttgggatagaattttagtagtttgcaagtatttttaaacattttatcataggtacacttataattttgatatgatctcagtattaacctgataactcccaaattgatattttcctagttcaactgaaattaaagggagaaatatgggattgtaggagtgccttgtcctcaaattgactgtatttctgttttgagaaagatcttggtactgatcacgtagtcaactttctaatgcaatgttaaagtttatatatttgtaaatgttattgttataaaagcataaaaccagaaattaagtcttagatttagtttctacatcttttattggaagatgactgtagataaatatctttctgtatatcattttaataaatgagaaaaaagagctgttgaatgaaagatcatgaacatcagtatttatctgaggaacatcctgcggaggaatccctttccccatttattaaacacaaaattgccagtgtttcaagtagttctctgatcgatagaccaacaactgaaattaaatgcttttagtctcaagtgcccatttttattaaaatgtaattatcatgaacagaaaaagcaatacaaggcgtgtgttcttaataattctgccattctctttttgacatttaaaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccggagcaaactggctaacattctttttaccagggaactagcccgccgcttag

SEQ ID NO: 25461 - DNA, 1059 bp, Homo sapiens
ggctgcggaactcccgtggaggggccggtgggccctcgggcctgacgatggcagtggccactgcggcggcagtactggccgctctgggcggggcgctgtggctggcggcccgccggttcgtggggcccagggtccagcggctgcgcagaggcggggaccccggcctcatgcacgggaagactgtgctgatcaccggggcgaacagcggcctgggccgcgccacggccgccgagctactgcgcctgggagcgcgggtgatcatgggctgccgggaccgcgcgcgcgccgaggaggcggcgggtcagctccgccgcgagctccgccaggccgcggagtgcggcccagagcctggcgtcagcggggtgggcgagctcatagtccgggagctggacctcgcctcgctgcgctcggtgcgcgccttctgccaggaaatgctccaggtgtgggcctcggggggccgggctggtggggagggcctgggcacggtgtgggaggggactgcgggctggggctgagccgcgagggaccgccctggggttcagggtgtcaccttgggaaccgctgaggctgagaggagtccaaaaagccactttgaggcggccgggaagctgcagggttgagagggaaagagaaactaactgggagggctgccttctgtcctctaaggatgtcgaaaaagaaatgggcccaagagaaaaataaataaaccagtttctgaacgtttcatttcgttacgtgaggaccgccccgaagtagatccatggcctctgaattgtttttcctgtgtcagaagtgaatttgcaccaagctgtgtcttcagaacccctgagcactgggggaagttgctagctaaggacctcatatcagtcctttaaaaaaagttctccttcccccggcctctgccccttttctgctggggtaaggagctcgctgccaccagtaaactcagcaccatccttaacgggactgtggcctgatttccaagtagaatacattttggaacccagtggtcatgctccatacagagacaggaataaaaataacacccagcattattga

SEQ ID NO: 25462 - DNA, 1049 bp, Homo sapiens
ctgagcaatggcgggtgcccctcccccagccttgctgccgccttgcagtttgatctcagactgctgtgctagcaatcatcgagactccgtgggcgtaggaccctccgagccaggtgcgggttataatctcgtggtgcaccgttttttaagcccgtcggaaaagcgcagtattcgggtgggagtgaccggattttccaggtgcgtccgtcacccctttctttgactcggaaagggaacttcctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacccgtcttctgcgttgctgacgctgggagctgtagaccggagctgttcctattcggccatcttggctcctcccctgcacttttcaaataaggtaacattggaggaaacacagagttcatgactctatgccatgcactgtgctaggtggtttctcatgcactttctctctttctctctctctcttttttttttttttttgcttttggctttaactaagtggaataaacaaaacaaagaatccattagagagcacttgtgagatgggacaggaaaagtttgcttttataagggaagaggtaaagggaagtatttgccaccagggcagggatttatttactctgctagtggttctcagattacacccaaggggtctgatgcctttgcaaggccctgcaggattctgtgtacatgggtgggacccttggcactttgaacagagccagggggatgatttctataaatgtttagggcactctcatttgtgaaagaagaaacaacatgagaaggcataatctctgtcaagtcataagctcgcaggctggctaggaagaaaaggaatgatatgtaaaagattaagggtattagacagcatatggctgtgcgtggcacaaacattcagggcccaggagaattggtagtttctacaagctgggggtccaggaagcc

SEQ ID NO: 25463 - DNA, 1041 bp, Homo sapiens
taccacccaactcttctcattaaaaatgacagagataatgagactctaatgaatcactctctaagcatcaaagtcacagtaatcaattataactctatgtcactaggacaatgatctctgtgaattggtgatctttacgtaagcttgttaagagatccattaggagggagcgtgtactctctccctcctttgatatattatcccagcaagaagcaacttgtgttaactcacgatgctttaagctgggagtcacagattggcaatggggagcaaagcgaacctctaggattcaacaactgcctgggagaagatattagacaaagtggaaaggcattttctccctccacactgtgggaaaagctgagatgtttgctgcttcactttctttctctccccgaagaatctactcttgcatctcatcctggctcatctcttacaagggatgagacagacctggtagcagtgttggggtggacgctgagtcagctagctaggatggtggtaagtagcctagagcagatgaaagattatgatcctggtcaaagaagagatcccagtggggttggatttaggaggtaagttctctaggactcagacaagtgaatggggtcagtcagctattttgattttggaagtgataagagaacacaggactttgatctagaacagggaagaggtgtccagaacttccattagtgaagtggtgctcttacagtgtaatgtgtgtgtcagttggaaatgcagaaatcacccatcttctgtgttgagcaggctgggagctgcagactggagctgttcctattcggccatcttggaacgccctggaaggtaatgtgtgtgtcaaggcacagggttggggttgacaccgccaagcagcagcaccttggtgtgcactcctttctgctgggtctgctgtagagtgtggcatgggtactaccgtctccccttctctggaagacctcaatgcgtacttttgggaggaaggtactgtagggtatttctgcagcaatctgcactcagaggaatccccagagtgatcac

SEQ ID NO: 25464 - DNA, 1030 bp, Homo sapiens
tagccatctgtgttttaacaaggcccctggggagtctgaggcacactcaagtttaagaactacttccagttcatctggcccagcatctaattccagggtgcttttccatttcctgtgttcctctccctcttcaagatgtggaccctgaaggcaggagccatgttggttgtctgtctggcactcagaccagtttcaacagggtgattgacgtcccagggcaactgatctgttttccttacccctccctgccctatacaagcacaagggagtctggggagaaggacagtggaggaaagggccgatggaagatgaccttcttgttttcccgagtcaagggtttgaggtttttgtgggaggttggggtgcattatgctgcttctctcaaattggagaccattgttaccatgtaattttatgttgtggcctgacttgatccagaattctgtctccaatagttttacgtgggttttctccctggaaaaagttattacgattgagcaaataaagcaatgttggctaactgttcccttttctggatcgacatgtccttcatctgggtaagtggcagtggccagctcctctggcttgcaggaccagcaaggaagattttcagacgtgactaatgtataggctccttggacttcctactcatgaactctcataaaatgtgctttgttccatcattgtcaattaacacagcagcgagcagtgctgggctggggagcagccgggcctcgcctttagtgcacttcctccttggctggctgtgagctttcagatagccagacataattccttttgagctgcttaatggacacataattttaatcagtcataggacacttgagcgggaaggaactggagaaatcatctactcctttattttacaggtaaaggttccggcttaaaggttatgcagttggttaacagaattatgaccagatctagcccttccggttctcagtttaataatagtgacttccagttagtgaagcatgccccggtgtacacttattttcattaatcctga

SEQ ID NO: 25465 - DNA, 1024 bp, Homo sapiens
tcaagtctttttaagtctcttctccaccttcccctctttatttgttgaggaaaccgattcttgtgtcctttgaatttccgtgttttggacttgctgactgaatctcttctgtcgtttaatgtggtcatctgtctcatattgctgtgaattggtggttaaaccttgaggtttgatccaattgaattcagattcaatatcatggcaagaatactttttaggtgggtgtgtgtactttcaccaggaagcacataacgattcgctgactttctctttgtgatgtgagcggcttcacctgttactgtctgcttgcccaaagcatcttttcggcttgtgcctggatgtgtagcatttgtttttactccaagtcttgcctcgactgggcttgttgatggtatggagtggatcaggatgagaaaagaacagaggggttggttgaacagctttttgaatagttgtgagttgtctgttgtggatttgagttttctggacaggatgccagcttgtcttttgtatgaggcttaactaaacactaaggacttgattcttaccctgtttgttacgctacatggaattaaaccagaaagaaaattgccttctcatttcaataacacacaagaataataatagaagtttctgaacaggcaataagatgataccatctactttcctcagtgcacctcccccataaaaaagataagtaaacatagaaagcgaaactattcatgtttcaagctctaagagtagacttacctagtagattttaaaaagtatttatcagcatcaggtatgctgttgctgtctagtcttgttattcttccttctttgcacctctcagcctaagaacacaagtgtctgtagcatatataatagctatgccttaccagcacaggaaagacagtttgtcatagcgcagtagaagggagttcatcatgcctgaattccagtcttggcactgccacatggctaatgtctcagcctcagtttttcatctgtaaaataagcttttgataaaattctaggaact

SEQ ID NO: 25466 - DNA, 1016 bp, Homo sapiens
agatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaagggtaggctaattttaattagtggatgccattctatcttattagaagcttggatttctagatgtacaatgtttaatgtaggaattaaagcactgaattttgaagcaattcacattaacattataccctattttatttatttttacaagtgtattcatgctttattttgtcattgtaagaaaggttttttcttgaaataacttttttaaatgaaagtatttgatgttcatctcagaagttttattctttaggttttttttaagtgtattaaataaagttagactaatgagaagttttaaagtataatgaattgtttctccccgttttacagtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttctctcaccctctctcttttgtttatcttgtttttggttacatgataccatggaaatattccaaataaatttttttctcacagtgtcaaggtaactgaattcattaaaa

SEQ ID NO: 25467 - DNA, 1044 bp, Homo sapiens
atgtggtctctgtcggcccctacatgggtcccagggacccactgggaggtgtttcctagtcaggatacatgggggtcagggacacacttgaggaggcagtctgtcccttatcagagcttgaacactgtgctggttgatccgctgctgtcttcagagctgccaggtagggacgtttaagtctgttggagctgcgcccataaccacccctttccccaggtgctttgtcccagggaggtggaagttttatctataagtccctgactggggctgctggctttttttcagaggtgtcctgcccagagaggaggtagtctggctgcaggggccttgctgagctggggtgggctccgcccagtttcaacttcccagcggctttgtttacactgtgagggtgaaaccgcctactcaagcctcagcaatggtggatgcctcttcccccaccaagctcaagcatcccaggttagctcaaactgctgtgctaaccatgagactttcaagccagtggatcttgagcttactgggctccatgggggtgggacctgctgagccagaccccttggctccctggcttcagccccctttccaggggagtgaatggttctgtcttgctggtgttccaggcgccactggggtatgaagaaaaactcctgcagctagcttggtgtcagctcaaacggccgcccagttttgtgctggaaacccagggccccggtggcgtgggcagcgaaaggaatctcctggtctgcaggttgtgaagactgtgttaaaagtgcagtatctgggccggagtgcacggtacagtccctaatggcttcccttggctaggagagggatttccccatccccttgcatttcccaggtgaggtgacgccccaccctgctttggctcatcctccttgggctgcacccactgtccaactagtcccaatgagatgaacctggtacctcagttggaaatgcggaaatcacccaccttctgcgtcaatcttgctgggagctgcagaccagagctgttcctattcgtccatcttgccagccaaggcc

SEQ ID NO: 25468 - DNA, 1022 bp, Homo sapiens
aataagcagaaaattatttgaaaaatgtttgcatatgttactttccaccatgtttctctagaaataatagacataaatgataattgaattgtgattcaagactagtttgtcagtaatttgcaatatgcacttatgtttttgtttcttttaaaataaaggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaaggtaagttatgaaggcgcaggcatccctgagtactctatcagttcatcattgtattttttacaaatggaaactataaatacgttaggtgtatcatatggttccttttagaaattaattttaagtttggattacaacctagatattctacatgcctctcattcatttgtgtttcatagtctggaggcagttttcttctctgtttttacatctaataatggctgactctgggaggtttttttttcatttgatgggaaaaaatgatagaacaacagagactgggatcttttatatttaagacatagctcattattccagttctttctttctttgtttgtttaggccattatttaattttatgttgtcaagaggcataaaataaaaatcagaagtcgttagggatcgagattagttctttatatttcgtttttgatttatataaaataatgtatgaacttcataaatatttcttcttttgaattaaagaactgtaaggcctgtctccctggccaggaatcaaacccaggcagctgctatgaaagcagataatcttagccactgaaccacaaggcggagagtctgtctgaacttcatttcagctgttaagattgtatctcatcttcattaatgttatttatactcccaggagatctctaatatgac

SEQ ID NO: 25469 - DNA, 1025 bp, Homo sapiens
actgtagaaatgtctatttgtatccgttgctcacttttaaattgggctatttgtctttattattgagttgtaagagttctttatattttctagataaaatttcttttcagatacacgatttgcaaatattttctcccattctatgggttgtctttactttcttgatagtgtcctttgaagcccaaatgtttttaattttaatgaagtctaatttatctaatttttcttttgtcatttgtgtttttggtgtcatatctaagaagccaattattgcctgaccaaaggtcataaaggtgtattcccaagttttctttaagtgtttatggttttagcatttgagtctctgatttattttgagttagtatcgttgtatgatgctacaagcttttgattcttttctgatttcagagactgtgtatgggtattttgagactatgtgggggtatattgtctataaaatgaggggttgaactccgtgattactaaaggcctttgcagcacaagcattctgcaattctgtgtaactgtaaattatcttaatgttatttttaacagtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaaggtatatcttttgatacatactttttagtagctcaaccatatcacattgaagtcagacatagtaattgtaaattgtcatgcttgataactgtagtgtcttgattagtagaaatgttttttcaattaatttgattatctttaaaatttatgtgtttaaatttattaaaataaaagagaagtagaatggtttaataaagtccttagagataaagagtggaaagctgtgtttttataaggaaatggctgtcctcacttaccctccccaccagattagagttaatatgctatactaaaatatgattattcacttgagatcgaaggatcta

SEQ ID NO: 25470 - DNA, 1039 bp, Homo sapiens
tcccaatggccaaagctggagcactttgaataataaaataaatgatgtattattttattgtgacccaaagtataaatgcccaagagttgatgctgatatagatggattatttgaataaataaataaatgggagaggagaaacagatcttccttacagaattattccagtttacttaggtattgccttctccaggaggtggaacataggcccctgttcccctggcttgagtgtggctacacttagtttccaaagagtagagtatggagaggggaaaaaaagtagctttatattggtgaaacttgtcaatcacaccttggccaagtgataaaggttaacatcattaggaatgtcatgtggctatcacatgccccctgatatggcatgataaagaagtgcacttcggttctgtgctagtcttcctaaaaacctgaagtccaatctaagcatgaggaaaacatcagacaaacccaaattgagggacaatctacaaaatacttgaccagtactcctcaaaactgttgaggtcatgaaaagcaaggaaagactgagaaattgtcacaccccagaggagcctaaggagacatgactaaatctaagtatcccaaatgggattctggaatagtgaaaggacattctggaaaagataatgaaatctaaataaagtatgatgtttacttaatagtaatagtaatatagttaatagtgatgttgatttcctagttgtgacaaatgtaccatggtaaagtaaaatgttaacaataagggaaatggatgaggagtatatgggaactctgtgctatctttgcaacttttctgtccatctaaaactattttaaagtaaaaaaacttattttagaaagtaatcaggatacaaaaagctaaacatggtttagcttagtttgtttgaatggtaaacacaatcatgataatatcaacatgatattttatttcatttttatatttttaatataatttatgtatttttatttttttattcaaaattaaatataaacatgttgggagagttagaagggaaag

SEQ ID NO: 25471 - DNA, 1118 bp, Homo sapiens
caaaggattttaaaggagaattaaatctgatacaattttttttctctctttagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatacttagggttgtcattgtttttaatccgttacttttttttaagataaaccctgacattttccattacagtgtattcagagtgccagtgtttattttttttttaactttgagaatacagttggcccttcgtatccatgggttctgtatccatgggttctatatccatggagttaatcgactgtggattgaaaatatttggggggaaaaatggatagttggatctgtactgaacatgtacagactttttattcttgtcgttgttctctaaaaaatacactataacaatttatgtagcattcacattatattagatattataagtaatctagagatcattttaaaaatatgggaggatatgcatgggtcatatgcaaatactataccattttattataagggacttgagcaactgtggatttgggtatctggagggagaacct

SEQ ID NO: 25472 - DNA, 1050 bp, Homo sapiens
gcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggc

SEQ ID NO: 25473 - DNA, 1087 bp, Homo sapiens
ctggtacccctggaaaagcaggaccaggccctgcagcctgtgctgccttccaggcccagccttcgtccccggagcccacctgcctgtcagctccagcagctgtcttctgctcagccctgctgggtccagccgggccggctggtgggaagccagtgggctcagccccaggcacgaaggagcctcagcccagcttcaggtagacacttcccagtcatgtaggtgcttctggatgttcagtgggccttcagctcctgggggagggaggctgggctgccaccgtggtgtgctatctatgcgagtggacgtgtcggaaatgtagaggacattgctgagctttccctggtcctttggccactagagcttgttcacagggctctgttgctactcagtgccttgactttgaacactggactcaagtgaaacgagctcttgcctcctccaggctgggccactctgggggatgccttttcctcccctcattgttttcaaagtgcagtctgaagaccccctacaggacctggggcttgtgaatgacagagtcagcctctgggcggggaactcgaaagacttcatttgtagtggtctcctggtgattcttggggaccctgaagctgagagcccccagtctggatgcaggtgatggtttggttatcaccctcagccagtatggtgtcttgatgcagaggtgggggtaaaggctggggctctgcagctcagagatatcagcccccaagagtcctgaagtctaggggaggggagagtcagcctgttttccttgtatgtgtagatctgactgagaaaccaagggggtaaagaagatttctaaacaactgtgaccctgtttcaagcctcctgaggacatttgccattgtgtggaatctcgggatggggagggtgggtgtccagcctgccatgaccatgggccctcctgcctcatgacctcgcagcctgggcttctggaacaggtctgggtctctcctgtccactggccccagagccagtgccatggcccctggtccaggttgcttgtcaaaggtggtgacctagctcctttgataaggggcagctctttatccctggtttgttg

SEQ ID NO: 25474 - DNA, 1054 bp, Homo sapiens
ggctgtggcaggccattgcctctctgggcctcagtttcctcctctgccaaagggtcgttcttcctgtcctcagttctgagagccacatggttacagagagaccttatcctgggaagggcagaggtggcactgaaggacttgttgggggctcacatttctctgccagtattctttcttgggactcgaaggagagttggttgcccaaggggtcatcggtgggatgggcaaggccagtggagggcagggcaggctgcttgaggggtggattcgagctccttgtgggagctggagtggacagaggtgcctgggtgacgttgggccagggctggggctgtatgatgttctccgcacacacacccaagagtcctggcacctgcccgaggtccgctcagcagcaggaatgaaggctgtggcgggcaggttggggcagtggggaaggcgggcatgttgatcagtccactcatcagctgagtcatggtgccagggccacgggtcctcccctgagactcacccaaccaaccttgatccactgcaagccctctgggggccggcacgaggcagagagtgcagcaagacacagccggggctcaggggcctggctttctgtcttggccctgcctcctctctctcgagtgactgtgtacagaggcctctcttggtctcagtgaacccatctgtgacatagggggaaggggctgagaggcagaggtgaggcaatgcttttgggtgtgcatggcctcttgtggctgtgtcgtgtgactggtgggtatctgggggcctgcctgtgctctgctgcctcaagttctgagggcttcatgagacctatctggcttgaccagatctaaagcccagatcctgggtacctgctgtgtgcgtagccctgtgcagtggtgagagttccatatctggtccaggggattcctgtaagagagggtggctgttactggaaccagacgagagaggtggtctctgcagtgacaatgaacgggattcgcgattcagcacctgtcacgtctccccacaggaagggttttgtcccagagtcccacgatac

SEQ ID NO: 25475 - DNA, 1025 bp, Homo sapiens
gtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttg

SEQ ID NO: 25476 - DNA, 1050 bp, Homo sapiens
ctgggattacaggtgcacgccaccgcgcccagctaatttttttttgtatttttagtagaggtgggatttcaccatgttggtcaggctggtctagacattgttccaggcaccaggtagctagcatgtaaattaattttatggctcttggattggagatggggctggggattcaaataaataatgcataatatgctatgtaataggaagttcaatgaaaaaaagtaaagctaggacagtagggacagaaagtgaaagaggaatgttctaacccaatttactctccaggatttgactgttttactgctctctgtccttgtagtccttttcgacctttaatacctccgtatagctttgcactgacagtgtatccttgggaccatctctaccctgtggcctggattgtatatatagtactactctgcatagattttgcatataataatagcatgatgctggtagtggattttgtttttctgaactctactaatgtgtattttacaactatctatacatttttcttttttaaaaggacactgtcaagtacttttaaactgttaattgtaattttaaaaatttcctgcatgtatttatttttatttctattgactgctctttgattttctttcttggaacggaatgtaagttaaaaatgttttttatttattgtaaatgataaggctctaggaataataactgctgtttattaatactattgtttgtgaaatagtggatttatgtcaaatatatatatatatatatatatatatatattttttttttttttttttttttttttttttttgagacagagtgttgctgtgtcacccaggctggagtgcagtagtgtgatcttggttcactgcaacctccgcctcccaggttcaagcgattctcctgcctcagcctcctgagtagctgggattacaggtgcccgccaccacgcctggctaatttttgtatttttagtagagacagggtttcaccacgttggccaggctggtctcaaactcctgacctcgtgatccgccctcctcgaccatccaaagtgct

SEQ ID NO: 25477 - DNA, 1149 bp, Homo sapiens
ctcacctctgtaatctcagcacttttggaggctgaggtgggcagatcacttgaggtcaggagtttgagaccagcctagccaacatggtgaaaccccgtctctactaaaaaaaaatacaaacttagccgggcatggtggtacgcacctgtaatcccagctactcgggaggctgaggcaggagaatcacttgaacccaggaaggggagattgcagtgagccaagattgcatcactgcactccagcctgggtgacagagtgagacctgtctcaaaaaaaaaaaaaaagttacaggcatgatgtcccttactcaaaagtacattagtgtatgtttcttgacagtaagtatatgttttcatataaccacaatttctgaagtcaggaaattaacactgataaaccactaatcaaagcagccaactttattccaactttgctacttatcacactgattacctttataagaaagagaaagggagattgacaatgggggcccattgtcaaattgaggatcacggattactttcatcactgctcttttctttaatctcgaactgtttctgttttttatgaccttgacatttttaaagggtataggcctgtttcatagaatgtctcaatctccagatattttagatgacctgctttcaatatttagacaacaaaatttaaaatgtctaatgtatgttaaaaattgggttttacacacttatttgtgagagaaaaggtatgcttccctgggtgaaattaattggtgatagttcgtcctttcagtgaattagtttctggagaatatttttttctttttctctttttttttttttggtgggggggttgttgttgttgttgttttgttttgtttcgtttttgagacaaggtcttgctctgttgtccaggctggagtgcagtggcacaatctcatctcattgcaacctctgcctcccaggctcaagcgatcctcgcaacctcaccctccccaagtagctgggactacaggcacacaccaccactcctggctaatttttgtattttttgtagagatggggttttgccatgttgcccaagctggtctcagactcatgacctcgagctatgtgccttcctcagcctcccaaaaatgctgggattataggcgtgagccaccgcgcctgg

SEQ ID NO: 25478 - DNA, 1036 bp, Homo sapiens
tttccattatgctattctataggaactgaacaattttacaaagtatataaataacttattctaattagcctctcagaatctaatgattacctcattatggtataagttatgcttttctttggttaaagtatgtataggattaccagctttttaggttcctttctcagtttagttattcttgagatttagataaaaatacttgtctaagcacatatgttatatttgtacttcttatttgtaataagaatacttgttaatctaaggcaggcaatttagggactgtgtatagagcagcacacccgactctcaacagaatcttacttacaggttctcatgttaatataaattgaaaaacagctacaaccctctggtagacctagaagtaatttatttgctgatgagtaggaaataatgttttgaagaaattacgttactagttgtatggaagaatttgtgatgtttggttttctgtataaaaatgtcttgatcttggttgtacttgttttagattactaattttttatttattatcctttaataacattatcagtgacattgtggttctaatgtctgagaaagttttcaccagttaatttacttagttaagataatcacaaactgaagactagaaaatacttgatcccatcctgtgttttggcatcagaatcactctggccacttgtttaaaatgcctcgtagtagacttcacaaggatgtgaacagtttgcaaatgtgcggcaacagggtttgctcgttacaatgattgtggggattctattggcattaaatgcctggtagccagatgttatactttgcatagtcagcacaaaaatagtttcgtcccactgaaattttcagtagcctccacatgaaaacactgacttgaaataatttgtagctggcagagattattttaatctaccaagaattcacctgtaatttacaccatcccaccatgcttataaggtaccctaaggatcaaaaggtagcctttaaaatacaggcagatgtgcttcatgagagatttgcagtgtta

SEQ ID NO: 25479 - DNA, 1046 bp, Homo sapiens
ttttaggattaatagtttataccctgaaatgcagagaacagtgtaaaattctgggcttcaggttcaatattaaatattgagttattttctcatgttgtattaatctataggaggggggcaatctacctacagttgttttatacatcattgtctaggatagaagtaagcatctttttttttttttttttggagatacttcacttgttgtgaagaacattaaatatttctagtattgccttatttttctacctggagctagctgactagttctttccttgttttccttcttctaataaactttttaaatatagtgttgataattttttttaactccagtctttgtgctcatagtaatttgattgatgtggaacttactaggtataaagcagtgttcgtatttttgttatttaacttaggttttgacaaactaacggcttcttgccctgtacctcttcatttttgaactagctatttttttcttaacaaaaagggtgctaaagtgtaatgtgggctttgaacccagtaaaatttattgaaaggggactatgaagtctgaagaatgtcatgtattcagcaggtaaacagctgtgctttagtttgctgtggattataaaatttcctaacctgtcttccagttacagaaaattttaataataggcaagatattataaatttttagaatcattctgtttaaattgctggcctttggcagacttagtcttgtgcttctcttatgataaaatattcagagaagtaaaattagtactgcaaagttgatagtaaggccacctgccatttttctgagtttcacatacagtcattaatgaaagcagaaaacaatatgaattattcgaagcattcactgaaaatactgttatcctttagcagttacagttctctgtaactgaatagcattcgatagttttttttcttaaagcaccttcatattcatatttcatttcatcctaattgttggcatagactgtcagagtggtttgttgattaaagatgaagaaattaaagatcagttgattaatagactttcc

SEQ ID NO: 25480 - DNA, 2375 bp, Homo sapiens
aaccctttttatttgtatgtatacatgtatgtgtgtttgtgtgtgtgtttataatatatgtaaaatatttaatgttggttaaaacatgccaaattgcttttgcttttagatattagtcttttgaaaaagttctactttcctgaaaattcaaagtgagggtctaatgtacaataaggtaaagacccccctattgtttcttatgttttttttatgaaatataatggtgtgttttttcttgtctgtgcttttgatttgtgtgttttagagcatctgaaaagtcaactatataaacataatagtgaaagagaaatttcactatcaaaagatttgcacaccataagaaaaacattagttacatagctactgaactaggttagtacactggtttttgctttggtctttctatgcctggccattttaccagataattatttcagtgaatttgaatttagtgtatttgtcacttaaggaagcttataggcttgggccatatacttcttttttggatatgttaaagaaaaaaaatgttttaggcttgttgtacccctgaagttggagcattgagaactttgtttatatttgtatattaaaattgttcccacccccaaattattaaattggtgattaccttttttccctctccaggaagtatttatccatgtagataatacgttttgaagggctttggatatcaggggctgtgtatgaatccctatcttgtcaaagaaattatttttttaaaactttattttgaatttttataattctagttattcagctgaaactgagggattctattgccagcttttatgtaattggaaagatttaaatcagcttgtgttttaaaaagtaatgttgctactgtaagcagatgtactgtaagttagtgattatgtttgaccaccccctccaattacatgggtatagctatttaaaagaaaaaaacaaaaacaagcaaaaaaacttactaatacaataaatgtccatgtaacaaaggtatctgttgcagtgttcattttgatttacattattgcacacacactgggctagatttcttttttaaagactctggtcttccaccccaaattctgggcctttgctcatttggggtattgatactgaacatatacagccaattaatgtattcaaatggagccctaagatccactttgcagtactagatgtgtagatttacctatctttagcctaatacctttcttcatttatcatgtattcttagtcgcaggagctgctcagctcctgatttctgttattactgcccaggcatcctcccttcataagacatgcctatgaaatggacacaaaaatttggaacacaacaaatctaagacttatcataatagttttttgttttattgttaagattttgtcatgtcctgtcatcttttcataggtaagtttcagatcagattcttgttcagctcttaactgctgtgttgtgctttagtgcctgtataaatggcagtaaataggttctacacagcttgcttagaaatcggatataaatgactttttagatgtctctatgattgaacagcaatctagatatgtgcttctctacctttctttaggttgtaaagaaagcagcctaatagatgcttagggaaggaattctggtcagttgtgggaaataatcaccactgggccagcattctgcattatagactaacatagcttcagcttgaaatctgatattttaatacacctctgattggaattagcaattacctgtgttattttctttttgtgacccccagtttcccatagttttagtggtggtatgactggcaacattgttaacaacaaatagacccatgccagactgaaaataacttgaaggatttcataaattttctttttgcatactattcatggaaataatctactctgcacttccctatgaatggatcatgatgcaaggctgtccaaaaaaaagaaaaatatttctttatgaatcaagtctcaaggctgatagtataaaagacttatggaaatggaatttgcatatttttaaagtaattttactgagctcacatatcaagaatatgaaatcatgagatagagataagttctctcaattctcattagaattggttggaattaattccagattatttttctgggagattttattttaagatgtgaatgttacaaccattacagttacctgtaaggcttgagatctgcatccccaaagtatgttcctttgttagtgttagttatttgagattcacagaaaatgcccagtagcaacagtctgtgctgtctttcaaaaaaaaaaaaaaaagttttcattttttaagataggcttataaccaacacatgtatttttagcaggatgactagtaatcact

SEQ ID NO: 25481 - DNA, 1028 bp, Homo sapiens
gcttgacttttcctttttggaggaaaataatattgcatgtgtcaaaactggtttcttggattatttgtcaggggaataatgctgctcttattagagctgttgtcttttcattgtcagttaaattgttttctgaaataaataggaatttaaaatgtagccatattttagaaaaatcactttgacagtgtccttttaaattagcatagttaatgtagcatacattgccagttttaccaaaaccaactcaagaataactgtttattacatgtgcttataattcacttttgcaataaaaatgcatatagacacctagtattttcttactatgatatcttaaaatgtaaaatcttcaacaaaacatgatcagtctcagaaactgcattggctggtataaaaggttgaatagcattataatcttttgcctaatgtggtagcataagcctggtttttttacccctttatagaattttgaatttggcaaaaccaacgtaattaagttttccgtctgtattatactcttaccttggtctacccatgatgtactctccttaatttttttctttataccctgtatgacctatttatatatgacttgtgcttaaataagatttaatagaaacttagatcccttgaaaagcattgccatattggtccgaatatagagcttgtcatttaaaaatgtatttggcaggttcagaaatgtggtttgaaattttcttagatgtaaaagttattcagttaaaagaggctagtgcttagaaataggaaggaaacgtacttgaatatatgggctttaagtgagacttgagaactgagagtttggacagcccttagagatgcatgctgtggaatttgattatccagacaggtgttgattaacagccagatcttgattagctcttctgagcatgtatagctcaccagggcctacatgacctttattttctgcactataaaaggaaaaaggattagaaggataatagttacatttgatattaagtaaaaatttggtatgcattgtattaagg

SEQ ID NO: 25482 - DNA, 1033 bp, Homo sapiens
ttgttttatttttacaatgtaccctttttttggtaaactctattcggtgttttaatagtcctcatttcaggttcagcttacctggctatctgtagaaataaaagctttttattttagtgattcagtcaaatatactgggcttttttcccctttgaatgcaacgtgaaaccgagagtttgacttttaaaaatacattaatacaaataaagatgtcctaaaattccactgataacattttaggacatgtttgttatgtaagtcaggaatcatgacattttattcattactttaatggtgaagcttattgtgcataaaactatttactttctaggaatcaaatattatcttgaataaagtagactagagcaggaacaatttattcttattttcctagtttcccttctatttttctttctgcttatattatctagtgctttcttgtcttgactcagtttcattttcctaaccacataaatgctgacgtctcatttgttttcttataatttgcagttgttctgtgagaatcgtgactgaaatatgaaaaatattttaaaatttaaggttttcaactcaaataccattgtagcatgcttggtaccagaatgttccccagttttgtgttatagattggaaagtaaaatattttaaaagtatcttgtaatccatctcagtagtcaaaattctctgagagaaacgatgaatgagcatttaaaaaatcttagttttatggaatctgtgttccctgaatatattatctgtatagtgtcagacccaaaaattggcattcattaaatgttgaatagatggttaagtgtcctatcagtttattggtagccttgaggttggattccttgaggatggattctcatcttttccctttaagaccattgctgtcacccatcaatactttgtcttttattataaagacatgttcttctctaagtcttcttcctgcccccttttataatctgatgataggtagctaacctcatgtctatgtaaaatctagtaactttttattcgggggtcgggt

SEQ ID NO: 25483 - DNA, 1026 bp, Homo sapiens
aggattggctgcagcagctacattagcaggtaacatactatttgttcatctttattatggttgctttttaatgtatttagttttgggtgtaagctttatttttctctatttgggcaatttgaaattcctaagaaaaactgaaacattatccagaatgaactaaagtttccaggaagttagtactatttttcaactgtaatgctacagggaaaagcttaagcaataacttttcctcgtatacgtaattggcttacatttcagctttatagttttagaaatctatatagtcaaccatgaatctccattttaatgacaaaccccattacccgcagagacaatgcaaagtaaaattacttctcagaaaataaaatagaggtaggtggcctgcatacataggtcaggggtagaatagagtaagataaacagatacagtaattctgagaaaatatgtatctaaaatttcttgagcaatgctaaaatgtacaaacaaggtgggggacaaaaagtttggatcaagttggaaagaacgtactaaaaactgcccagcctgagactaccacccagaatctgaaataaaagccaaagctggccaggtgcagtggctcacacctgtaatcctagctctttgggatgccgaagcgcctggcctgggtgacagagtgagactgtctaaaaatgaaaacaacaacaaaaaagctgtatttattgtctgtgtaagtaaggaaaagttgtgtgctgatcaggcacagtcttatttgaacaaagcgatttgctgatcttagttggggttcttgggaagagtttgttttaggttgaggtggctacaaagacagaaatgagttagtctgaggcattgtttatattgattatacaggcaagaataggttgatatctgccttagaattttgtttattggaatgagtctgctaatgggctgactttcaaaacttgaggctgtccctgttgtttttgggggggctgggggggctttgagcgatatcttgactgaaatattgtcactaatca

SEQ ID NO: 25484 - DNA, 1040 bp, Homo sapiens
ctctactctcatgccatgacaacacagactacttctgtgaccaaatgtgtgggcggttttctccacacaccaagcaggagacaccagctgggtgtcctctaattcagttccaacactgtctacccagagacaatgtcggatcccagaagttgaggcctcagtctccaggactgctttccacccccaacacacactgatcacaagtctgggcctccagaacttctgaccgactggcttcaagttggagttcccacaagcccctctttgggtttgatttgctggagtgcctcatagaacacttacttttactggtttattatgaaagatactgttaaggatacaggtgtgcagagctgctgggtagggtgaggcatggaggaaggggtgcggagcttccatgccctccctgggtgtgccacccttcaggaacctgaattttgattttaaggcctagtaagatatattttccttttgaatgctttttaaaaatattactattatcattattgttgttattgttattattctgagacggagtctcgccctcttgcccaggctggagtgcagtggcgttatctcggctcactccaacctcagtctcctgagtagctgggattaccagcgtttgccaccactcccagctaatttttttgtatttttagcagagacagggtttcaccatgttggccaggctggtcttgaactcctgacctcaggtattccacctgcctcggcctcccaaagtgctgggattacaagcatgagccaccacgcccggcctattattttttatttatttttgagacagggtctcgtgaagtaattttttccagtagctgtggttgaaagacctgtacagtgattcctcaacatctgagagtttcttctctctttaatgagtactgcaaatgtatatttttaggtctttttcagcctttactaaattcatatggacgtatgttactcagaagtgagtgtaactggcctttaagctctttcttgtttccgtattgactggagggtaaaatccaaactactta

SEQ ID NO: 25485 - DNA, 1013 bp, Homo sapiens
tggtgaaaccccgtctctacaaaattacaaaaattagctgggcttagcagtgggggtctgtaatcccgtctacttgggtgtctgaggcagagaatcgcttgaacctgggagacggaggctgcagtgaagcaagattgcaccactgcactccagcctgggtgacagagagagactccgctcaagaaaaaaaaaaaaaaaaaaaagtccacatttataggtgagtgccagtcgcagcatgtactctggccccgtttctttcctctttttgcctctctttccttttttccccacccgctttatcccttgtttgtcctcttatgttagaaatgtactgctacctgtctattcatggacagcacaacggtttttatttctcgaggctttatattattaggcaggctaatacatctattactcttcttttttggggttttaagtttttggttcttgcttatttgcttttttgtatgaacttcaaaattagcttatctacttccagaagataggattaaatgttgtaatttacttagggaaatttgacatctttatgccatcaagcatcaggttttttttgttgttattgtttttgttgttgtttctttgacaaggaggtcttgttgtttgacccaggctggagtgcagtggtgcagtcttggctcactgcaactgctgcctcccaggctcaagtgatcctctcgccgcagcctcccgagtagctgggaccacaggtgcacgccaccacacctggcaaattttttgtagagacagggtttcaccatgttgcccaggctggtcctgagctcaagtgatccacccacctcggccttccaaagtgctgggattacaggcgtgagccaccgtgccctgctgacatcaagtattcttgtccagggtgtgatgtgtctttatttttgttcaagtttactgtagtgtcatttgagtgctttaaaatttttctcataggggtttgcatatttcattctaagtttattttatgtattttatgttttgtt

SEQ ID NO: 25486 - DNA, 1023 bp, Homo sapiens
tttagatttacttttgtcatgtgaatgagaaaaagcattgctaaacaaaaaaagtttgttggcagatttgcaataaagtgatttaatttgctgagcagaagaaagtattctttaggaattcagcacttgtttgtttgccgtagataccacggatgttcaatgattatgttcattaaaatcagtccagctgggtgcagtggctcacacctttaatcctagcactttgaggggctgaggcaggagggctgcttgagcccaggagtttgagaccagcctaggcaacatagggagacccctgtctctacaaaaaatacaaaaatttgctgggggtggtggcatgcacctttagtcccagatactcccggagactgaggtgagaggatgcagagagctatgattgccccactgtactctagcttcggtgatagagtgagaccttgtctcaaaaaaaaacaaaacagtccaaggaggatgattacggagaatatgtcctaagaagcttaagtcactctgtgtattgacttatttgtgactcaactaggtttttatgtaattttgttgtctttgtaattgatgcaaaaggaaggtacagtctccaggctgtagatgacagacttggagaagtagtgcctgtgtgaagttgcaatcattagtcattttgtgttggtaaatgtcttcagcagtacaaaaagtctaagcgaaagccttgttcattgtccttatgttaaaataagcattgtatgttaatatatgaagatatgtaaatacttagtcactatccagatactaattgattttatgatcggaattcacatttcataaaatatggtttttttcattcattaaatgttgaacgtttacatagctaagacagtcactaatccctttgaccccagaggttaatttctactatggtgttaatttataattacaagattataaaagtgtgattagtaccatgtggcagtagagtgctttaataccatttattgtatctccaaatgctttccccaccctgttttt

SEQ ID NO: 25487 - DNA, 1378 bp, Homo sapiens
aagtaacacaataacttttgtactttgatagtttccaaactgtaatgcagttaagctatatttatataggacattaagaaatttattttgctaacctcagtaagtcttacaatatgaagaaatacaaagataaagccaacagtaccttctttaccaaagttgagtgagatgtttattttttcgtacttcccacaaacatatgtagtcatacattgcccccctccttttttgaacaaaaattggatcatatgatacacattaggcaactttgtatttttacttaatatcatggacattttacatgtaactttaattacttgtaatttttgtactggctcattgttttaacttttttctgttgttgagtttggcttatttttttaattttgtaccaccatataagtggtgctgcagtaaatatctttatatagttaattcatttgtgttggtgctgtttgtttaaggtaaatttccaaaagagaaacttctgggtcaaaatattttctttttttgcggggcagggagaggggggctgtgcagagcgcaggtaagagctgtggcccctgctatgttgcctacgctggtcttgaactcctggactcaagtaatcctcctgccttggccaaccaaagtgttgggattataggcatgagccactgtgcccagtccaaagaattttatattgatttttaaacaaataaacaaaaagttcagtttgatgtgtcattaatactctagaaagcacttgcatttcaatttcatttattacctcacttaatctttgcaacagccctatgagggaggcattgttgtttccatttgcaaatggacaaatgagatcgagttcatttagctagttagtggccaacctggaactgtattcttggtcttttgattctgatttctgttacaccatgatgactgatactaacaaaattttttagttgggaaacttctagggtgtttgtggatatattccttagccatatggtgatgtatgagtgtttcaaccctatctgcagagggaaagcatcacctggagagcctaaaaaatactaataaaaatccgcctgtcttgctgcccagactaattcaagccagccttgggtaggtgaaacctgagcaactgtagtttataaaatcctcctacctggactctgatgtgtgttgtaagtgtttgagaactagtgatctcaaaattggggtgctcccatccctgaggggtacctgaagagtttccagactacatctgttagtgcatttaagtcttctgggaatcagttatcaggtcctcaccatatatgtactgagaaaggtagaactctgatccatcccacatcttactgttgtgtattttacccaggtagttaaactttgg

SEQ ID NO: 25488 - DNA, 1022 bp, Homo sapiens
tttacaggtctagctattttgagttataattgccagtaacttacgcattttccagcaatttaagctgtgtttaacacatgctttccttaatttgagtccaaagttctcttaggtgtttcagcatttagcaagatttcaactttttaaaagagcctaaattaattactgacatttactttgctcttacaaagctgtcactttagaataaattctcaggcattacaaatactgtatataaattaccaaataatacttggattttgtttctctcaagcattccatacttgtttatgaatctttttttcttgtttgagacagggtctggttctgtcgcccagactgcagtgcaggtggtgagatctgggctcactgcagcctccgcgtcccgggctgcaactgttcttccacctgagccttccgagtaactgtagctgggggtacaggcgcacgccaccacgcccggctaatttttgcattttttgtagagacagggtctcactgtgtttcctgggctgaactccgatctcaagcgatcctcccgcctcgccctcccagagtgccgggattacaggcgtgagccaccacacccggcttgtttataaacctttctggtgtggaaagataatttgccttccggagtaggtacttatcttagttaacaaaagtaattatgaccagagatttgggccaggtgtgaaatccacagccaattttctcagtgaccaagctgtctcctttttatagaccctaacatgatctgcatagttttaagtggaggttgattcctgtctcctaaactcaagttctacatacgtcctaacttaaataccttgttgggtttccaggatatggaaatacttgtattttttcatattcttaaaatttacagatatttaaaatatccgaatatttgagtctcacatggctttgtctacatggctgcaatcacagcttgagaccattttactaacaggtgtgattaagataaaaattacacttatagccaggtaaattggtctgtg

SEQ ID NO: 25489 - DNA, 1028 bp, Homo sapiens
tttttatgtgtggcttttaaaattgttattattttaagatgttgctatgtcattgaaagtgagttttgttattagctaaatcataagatgcttctaatatttctttgttcttactataaatcctctattagtaatgcataaaagcatgcaactccaaatgtatactaaaacaaagctttgttcatgttcactccctcagggcagaatttgggttttcctgctttggggtcccgtagggctttgtccatacctctgtctgcctgttgtatttaagagccagtttatataggtctgttctctcgcctagtctgtgagctgttccagggcagagaccatcttacacacttctgaatgtcagccacttagcctagtaccagatatgggatggaatcagagtcatttttggtggaactcattttaatctatcagcttcagcaattcactgtccaacagtgctgtttgtagaccccccaaaaagtggggaaaaaaaaacacacagaagaaaagacagatgtggggacaagctgcagcaacctgcagggatattttaggagggccctgtccccttaggtgcacattaaacagttaaagggaagttcatctataagcccagagaccatagtaaccataaatccactttcctgcagaaaacacaggaggaaaagccaaagcatggttctggagaatcaaaatctagactgaaaaaaagttaaattttgtgcttaatagaaaacaatgggttacttaacatgacaatttggaaacagaaaaatttctatctcaataatgtatactttttatcaactctcatgagttccaaaacaagtgctaaggataaataaactacaggaaataatttattttcttctaaacctttgaatgtaaacatcctgctgattgcctgcgattctttgttaacaattccagtactttcatggcagttatcacccccatgacacacagtgcctcagaagagctacatagactgtgagaaggctttcagtaaaggtagttgggaaggctgggtg

SEQ ID NO: 25490 - DNA, 1086 bp, Homo sapiens
tgctgagtggcaaactctcataggactcaggagcaatccacaagtgaaatacgagataacccactggacttagaatgtctttataaaccttgatacatttgacttaaacttttctacattgttaattcttaattccataacctcccagtacaattatcttaaaacgagaagtgtatatgttcttaaaattttttttttagaatattgaaaatattcacccagagaggacttttgaaaatgccagtgttgttttgtctcatggccatagtggtcatcatatttctgaaatagcagttggctagagattgaaatttggaaaccagaaggaagccctcactagccgaagggagagtgctggggcctcaggagggccccctctccagggctttcagctacttccagtcactgagcgatgtgaaaatacaagaaaaacagtattttattttccatttaaactgtaagtgaatctgtttcaaaaatgcatttaagttcttccaggttgggagttcataaaaacagctcaactctcagttaataataagactggcagatgctcacttccaaaattcacacttgctgaacaactagacccatcatgtgtcagagtctgctttaccacctgtggaagccagctgctgtaaaatactcatcatttctggattcagcttgtgtgttgtgctcagaaaaaggtcaaagaaaggtgctaacttattcctgtcccaagtgaaatccatatgcaagtgtaatcattcccagatagagggctgttcatggtaattatgtcaggactgtaagtttactgaaattttatggggaaatacgggggtgtaatggtaaatggtagacatttcaaggttagtattaacacacagtcacaggaataaactttttcaactccaggcaatagttttgtttttgagatagcattaaatatacttctagaatatggggaaacaaagcattgtttcatttaatcatgcaaaactaccttgcagttaattcattatcctttctaccagcaaaattcaagctctccactagaataatacaattacagctcctaagtgaaactaggtacagagagac

SEQ ID NO: 25491 - DNA, 1044 bp, Homo sapiens
aagtactatttgtcgcagcttcacttagtcataacacataggcaccattgctgctctcccagaaaaatggatgcatctgtaataagctatataaacaggtgaagtctttcaaggattttgaagatttactgtttttttaaagcctatttaatgaaacaggttgtgcacaatccacacctaagcaccatacttcttaccttgtggccatacctcaaattgtttcttagctccttttctaaaaaatgattacaacaataataataaattcaagaaaaataagcatcaaaatactttcctctaacccctgcaaatgtatccagtataaaaattcccagtgtgcatatttaccttcctgtactgttcaagaaaacacggttgtgcttcattatcaaaagttcattctggtagataacagaagagaatgtgaaatatgcgaaaatgttttcttaggatagaatgaattggctaacatgggagttctttttttaatgagatagtaacataagaaaatgtttggtcgtgtacacagatttggaaaccttcaccacacagctgtgttatcaaattaggcatacttccttgacttaggtgatttttttttttaccaatatgaagaatgaaaaatttttattactgtgatttatcaaatttggactgcaaatttcattgaaattatcattacaatatctaggaaaagtgtcacccagcaggtaataattgttgttctccaaaggcaagagaggaaaaccagtctcatcaactaagtattagttgtgataaggtctttggtcttcttatatttttacaaggcagtgacgcattcaatgtacatattagaacttccttattgttttggtccattcccattatttcagactgcattttaattctcaatttgttattgatatagatcaatcaaatataaccctgtggttgcttatatatttttagagtttcccttacatgcagttttgcttaacatgggtcacagtaaaggatcgtttataaaagtaatggattgtttcctgtttctgccagctgatt

SEQ ID NO: 25492 - DNA, 1050 bp, Homo sapiens
tatatgattcattaccatattgattttggtgataaaattattccatatttggccactgggagccacttaagtcgggctcctgttgtaactgcaattttaagcaagatgtttattaggcatcatagaagtgacctgctggaggtagagttagccacatggctatctagggtacaagggttctaaacagcagaatagttattacaaaggctttaaggccgtgagtatgcctgtttgagaaacagcaaggccagtgtgactggagcaaagtgactaaggtgtgaagtaataagacagggaaactttcattgcatttgccctccccacactcttctatatcctgtggtccagaagaaacattaaatacacccttatacccaccaacaaacgaagaagtaaaaactgccattaagccaacttcttgaatttattttgtatgttgtaaaatccagatagctacatatagatgtgtactttttgaaaatgtatcccatcagccagtgatagttgtatttccatggagattattccagtcgcctgtatttgaacaattatacaggatctgactgtaattagaaaaaggagatgggcccaagtcaacctagtacaagtttggatttcacattttaaatcattggttaaataaaaacaaagtgaagatgaaaatgtttcttttgttaaaaaagataagaaaatataaaattggagcttttattaatttatacatgtctcagagaaataatagtcacagagaagtagcagacagtggcatgcacttattagcttctcacattattatattacactggaaacatgggctgttactgtacagtgaaactagagtttaaggtggagaaccagattgacctgatgcatgtgtttatgagtttcacattgaaggtgcctggtttttgttgttgctgttgttgttgttgttgttgttgtcgttgttttctctccaaagaatacagcttagaatgagtgaggcaagctcaaatcatgtagctgtaactgtcaacttggtgaatttctgagttatcagaaagtgagact

SEQ ID NO: 25493 - DNA, 1041 bp, Homo sapiens
acaagataattcatttctttattcaacaaacatatattaagccctttccatgtgtcagatcctgtgctatgttttgaggacatcccagagagtaagacagtctttgaagtaggagagcctggagtctgcttgaggagacagtctaaccaatagatgtgatacctactgtcttgtttcagttcagggggtgtgggagcatggagtgctggtaaacctagtaatctgaagccaagataggacgtgatcgcttcatggctgctttgtgctaggattttgactgtttctcactccgtgggataaaatatcttcagtggggtctcagagctcactaagcactcgctccttttcttgccagcttcacctgcttgcttcttattcgtaattgcccttgggaaatgtacaactatagcctccctcgctgtggtttttgatactaaatggaggttttaaattattattgggtataagaaaatatgtttttcatttctaagtgtgaattcaataaattcaagattgtactctgttctctgtattattgtctactgtgttgggtgttttttccctaaataaggtgtcttaatcagaatgcaggctttatttttccttttagcattttgcacagcttctaatctcttttgtgccttcgaagtctcctctagtactgtgtcatgtggttgccatctttatggtgtccagctctgcctcttagtggttctacttgcacagttgctgtgagttctggcagtagaatcaggacacctaggttccaatatttattgtccttttttttttttagtctgtctgatcttagacaagttattgagtctctactttagttttgagtctcaacctcagtttcctcatttgtaaaatggggataatatgttcttcaaagtatttttgtgaggaattatataaagcatcaagaatggtatctgtaactttaaagttccaaataagtattagctattattattattagggaaataactctagagtcattgtctcagtcattaggttaactattgtattaggtatcta

SEQ ID NO: 25494 - DNA, 1024 bp, Homo sapiens
ataagtttataaaacataaacataactttataaaagtacagcatatccaagagttgaaggacactttcaaaaggtgtaacaattggaatgctctataggcattccattcaagggcgttttgtcctagggggtttcctttagttaatttgaggtgagatcgaggtggctgtgacttcattgcccagtttgcttctggttcttgtacgtctctctagtggtatgagcatctttttgtgcttattgagcttctcagttttaaagatattttacaataaagttacattttacatctatagtcttcgttattatatatgcatgattcttttagacattgatgtacaaggttgaacatacaaaagcctgtactctttgaaggctagttttgattatatttatttttaattgtaatctctgacctcagcctctgatcctcatatcagatacaattttttgtttctattttaaaatttgaatgtggtggcaataaatatggctgcatatgtgaactcctctgaatactttctgaaaaacattagtttactaatctgttattaatttgtgtaaatgttgcacgtcagataaacagtatcaatttatctagttttatctaattgttaaccttgtattttgcaactgaccctttagctgcagggagtatgttgtataattttctatttattttcaaaatggattaccttcctttattgtatttttagattaaaaagttatatgtgcttattaaacaatttagtatggaaaactgaataagaaaataaaaaatcggtgtcctgtaagttaaaggttgaaaagaaatactaaaacttcataatggtttaattatgcttaaacattttcagcctaaagcctaacaaacgttagcaccttggcactaagagatgagatttttcaatgaataatactttgtgtaatagctcagatattttctaggctgaagtaagcatctaggaatagcagcacaagggaccatatttttagtgctttttcccctatgtcaatatcgtga

SEQ ID NO: 25495 - DNA, 1072 bp, Homo sapiens
attacgtttattgatttgcgaggacttttttctttgttaaaatgttgctctgctttcagcattttctcccttgtagtattaccataatgtatttaagattgagcacttaattctgaagtcactttaagtatacctcaaccaaagggaaattaatatattatttctaatgagtgtatttaatataggtaagtagtttgtacacttgtgaaattcttggcattaattgatgtccagaagctgaaagctactctctggtacattaaaaaaaaattgtgtgtgtaattacaagaaagtttgatgtcacagttgcaaaggagttgtgcaaaacaaattgcctttttccagtaaagataattcagcaagttcatcttgagtgtagtgtgtggtttcgtttttaatatgtcctcagcagtagtcatagattttatcttcatcatttaagctttattttctggcccacttgcacagatttaagaaaaatctcactggggttagtgtgcagtcattcagacagcaaatacagcaaaagtaggtgaaaatgtaaaagtcattaaaagaagaattgtgaaattgctcatctcgcaaccacatcaagcaggagcaaagacaactacacagaatcttggtgtaacatacactcattaccacttggactttctcctacagtattttgcagtttgttttttggattctttagtgttatataatatttcaaagtaatatgtgactgggaaatattggaataggtatcagaagactgtagaatttattttgccatttaaatgcttatgtccttgaacaaaaaatgtaaacatctttgaccttcaatttcttgttctattaattgcctgctttttaggtctgatgagaaaggaagagaatataatttgcaaataaaaagaagcaaaaaaaaaaagcagtagttttattgcaaggggctagatggtgatcaagttaggatatagaaaacaattacttgttcttacatgttattctggagaaagatgagatggatacccatagttacagcagaagcgtaaaaagaattctgtttatgcatcatctgtttatg

SEQ ID NO: 25496 - DNA, 1029 bp, Homo sapiens
attggaaaccattttgaatcttgttgagtgatttctgtgaattgtatgtatctgaaattaattatgggttactagttttacaaaaactttctacaaatttggagacacagtctaggcagttgcaatgaggcaaaggatgcagtgactttttttatcagatgatttttaaacaaaaagaaaattttgccagcaagttggcttggtatcttcattcattgtagccgttagctgcaggtgtgtctttccaatatatgcaacacatgtagtttgggttttaattagggcgaatggtcttggactactgcagagattctgagctacctcagctttttgtattttagttaccaacagtgtttacagagtcttgtaatcactttgccaccgtttacatcctgaagctaaggtacttgtctccttgtctttggctctttgtagtgtgcagaaagcatactttggccatagcctactgcagtaatccaaagtgcttctttgcatttacatttacatctaacgccttctaattctagcttaatttttttttaaatgccacgtgttttctttgtacctagtctgtgaagtttctgtaatatccagttagtcatacaagtcaagatgctacccatgtagacacactgtatttttaaggtgggcaagtgcgattaacgatgaaccattttaaaggggaggttatttgaaacctctaatttgattattgggaggattttcatgctttctttagtatttattaccatcataccgattcaaactattttattgtctaatacattagcattttgtattttgatggaaattgttacagaatttaaagatttgatgaaataagatgtagcagattttttgtagcaagtttctggtaaaagggttttttgcaagtctcaggttcttgctgcactatttttttttaaatatttattccagttattctaattcagaagcattcttttcaagtaacagcagcacttgtgaaaggaaaaaaaaatgcacatgtttcttagtaggttactaaat

SEQ ID NO: 25497 - DNA, 1076 bp, Homo sapiens
aattagccatatgaaggagcgactgtccttttgctgagatacttttagagatgagacattccctttctagacaactctaaaccaagggaaattcttcctgtataaatatgagcttctatctttgtttatataatttccatcattaaaccacacttctgccttttcaggtcatctgagcaaatgtaatcactcatctacccacaaaatggctaaatgacttaattcaactccctttgttgatttgcctgttagtttgtttatctggtggtctatctattaaatgtttattgagtacctgcagtgccagatgctgtgctgggtgtttggaatgcaaaaaatgagtaagacaaagtctctgctctcaaagaatatttttagtatattaaagatttatatgtaaaggatatagttatttttcatgtgtaattttcttttcttatttggcaatatatgataaaacatttagcaggagtgatttttgttggccacatggaagaacttgttgatcggatgatgatctgttaatacagcctgttagttttgcagagatgtagaatagaatttctttggagctgtttaaagggaaggaaaaaatgcaagtgtcttagatgtatttgacatttgcccacctgaataaaatgtgcggggtagagttattcacattttttttaattctagaacttctttgttcatatggttgcagttttattagcttgaatgcattaaatactcctcaccagtgaaacatctcagtgtggaatcctaataatctagaggcctagtttagggagggaagggattgataacagaatcagcagtgagtggctttcatggtggtagtgatggaagccactcattctggctcttttttaaccctgtcttttcagctctggttggagtgaatagaagtgggaacacaatgcattctgctttttggcataagtttcactatactgaatgcattcattttgctttgggagttagtgaaatataatgaggaaggaagggctcagtctctggagtgaggctgcctgtattcaaatcctgactgccacctgttagctgtcaaattattt

SEQ ID NO: 25498 - DNA, 1032 bp, Homo sapiens
aggtactcttataggaggctatcctaaaattatattattttctctaaattgtgtggagtggagaacacagcttcagcctgggatttgggctatgtgggaaaattttttttttttctgccagtattttaagtcctttagcagagttaggaagcaggaaaatattattcaaagtctaagaattcctttaatggataaagagaaatttactgttcttaaatgctacctgttaaacatttgtcttattcttcaatatttaatactaaaatagttttcagagcagtattcattctgggctatcagatagacagaactttaaaaatatgttaaagctagggttaagtaatgaatataacagcatgggaaaagtggagaaggaatctggtatgaggccgaatgggtggggatagaggagtctattttaatgctgatttctatgagatttccataagcgtgctgaaaaaggcttaaattaatattgtgttcagttggtgatctaaacactataaagataattgttgtgtaaaagtttgacctgaagctttcatttggaattatcaggacagtatcctaatctgagttttcaggcctctagaagtccatggatgtagtaatgaggatcaatatgattttaacaaaactcctagcatatggtaattgaactatgaagtctttcacattaaaagcagcctgaaatataaaatttctctgatatatcatgatacatgtttttgaaggcaatactttggttcgtttgctgtttgttttataaagcaggcattgagaaggaggatgagtttaaagacttgggagtaagaaataagaggactaatgtaggatggaggcgggtccctgcattgagacacttaataaatatgttctccttagtgtccctgacatgggccacatcctgtatgaaattctgaaacagtccaagtttgtctttgtgttccttcccctcactcatcctcctcttaagagtagtcctacttaggggagcacagggctccatggtctacccaccctttgtacccc

SEQ ID NO: 25499 - DNA, 1096 bp, Homo sapiens
aaactggagctttcagccaatgcagtaaggtaagaaaaagaaataaaggcatccctacttccagaaagaaagaagtaaacctgttgttgtttgtagacgtatgatgtctacatagaaaatcctatggaatatttaaagaagttattagaacatgtaagtgaagttagggttgcaggagacaggatcagcatgtaaaacacttgtttttctatatactagcaacaaacaggaaattgaaataacatcaaaaaataacatgaaatatagataaatctgacaaaaggcatgtaagacttatacattgaaaactataaaatattagtgagataaagaagacccaaataaatggagatatatgtcatggcttatggattggaagactcaacattatgaaaatgtaatttctctccagattgaaccacaggttcaacaccatcctatcagaattccagcaggcatttgatagaaattgacaagcttattctaaaattcatatgaggatgaaaaggacctagagtcaaaacaactttggaaaataaaaacagctggaagacttaatactactttattgtaagacttaaaaagttacagtaatctagacagtgtatgttggcatgaagtttgacaaataggtcaatggaataggatagagtcctgaaatagatgcacacatagagggtcaattgctttttgacaaagatgtaaagtcagttcaatgaagaaagtagattaaatttcaatagacagtgttggaacaattggatatcagcatgcaaaaaaagactttgtatgcagaagttgactcacaatggatcacatacctgtatacaagaacttaaaacctatagccagaatattaagtctcagaatttaataataacccaatttaaataatggacataagagctgaagacactttaccaaataagatatacagaagacaaatacacacatgaaaagatactcatcctcattaatctttttatttatttatttatttgtttatttattttttggagacagagttgctctgtcacctaggctggagtgcagtggcatgatctcagctcattgcaacctccgcctcctgggttta

SEQ ID NO: 25500 - DNA, 1044 bp, Homo sapiens
ggttagagtataaggaagtggggctttgcagtggattagatgctgttagaaagtaggaataattttaagaacctagaaggcaagaaaatggagcaaggctaataaagctgtgattgataaagaaacagaagttggctgggtgtggtggcttgcacctgtaatcccagcactttgggaggccggggtgaatggatcacttgacctcaggagttagcaggccagcctgagtaacatggcaaaacctcgcctctacaaaaaaattacaaaaattagctgtgtgtggtggttgcgcacttgtagtcctagctacttgagagactgaggtgggaggctcacttgagccctggaggttgaggctgcagtgagctgtgatcatgccactgtactccagcctgggcaacatagcgatagcctttctcaaaataaaaaggaaaggaaagaaaagaaagaaagaaaaaaaaagaaacagcagcctttctcaaaataaaaaggaaagacaagaaaaaaaaaaaagaaacagcagtcattcatattagtcaggattatgtttggtcattggctattattgtttatttttatttttttgagatggaatctccgtctgttgccccagttggagtacagtggcatgatctcagcttactgcaacctccgcctcctgggttcaagtgattctcctggctcagcctcccgagtagctgggatttcaggcacctgccaccacgtccagctaatttttgtatttttagtagagatggggtttcaccatgttggctaggctggtctcaaacttgtaatctcaagtggtctgccagcctcggtctcccaaagtgctgggattacaggcctgagccactgtgcccagcctgattatttatttatttatttatttatttatttatttatttatttatttttttgtggtcaggacaatgttcatgttttgtctgtgtttagacatgattagacagagtggtttaatttttctcttgacccatcatgagcacagggtggccttgtctgatactggtgttctgtgaaatt

SEQ ID NO: 25501 - DNA, 1059 bp, Homo sapiens
gtcatcagcaaacatctggtgacttttggatgaaattagcgaccaatttatattggcctcttaattattattaacctttgtggtctcttactcttcgatttaagaggattaaaggttgccttagtcaaatatccatactagattatttttattccaggataaattctgctgtcaaagagtatattggtattaaccaatcaataccagttaatactggcatttcccaaattatgtatacctcatcaaaagaggtagctaaaaacctgaaatttctttgtctttcatattttggaaatgcctgtggctgggatgctgtttgaagttaaaacatatcccgtgcaactaaattatttttctttctaaggattttctctgctcccagtggaaaatttctcactttatatgtgtattattttgtgtgcttgtgggagcatggtttgtgatgatgagaaaagaaattttccatttgggaatctaatactatcaactacatttttggtttttgttttatcctgggataatgtagtgtgtggatgaacacaatgtaatctttactggcctctttcttatagttcagactccatgtttgaacagctttggtgtttttagtttttattcatttctttttttaaaaaaatgaattatgggtgattcagggtttaatgttgtatcctaattgtgaaatctgtgcttttggacctgagcagatacctttgaaaccattacctcatctgttactaggaagaatgagctagcatttacattcctcccccctggcaagtctgaaaagaaatactttcccccctttttggaatgaagagactatctataattttatttgtacctttatccacaatacactgttttttccatttgatcctcttatcaaccttgtaggatcattattattattcttactttgcagttgaggaaacagacttgttggcaagtgacatagccaagacttgaaagttttttaaaattcaaagcccacattcattatcatagctactttatatctttccactgggataacaggacatgcctaattggcttttt

SEQ ID NO: 25502 - DNA, 1031 bp, Homo sapiens
agtgctggaattacaggtgtgagccactgtgcccagctcagttcacttatttaaactgcatagttcagtgactttcagtatatttacaaagttgtgtaaccatcactacagtcaatgttagaacattttcatcaccccagaaaccttaaaccctttagccataactcccaaccttcccctcatccttccaagctctaggcaacttctaatatactttctttttctatagatttgcctgtttgggatatcttgtataaatggaatcatataatatgtggccttttgtgtctagcttccttagcaaagtgattacaagattcatccatgttgttgtagctgttggtacttcgtttatttttattgaggaatactgttccattgtatggatataccacatttattctatttatcagttgatggacttttgggtttcttccacttttttggctattatgaaaagtgttgctgtgaacattagtgtaaaagtttttttgtggacattgctggatcatttggcaactcttacgtttaacagaggaactgcaatactctttttccaaagaggaacatcattttacattcccacccatcagtcagtgtatgagtgttccagcttctctacatcctcatcaaaagctgttaattatctgtctgattatagtcatcctggtggtttggaagtggcatctcatttggtttaatttgcttatgcttaatgactattgatgtggttttgtgtatcgtctttggagaaatgtctatacaaattttttgcctaattttttaaaaatatttttcgtttttggagatggggtctcactgtgttccccaggctaatctcaaactcctgggttcaagcaatctgcccacctcagcctcccaaagtgctgggattataggcatgcaccaccgcgcctggcccttttgcctacttttaaattttattatttgtctttgtattgtttagttgttcagttgtaatgttcattatatatattatcaaatatatgatttacaaatattcttaggtt

SEQ ID NO: 25503 - DNA, 1047 bp, Homo sapiens
ttaacatttattggttgattataaaatgaacagccagctgaagaggtatatagaatgaaatctaaaagggtcccctacacaagagtttctgtccccgtggagtggggtagacctcctggtacatggatgtgttcaccaacctagaagctctctgaaacccttcgtttggaagtggaggctccattacatgggcacaattgattaaatcattgatgatgagctcagtcttcagcccctgtcccctcccggtaggaagataaggctgaaagtttcaaccttctaatcacatggttggtttctctggcaaccagcccccatcctctgccagtcacatcattagcataaactcagatctgtttgaaaagggcttcttatgtataacaaaagatgttcccctcacccctaccactcaggaagttactagcattttagaagctctgtgccaggaacctggggcagagaccaaatgtgtatttcttatgtcacagggaccatttaggatttctatatatttatatacatacatatatatactctgttcagttacgcttgttttgaaaacccaaatttgttctaacatggctgtgatattagagaatgagtacagcataatgtgaatttcctgttacttacacaccaattttgtccttaagaaatgctagagctgggaacgggggctgtgtctgtaatcccagctactcaggaggctgaggcagtaggatcacctgaggccaggagtttaagaccagcctgggcaggccgagtacggtggctcatgcctttgggaggctgaggcggggcggatcacgaggtcaggagatcgaaaccattctggctaacacggtgaaaccccgtctctactaaaaatacaaaaattagctgggcgtggtggcgggcacctgtagtcccagctactcgggaggctgaggcaggagaatggcgtgaacccgggaggcggattttgcagtgagccggctgtaacgttttcttgaatgggtggtaggccacagatattactggtccacaagccaggttgggcaggagctt

SEQ ID NO: 25504 - DNA, 1028 bp, Homo sapiens
atttgctgaatggttccatttcaacctttttctttttttcttgagtttggaggttggttagcaggagggaatttttgggtgtgggaaattgtcagtcatacaccccagtgcatccactaatcaatccaaagcttccaaagcttttcttgattgattgattgatttgttttcctttcacctctgatctcagcagtttctccccacccctgtactaatacttcattgctagttcttcaccttgacaggaaccagatcttagtatgtttttatttagtgtaaaaaatttctaggacattatacaaactctttttcttttatgtaaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtaaggataaggatactttgagacagtagaacaaatgcaacaagaaaaaaatgacctgataagagacaaaaaaagggaagaaaattagaaagatactaattgtagagtcagaaaaaacctttttataaattaaacttggataaaaagcagtaggcttattaaaacagactgaaatcttaacacagcagtagaaatcttagcacagcaggagaaaagaagatagttactactgattgtgaaaagactcagacatggttttcataattgaagtaaaatagttttaaatattttattcaaccactataactaagctatttattttaatgaaacaacagtaaaattttgatacacctcagtccatttccacaatacttttagtagtattgtatctcttttagatacatgaaccctttgaatcattattaatgatacagtttgttgaaattttataagttaaaacattctaaagatgaacaaagtaaacaattttattcttatcaaattcagtatatttgtgtactcttccac

SEQ ID NO: 25505 - DNA, 1027 bp, Homo sapiens
cgcaagtggtggtggtagaagggtagcgcaaacaatttggactcatatccatttcttcactccaaaataaaatccacgtagatcaaatatatacataaaacccttaaatcatagaggtactagaataaaatataggacaattttctggtataagacctggtatgagacaggcctttctttgtatgacaagacactcactagtcataaaagaaagaccaacaaatttaaattggtataatgaaagatgccctaaaattaaaagacaaacaagctagattaaaagcatttatagcatatgttacaggtaaaagcttactattaatataatatctattattgtaatgcatagaaaaagatccgtggatacaggtcatgttgttaacagcactgggtattttcagagactgatggggaaggatggtcaaaagaattggctttatttgtatgttttaagtttttacaatgagagtattaatgtattatgtgtctattaaaaaataaattttgatctacccatcctgttgaatattatgtagaatcgaatgtggtatttctgatgggtattatcttagaagaaggtttagacaatgtaaaatacatatgggtatatatacgtttatataatatgtaaaaataggctgtgagaatgtacttcagtggctgatatggttatcttggagatggtactgtgagtgaggtaataaagaatgactgtcatgttttgctcttcataattgtacattatttgaagcctttgcttttaaattatttgtacagtaaaaataaaaacataggggaaaaaaggctgaaatgggggaaatctgagctctcacatataaagatcctatagaaccacactatcccatacagtagcctttaatatgtggttaatcagcacttgaaatgtggctagttctatattgagaagtactctaagtgtataataagtgtaaaagctggagtttgaagacagtacaaaaatgtaaaatgtcataagaatttttatactgatcatatgttgaggtga

SEQ ID NO: 25506 - DNA, 1059 bp, Homo sapiens
cctctgctcaattgcccagtctttgcctagacctgctacgtgaactttgtcacagtggcaagtcagagctagcgtggctgcgactcctttgtgggaggaaaagtaaggccttgaacatctaggtgtagggaatccacccccagaacactgccagggaaggcagcagagcaggctgctgcagtgagcggcccctgacactttctccacggtcccctggcacaggaagacaagtccgagagagagcgctggcagcacctggctgacctggccgacttcgcgctggccatgaaggatacgctcaccaacatcaacaaccagtccttcaataacttcatgctgcgcataggtgagcacccccagctggcctgccccgcagcaggctcccttcccatgcaggggcctggcccaccaccaggagagacatgaggctcaggacaactgaggcaattcgggtggggaggttcacgcactcacagggcaaggagacctgaaagacctttagtccagacgactctagatgactaaaccaaaaacccagctgatgtgatgatccgactatactgtgcctactgttacaatagaagcttggcctgcctggctgagaagtgagtttgtgatccatttccagaggggttgctgtgcctgctgaggacatggcttcccagacaggcctgctctttgaaaggagttaagatcacctgctgcttctactgagggggtatcattcctgagtgaggtcccaggagacttgaaataccagctgtgttagaagctggccactaccatgccgagtaaatctgcatatggggggggggtggcggctgacacctaacaagcacacggataaacaggagatgtgatttccaccctccaatagcatacagccaagttgaatgaggacaatgatgtgttacattaggagctttgtggtacaggtctggagaggagatggcttctgaggcccataacaaggtgtggcctgtggctgtgctgaactttatgcctctaccctaggcatgaacaaaggcggggttctggctggggtcatcggagcccgga

SEQ ID NO: 25507 - DNA, 1029 bp, Homo sapiens
acagtactaaaaatactcgagagagtttttgtgaatgtcaaatgaggcaacggcgaggctcttagctgcagttactaactttcatatgattagtccctggtaaatttccccatctttcccggtatttctgggggagccgcgggaggtggcagctgagcgtgcactaccatgcacagccctctgtgaccagcacctgctgttctcttgaacgtgtgtccctgcccgccgtcctggcctccagctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgagtaagatgaagcgtgactggggatctgtattgtctccttcctcccgcccgcaaagtcctcagttcaagctcatgggcctgtgctgaggtggctttctgccactaggggtcctcaaaggcttgttcaagaaccagttcctggctgctcacagacgtatcactgtttggctaggacctgagaatagattcttcccattctccccgagtggaggacttgggataccccggtgcctggctgggcatcaggctcttgttcccagatggggcctgactgtgctgttatctgtccaacagcttacctatggtggccttagagcagatgcaaggattcaaccctgggctcaatggcactgacaggtaagggccacggcttcccctcctggcctgcactcacagcccttcttctagagacaggaatataacaggcccaagccccgggatctcaccctcccgggaggcacgtgacctgatacgtgcaggttagagaagctggcatgggttcctccaggagggctgcagcagtgcagtg

SEQ ID NO: 25508 - DNA, 1031 bp, Homo sapiens
gcccgtctagtattgccctggaaagaaagcagtgtggcctttaccccaggggtggtagtccaggaactctaacattctctccctgccctgtcagacacgttcaggcagggggctgttcacggctattttcttcacctctgtgtctgcagcaccttgaacgtgcctggcacatacttgatgctcagtgaaatattaactgcacgaatgaataaaagagtaattggcagagagaaactgaggcccctcgggaagtggggatagggaggaaagtcgcttggtgccctcgtcctgctggcctgtgatgcctgactctgggctggccctggcctgccttaccccccacccaacaccaagctgtggggaccttgccaggccccctcttgtggaggggaagaggcccacaatgaatttctcctgcaggagcaggggcagctggctgcctcgtgaaggccacaccctgaccctcctttctgtgtgtacctggcaggtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggtgagtgccattccaagggggcaggtttgaggactggggaggggaccgtcccctccatcccccagggctgtgaccctgatgagggacagggggcctcagagaaggcctccctacaaccccggaacagcattcctcctgtctcgccctggtcctggccctggctaaggccgttctgacctgccttggggtgaggcctctttgggcctgatattggatgtggcttttccttcctggaccctgcagtagcctgtcctcctgtcccctttaccgacttagggggctgcctcccctttacccactaagggggctgccccagctctccttatgtcagagcccaggtctccccaaagggagagtaatgagcagtcatcagctagcgggctcg

SEQ ID NO: 25509 - DNA, 1065 bp, Homo sapiens
aaggacttgaaggctgaggagaatgaagactttaccctccttcttctctgtgcagaaccacatctgggcacccaggcctcggcccccagggtttggccacatccccctcctccggtccagccttccacccctgctcggctcttcccgcagtcttctctctcggtttctgggaatgggagttcaccacctctcagggcagcacattctttgaactgtttgactctttaaaaattcttccttctctgaaagcaacattctgttccccagcagcctttcctcattagctttctctcttggggcctccaaagcaagtcttgtcccttttctacatagcagctttcctcagacttaaagacagcttcctaagaagaagggggtgggggggacctggggctaaggacacagcctggttaagctggaccggggcctttttatttttctgtcacacagcccagagccaaggggcttgttcaggcagctactttatgctgggaattcattttattttattatttttatttgtttcgggatggaggctcgctctgtcacccaggctggagtgcagtggcgcagtctcagttcactgcagcctctctctcccgggttcaagcgattctcgtgtttcagcctcctgagcagctggtattacaggtgcccgccacgaagccctgctaatttttgtatttttagtagggatggggtttcaccatgtggcccaggctggtcttgaactcttgaccttaagtgatccgcccacctcagcctcccaaagtgctgggattacaggcgtgatccaccatgcccaggctgggaattcattttaaatctaacagcatctcaaatggtaggtgtcccccttctaacccccgcaacattggtacattgtgtctctcccattctgttctcctgcatttggtttgggagtctcaggtacagactatgacctctatcctttttgaatttcatcctgtatgttgcaccagatttcagcagaacaaaagccacgagccacttgtcccagtgacacgccagccacacatttctaaatacatcctctgtatcttc

SEQ ID NO: 25510 - DNA, 1014 bp, Homo sapiens
tgggctgggatggctttggctctaagctgcagcttgggatcagttctgctgtatcagtttattgttctgttgtaccagtgaggttcttagtgtgtggtgttctggtgacgggagaagcacaaaacaaaaagccagccctcatgggcatttcagaatgtgctgcttttatagatgctgaagtctttttggccaaagcaaatcacgtggtcaaagccagcaggaaggaaggagactttttttttttttttgaggtggagtctcactctattgcccaggctggagtgcagtggtgctatcttggctcactgcaacctccgcctcccgggttcaagcgattctcctgcctcagcctcccgaatagctgggattacaggtgcctgccacaacacccagctaatttttgtacttttagtagagatgagtttcgccacattggccaggctggtctcgaactcctgacctcaggtgatccacccgccttggcctcccaaagtgctgagattacaggcgtgagccaccatgcccagctggaaggagactttatactctgcaaggatgtggctgtgtgatgcttttgcgggggagtgaagaactagggccagctgtcttcctcagacctcatctaaagcagctacctagtcactttctaccacttttattctcttttgagctctgatatgcttacatttgaaatattatttctgctaagagcttgacaagggtaaggtcacagactcgtcataacatgtggacctccacaggcagcagaggcaggctgttttggttggagccttggatccctgaaatagcacatcttatagggaggactggagagaggcccattgtgattggagggaggggagcctgttgaggagcaaccagagtcaagacagtagagcctggggccaaggccgccatgttccgtgtctggggaagccatcacgacagatctgtgtagtggcacccctggcagtgcgcaacctgagaagctgctctagctgcctggcagatcat

SEQ ID NO: 25511 - DNA, 1058 bp, Homo sapiens
ccactgtaaacaactaggagctggataaaatatagggaccaggcaatggtggactgtgattccttggaaaaagaagactaaccgagtgagccctatcgttcattacctagcctttctacctgaagagaattctaccacagggagggagaacccaaacggagactggcgagattactaagttgagggaacagagatcagaatttggagacaccaagttctaaggtttctagaatctgtgggacagaatcctaaaaggaagaagctggaaagagaaagatctccagaaatctcgatagaggcctcctggaatctcggtgaatatcaatctgctcatgcacagggcaaccctgtgagaccagaagagaacaactgcagagggagctgtaagacaaacaggatagagccaacacaggaccagggttcactggagtcctctttaaaagaatatgacaaaattatgcattgaaaaatggtaacgtttgcagtgtgagacatccagcaaaaaattactagacaaagaaggaaatgtgactgacccactaacaaaaaaaaagtggtcaatagaaatagacctagcaatgacaaagatgtgatggaattatcagggaaaggacatgaaaataacttttttttttttgtaacagaatctcactttgttacccaggctggagtgcagtggcacgatctcggctcactgcaacctttgcctcccaggttcaagcgattctcctgcctcagcctccggagtagctgggattacaggtgcatgccaccatgcctggctaatttttgtattttttagtagagatggggtttcgccatgttgaccaggctggtctcaaactcccgacttcatgatctgcccatctcggcctcccaaagtgctgggattacaggcttgagccactgtgcacagcccgaatataacttttataaatatgtttcatttgatcaagcatgtaaatgaacacatcaggatgatgggaagagaaatggaaagtataagaagatccagtagcacctctagggatgaaaaatcaaaatatcaactacaaaat

SEQ ID NO: 25512 - DNA, 1119 bp, Homo sapiens
ccaggctggagtgcagtggaacaatatcagctcactgcatcccctgcctcctaggctcaagtgattctcctgccttagcctcccaagtagctgggattacaggagctcaccaccacacccggctaatttttgtatttttgtagagatggggtttcgccatgttggccaggctggtctccaactcctgaactcaagtgatctgcccacctcggcctcccaaagtgctgggattacagacgtgagctactgcgcccagtcttgtctattcttaatttattgattttatttatgtgtcacttgcattttatttacttgctgtcgtttcagcaggcccatcccctctctcctttcccctccttgccattttctgtctgatgactcttccttcttctgagcaggttttcagtcctttcttctaggaaattcctctttgtggttcctaaggaattcactttgattagaaatgaaactgtttctttccttttccccttcctctcctccacaacactttccttcttgtagacaggaaagtaaatgacttgtttcagaagaaatctacccctctcttgagctccattcaaaaccccaacataagcgactggacttgaactttcgcaagatttccatgtctggggtttgttgttcacatgtcacttcaggactgatctccaggaagtgtagtttggtgtcggctgagtcagatctggtagtggaagactgcgacagctgcctatccagctctcggtgggctcctggactgcccttgggggcagtttctcacccaaggggaccaggccctgaggaatttattcccatgagcctgattcctttcatttttatttttatttttttgagatggagttttgctcttgagtgcagtggtgcgatcctggctcactgtaacctccgcctcctgggtttaagtgattctcctgcctcagccttccgagtagctgggattacaggtgcgtgccaccacgcctggctaatttttgtatttttagtagaggtggggtttcaccatgatggccagggtggtctcaaactcctgatctcaagtgatccacctgcctctgcctcccaaactgctgagattataggcgtgagccaccacgtcca

SEQ ID NO: 25513 - DNA, 1035 bp, Homo sapiens
cactttaattttattccttatactttttgtgtattaaaatatatgaatatatatatttaaatagtataaaagaaaaaaatcttccaaagtgtgtatttgctttatacatgacttctaagagttgctggaatatattaaaagtcttttaagttgatgcttaaaaggaattcctattttcacaaaatcatttctaccctgggttatgttttcttcttgtagaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaaggtaagcgctctgggatacttagtgctgattgctatcataaagaaagactccatcaccaaaattataggtgcagtatatcttcctccagttggctggaaatacgaagatgtatgaaaatatattagaatgactcagtttcactgaattagctgaataccaaagagacaaaatagagggcacagttgcctggtgagaaaactgtgtcgtgtacgtgcataaatacttcatgaaatggtatgctctgctttcatctgtctggaacaagaagagctttgaaaagaactaacaaaagagaattcttcaatcatagaatgttagaggaggaaagcacgttggcaatcaacttgtcaaacatttcattttataggtgggaaaactgggattcagtgagattaaacatgttcaagaatccccggagttagtggtataattggttcttaccctggaacactgtatgtttgactgtctctgtctttgtctctaaagccctgcaagttcctcatctgtgtgtgtatttgtttattttttttttttatttttatttttgagacagagtctcactcttatcaccccggctggagtgcagtggcgtgatctcagctcactgaaacctctgcctcctgggttcaagcaatactcctgcctcagcctcctg

SEQ ID NO: 25514 - DNA, 1052 bp, Homo sapiens
tttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgtactggtgctttcctgtctaagtcgccttttgtgtgttcttttat

SEQ ID NO: 25515 - DNA, 1050 bp, Homo sapiens
ggggcaggggtcaggacttgaggattaccccgggaatccctcctgagtaacctggaaccagggctgcttctcatgagcaggtttctgtcctgctgtcactccatccctgtttgtggatggtggcattggtgctctgagatgatggcgttcgagactggggtcacagtgcctcccttttccgtggggcaccctggactcttttctggctgccgctctggcacaccccttttttgtggctggtctggtgctgggctccggcccggggagggagaggcccttcggtggtactcaccccatcccctccctctgctttccagacatctgcatctcctgtgggagcctcaatgttaccctggaacaccccctcttcgttggaggaatgtgccaaaactgcaaggtaggagcacacccacccaggagaggtgccgttgaggccggcccttcggccttctggctgactgtgtccaccgcttctgggcatgtacagggtgacacccggtgtgcgtgtgatgtagacttcagagcttcctctggaagcagagtcctgatgacacgggcccttgggtttcaagcttttgacttgctctcatttttctcctctgaaagattctttacctctctcaagccccattttagtccccagatgtggggatgggagcagagcagcggggacaagctcaggcagagtgtagcagggttgccgtgccctggggagcccaggagaaaaacccagggctgcaggaaggcccaaggtggtggtgcagccccctccctggccttgttctcaggctgctctttggttctgtccatggcggtgcacaggcagatgaggtttccccttcccagatctgcagctggggcctgaccctggctaaggtggtggcggggtcatgtcttcagggcttaggctctgtgaggccaggtgtggagcctcccttcgtcctggccgtcctgggacccgtcctggtggtttctgacccttcccgctgctgtctagaactgctttctggagtgtgcgtaccagtacgacgacgacggctaccagtccta

SEQ ID NO: 25516 - DNA, 1041 bp, Homo sapiens
cctttccagcacctcttttaggctcttgacatccagcatattttcttctcatccaggagttcctcctttcaacatacttttataacaaatccaagaacatggcttattttacatggtgctgctatttgagtttggctatctttaactcaaacaaaagacctatctggtaaactaccagggaggtttactttggaagctcaagagcatgtgtgacctgaggatccttgaagattgccccattttagtaaggggatttttccttttactaaaatcacccctgctctagatcttggggtctcttctgctttggggtctgactgtgcattgaccacaaagaagacacatctctgtttaagcgactcagtctagaaaaggcagtgtttcctgtctgcatagttacaggagagggaagaaagatgctctgggttgttaaggggacacctttgagcctaggcttccttttgcttgttgggaagttgtgtggaagaggtaggatttgactttaatgttaaaggatgagaataaggaagtttgacggccggagggaacagctacctaatatgtggccaagagaaagtgaacagttctggccagttctgacaccttgagtccttgctgcacgcacggcatcattgcagtcttatgtcccaagaccacagaatgtggagtctaaggtgtttagccgcattataatggaagagcgggtatcgtacatgagacagtgtctgcaaaaggccaccaagccagaaccagaaacttcttttgagaggaggcctgaagtaagttctcaggcccgttgaccggcatggatgcagaagaggtatcagtgagagaagcagcgaagcaagtcatgctgcattccctaaaggttgggagcaggcaagagggacaaattctgggcttctcacttctgcttggggagcccctggaaatgtgtaccaggcaaataccttagttgggttgaaagatgggttggaacagaagagggcctgtgtttttgtttgtttgcttgtttttcgaatagcttcttttcctagctgt

SEQ ID NO: 25517 - DNA, 1084 bp, Homo sapiens
ccccacccccgccacacatgcccctcgctcctccagcccacacggggcctgcccagcactcccaggggtgccctctctggccaggagccagtgtccacattgtgtttgaggcgagtgcctccttggtgggtccgtcagtgcccaccctaatgccctaatgtctgtctctctgtcctagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggtgaggcgccttctggcctgggccccagcccgtcctgcagaactggaaaaccagaagtgatgggcctcagtttccccttcaggctaacccttagaacttactgggagcctcttaatctctagtcatgatgactggttcatctgctccttcagcagatgcttattgaacacttactgtatacctggctgtgtactagaccctgggcgtatacggttcctgctctcatggagttgacattctgatgggggagacaggcagaacataaagaaacaaggggctgaaatagaagatagcagaggcctgctttagttggggtggtcaagacaggcttcttggaggaggtggcatttcagttaaggtctgaaggaaccgaagagctggctctgtgaggagtggggtcagggagagtgttctaggcagaggaaacagcaccagcaaggccttgacttgtttggcaaactgtatgccagggtgaaatggcaaaggagaaagggccagatgcagccagagaggcaggcggggctccacacatcagttggagacctgcagagtctgcccaaaagctggcttacttctgacaatactgggcagccatagaaggtttctgtgcacaggaaggatgtgatgtggatttgagaggcagcagtggagacagagaagagctttggggtgtattttggagctagaatagctagggcttgctgatggaccggcagggaggggaactggtggactcaaggaggactcacaggggtctgg

SEQ ID NO: 25518 - DNA, 1050 bp, Homo sapiens
gctgcagggccagccccagcgccaggcttctgggaaccagtgccgctgaggcctgggggcagctctggagaacaagacccctgggctgtaggagcctaactggtttatgtcttaaactcagatgtggagcagtcattatttcccagcaccagagacagctggttcctttcttttaccccccttccagctgagaatggtaaacttggagcaagaaggtaagggggagtcagaggctctggatttgttactcagcccttcaaagaaatgttctcagcaggcatggagcccaggacttgctccctttgggtagagagccgggttgaaggtgactgaagtgaaatgggacagtagaggcggggggggtggtgagttcctggaggtggggggtgtgggaacctgctgtgtactgagatgcacccctgccagttctgcctgaagatttgaggcggggggcaggggggcggagtgaagtcattttactggtaagtaattttaaaccttttaatattaaagcaaacgtggatatgtaatgaatgaaattcattctggaatgaaaaattcacgtgatgttgaaaaataacacggggcttcagagaggactttctggctggcagcagactccagattcccagggcccctgcaccctcctctgcccacagggcaccttaatggagaaggtgtgggaggagagccaggccggagtcagagcacactggtgactccacatttgcagcgtgccctgcctctctcctgaggcttggcaacgtgcaatatgctaagcaaactccccctgtccccgtccagtttctgaggacaagagccaccacctgtagcaaataaagacccagcaaccctttgactcatctttgtgagtctctggaatcagagggtagccacatcgctgagaggtggagtgaagcactcgggtgaaaaggtacaaggaagtcagggacaggagtgtggggacatcacctagacaatgacagagaagaggggcacagccgagtgaggggagaggggccggcagtcctacatcccctggcctgaagc

SEQ ID NO: 25519 - DNA, 1024 bp, Homo sapiens
aaggcctcctttcctggctctctgatccctgcaagtcagataatctctctgagcttcaggtgtttcatctgtgtaacagaaaaaaataataccagctctgctttctgtaaagtgtaagaatacaatgaaataacatatgtgaagatgctttgttaattaccacgttcagtgcaaatgtgagagattattatcgtcatagcccagcgcatcagaatgagacgttgtatatggcttaaaataatccatccagtgagcagtgttgaaatgtaggtcagatcgtagcctcagatgtttagagagaggaaccacctaatctcacaggccaccaaatgtgaaggtgctttgaaagctgcaaagaatgacataaatgcaaagtgacaattatgtttaagtctagaagggacgttttagtcctcttgtttcctaatctggaatcgtaaagatccgagaggcactggaacctcgtacacagttgtatttgtacgggtttgtagatttgtacgtgtgtctctgtttgcgtctatggactcacgtcaggcacctactctgtgacagtcattcatcaagtgcctgccttggactaaatgcatccgtctaggcattctggatgccagcatgaatcagacacccacacttccctcaaggagctgaccgttgccttgctgggtaggggaactataggagaggaagggtctttcagctcagtctaggcaggggatgggaggagggggcctaggggcagggaatccaggataggaggctggaaaagcgagtaacagtttgctgataaacctgaggggaaggtggtgtggtcagaagaacagtctatgcctaggggctgaggccggaagcagtttgctttcgcgcttggtgctgtctgttgggaccacagtgtggagaagagaccaaggcgatccagccaaatcctggggaccgccctgcacatgagctgaggagcttggctggatcctcctggcccccgggaacccccgtggcaaaggtttaagctctgcagagtggcata

SEQ ID NO: 25520 - DNA, 1033 bp, Homo sapiens
cagagacgtccctgcctccaggaacagcaagaccaggggcccagacagtgactacaacgctttatccctctgtcttcatctctgagctcttcgttctcaggcaggctcacccacatggcgggaagacagcagctggcagcccctgactcacatcgaccatgttagcatccttccatcgcatcgataaaaaggttccagggaggcctctgattggctctgcctggtcacgtgctcaccacttgcctggggtgagggttgaggtcagcacaggcacaacgaaaaccttttgacaagcgtttcccaccgggaaggaggggaaggcatctaggtagagcagaacaaccagagtccactagaggaaaaggagaatgcaagcagagggagggagaaggacctgctacagaaatggtcagatatttttcagccattcagacagagaacttgagacggagaagaaggggcccttagggtgagaatattgggatcgtgtttggtggagtgaggatttaggtttgtgggccgtgacagttttggttttggaagaggataattatgtgcaagcccttgttgaggagagactgtggggtggcaggggggccagcagtcctcaatctgaagatggagaggaggcttgggtggtcatctcgggggtgctgatgaggctggggttggtgaggaagtgggggcggcagtggggacagtgtggtgcaggggagcagtcctgaggcttcaggagatggtggagatgtagctctttggtctgagaaggggctgagtgagcgggggttggggttacggatgcaggcagcactgacttgcgctgcccatgggctggacgcagcgggaatgatgtgtttggaggattaaacatttcgtgagggtggggggtggagagggaggtaccagtgttgtagctggtgatggaactctgtgtgggtgtgaggagctgatgatggttattctgtgggacgtgatgatttcatagaacaacagaggtggaaaggcctcagctacactcttatttatagagaag

SEQ ID NO: 25521 - DNA, 1033 bp, Homo sapiens
ttatctgtgggccagggtcaccccagaggcacaaacatcgatcatggcgctggctctgagatgtgtgtttagcatgctcattcatgaccaagaactgccacatttgcgaagggttctgagttacacggacctggatttataatcctgccctggggctttctagctgtgctaccctagagaggtattaaacctctttaagcctccatgtcttctataaaatggggataacaataggacctgcttcataggattgttttgaggattgaggatagtgcatgttccttagcacagtgcttggcacatggtaggtgctcaggaaatagctgcatgaatgaatgagtgaatgaccactgcattgggcagggcattgaatactgtgattagcatgctccagtgccctccttccccgctcccactgcagacaagcctgaccaggagagagagactgactggaaactttgttttctggccagtccgtgcccaaagttaatatagatctgcagcagtcacatgctgattgtgagagagggagtggagagctgtgagcttctgagtggggtggacctggactgtgcctggctccaccccttacccactgtgtgaccttgggcagttttattaatctctccatacctcattattctcatctggaaaatggggataaaaatagtacccacttcaaagggttggggtgaggtgtgaggattaatgagatgttgacattgtaaagctctgctcacggggcctggcatgtcggaggagcttaagtacaagctcctgcctgagcgaaggccacttagaggaactccagggatttcaagaaaggagagaaatctgcgggctggttgaatctgagagtaatcatcgttaagatttattgagtactttctctgtgccaggcgctcttggaagcatttttagggcattccattttaattttcacagcagcgctgtgaggtggaaagttctttctcccactcgacagctgagaaaactgaggcacagtttcgcctcaggccacacagctggtaag

SEQ ID NO: 25522 - DNA, 1050 bp, Homo sapiens
tgcataattgtgctgcatggtaattaggtgtaaatggtaagcagttcacataaatgtttttgtaattggtattaattttgcagaggcaaaccaagtttatgtggtttttctcttcttgctctgttagttttctagtacaggcatttccaagcttttggaggaattctattgcaaatgtttgtttatagggcaatgttttgtgttttctctcagaacaatgttatgaatggttatgaggttcccaagctggtttccaaatgcctctttggcccatacagtaggtgaaatgtgcaacgcgtgtgcctgtgtcggaaggcccgcccagcatcctctggctccaggtgccccagcgtgtgcagcatgaggggggctgtgtgcgtgtgtgaacctgtgcgcctgggtcatctctgcatttgtctaggtatatctctgtgtgtgcatctatgtgtgtttgtatctgtgtgtctgtgtgtgtgtgtgtgtgtgtgtgtgtgtgtgtgtgtgtggggtctgcatgactgtgagagactcctgaggccacagtggcaggtagacattctctggtaaatacattccccattctagtggcacggggcctgggctggagacttaggggcatcagctgggagggggagcctggcacagcagccgttcctaggagtgagcacaagccactctgaagtgtggtctgaagccagagtctaggtttcctaagaacatatggcttgcctttctttctgatcaagcacataataatttttaaatgatcatttattgagtacctgccacgtgccaggccctatgttaaacacttgactcagattccctcctatcttaaaatagacttatgaaatagggactctttctcaccccgctttacaacttgggaaactgaggcccgaatctctcagtgacagagccagggtttgaggcagggactgctggaggcagggcccatggttctgagatgtgctgctcagaaccctgggctcttctccctccctcggccccctccacaaatggtttgtttttgttgggacagacgatgag

SEQ ID NO: 25523 - DNA, 1033 bp, Homo sapiens
agtgctgaaggcctgcctggctcaggagggatgacaggggagagggggtgttgcaggcacctaacccccacagccagagcctggacaccaagatgctttccccaggatgcaaataccatcttccacacgaaacaacatccaggcccagatgggctgcttcaggctaccggaagctccatctcctatgggcattgaattcttttcagagggaaaatgattactagagaacctagtaattcgatgttacttacaggtctccccagttaaagtagcagatcccagggactctggtgccttctctgcacttaaccttacttgagaagccaggactctgtaggtagtgggcttggagtctctcctgcctcctgcacaggcgcgtctgcaaacaggtggaggacactggctccgtcttccctctgcttcctacttccaaggggggacagctggggtaggaccatggcataaaagaaatgggcatcaaatcctttcaccagttccaaaaagcaatatgagtctactagttctgtgacagtttgaatgggttgtgactgctttcatgttgaaaatttaaaatctctaagggaggtcatgagaactagaacttgctgggaatggagttgggaggcaggtgttgaagacaaaaacaccaggtagccatccttgtatttctgaagtaaatggagcctgtcattgctaaaggtggagattcagaagggacttataggctagaggtgggactgttgtttattcaggcagatgcttcacgggcaccaactgtgtgctgggcacgaagccccttcctcaggccttcaggcctcactggctccagggtcttagagcttaaggttggaatctggtctgggttcgaaactgtatagtgaagggtgggcttggaggaacgggctgccctatgaacacgtcagactcaggacagtgggtgcaaagtgaggccaccctggggaggaaaaggctgtggttccctactcagtgtctgttctaggtgctgagaaggatgggtccttgggctcagggg

SEQ ID NO: 25524 - DNA, 1045 bp, Homo sapiens
tgatggtattcttcaaagcacaaaagttttacttttgataatattcaatgtatctagtttttctttcatagcttgggcttttgatgtcatatctaaaaagtcattgcctaggccaggcgcggtggctcacacctgtaatcccagcactttgggaggccgaggcaggtggatcacgaggtcaggagatcgagaccatcctggctaacatggtgaaaccctgtctctacgaaaaatacaaaaaattagccgggagtggtgacgggcacctgtagtcccagctagtcaagaggctgaggcaggagaatggtgtgaacccgggaggcggagcttgtggtgagccgagattgcaccactgcactccagcctgggcaacagagcaagactccgtctcaaaaaaaaaaaaaaaaaaagtcattacctaatccaagattataaagccttccccctatgttttctctaagaatgttataatttcagctcctatgtttaagttattgactaattctgaattgatttgttcatatgttttttaatgatatcttttgaaaagcagaagtttggtcgggctcagtggctcacacctgtaatcctagcactttgggaggccgaggcgggtggatcacctgaggtcaggagtttgaagccagcctggccaagatggcgaaaccccatctctactaaaaatataagaaaagccaggcatggtggcacacacgcacctgtaatcccatctactttggaggctgaggcaggagaattggttgaacccaggggacggaggttgcactgagccaaaatcgcaccacttcactccagcctgggtgaaagagtgaaactccatctcaaaaaaaaaaaagagaagacgaaaagaaaaagaaaagaaaaagtttaaaatttcaatgaaagccagtttatctgtttggttttgtttttacatatcatggtttgggtgttttcttagagaaattttatagttttagcccttatagttactatgatccattttagttttagctcttatagttactatgatccattttgattt

SEQ ID NO: 25525 - DNA, 1032 bp, Homo sapiens
gggattacaggcatgagccaccgggcccggcccatttttgttctttaagtggatttaatttccatcttgagttcctacgctgtctgaactggtcacttaatctaggcatttccaggcaaactcgaaaccagccctcagagattcttatcctgcttcctgtgccctgagatttgcctattctggacattttatataaatgggatcatacgatatgtggtcttctgtgactggcttctgtgactggcttcttgcacgtagcatactgttttctttcttttttttttttttttttgagacagagtctctttctgtcatccaggctggagtgcagtggcgctatctcagctcactgcagcctctgcctcccagattcaagcaattcttctcccttggcctcctgaattgatggacatttgaattgtttttactttttggctatgtcgaataacgctgctatgaacatttgggttcagatttttgtgtggacatgttttcatgtctcatggatatatacctaggaatggaattgctgccagtctgtccaaagcagctgcactattttacttttttttgggtgggggaggtgggggtgtgggggtggtatttggtctttattccgtagatggcttaaagaaattcagttatctaaaatctcaggacaaatttatcccttttatcttatattcaattcagaaattgttgagattttcctagaatcacagtctgcaaatacatgacagtgaaggattggaaggtggtaataggaaaagtagctggggagacaaaacagtgcccagactgaggttttaatgttaggaaaaaagaacattaatgatactgcagaatggtcacaagagctatccctagcaccagtctttttttttttttttttttttttagttccttttattaatttcaataggttttgggggaacatggcgggaggggcagatttggttacatggataagttctttagtgatttctgaggttttggtgcccccgtcacccaagcagtgtacactgtacccaa

SEQ ID NO: 25526 - DNA, 1034 bp, Homo sapiens
cggaatgaataagatttggaagagaggtgagttataaaatgatggagcccacttaggaaaaatgaaccgtaagctggaggtccagacacaaagggcataagataggaggtgtggtactaaggacaggaatgtagatgggatctagagccgcactcgccgatagaaatgcaggccacgcacataatcaaaacatttctaacagcctcattgaaaaaccaaaaagtaataggcgtcattaattttaatagtatatcttacttaacctgatattttcaaaatattgtcctttcaacatgtaatcagtattaaaacatgatccagatactttgctgtttcctgcactaagtctttgaattccagtgtgtatgttacaattgccgtgcatctcagttcagcctagccctgtttcaggggctcggtagtcacgcgtggctagcggctgctgtgatagacagcgtaggtctcgattgcacaggcaagggtcagtgatgctagaaagtctgttgagatcattatgggatgatgaaatgaacatagctttgttttgagcggcagtttaaagttcgtagaacactctcatatttattaccttatatgatcctcagaatattgttgctgttactagtccccttttagaagagagaaaactgaggctaagtgacttgtctaaggttgcatatttggtaaatactggtgctgatactcaactttgaggccattgacttctatttcactgctttttcctcaccataaaagatgaaagagccaggtgcggtggctcacgactgtaatcccagcactttgggaggctgaggcaggtggatcacttgaggtcaggagttcgagaccagcctggccaacatggtgaaactccatctctactaaaaatacaaaaattaactgggcatggtggcgatgcctgtaatcccagctatttaggaggctgaggcaggagaatcacttgaactggggaagcggaggttgcagttgagacaagatggcaccactgcactccagcctgggcgacagagtga

SEQ ID NO: 25527 - DNA, 1119 bp, Homo sapiens
caacattttgctgtatctagtcatcttgtcctgacccattatgctatgtaggactgtctggtctctccttaaaaaaaaaaaaaaattaatgccatttaacggcacagagagcagacagcacaccattatgtactgaaaggtagaagccaggatgtggagacccgacctaaggtaacaggcatagatagaagcaacatagctgtctactggggcatcggggacagagggaaggaaggggcagggaaggattaagggaagtcagcacaggacctgcattaggaggttgcaaggagttcccttttcctcctgcctgagtggaacggagtaaataaagtattctggctgtaattttcctttcttggagatttttcaggtccttgagaagagtatttttatgactttttccaccacaaaggattgctttgttgaggaaatgtcaggtgaagcagtattgagaaggtgtccatttcacctcttggccatttggaagcaatcaaaacaagattggtagaggaggcactgctagagttgaaaagttgtaatagggaaagagggagcgtgagtgagaagcactgtgcagcccctttccgttcacccatcctctctagagagatcctgcaggagattcagcgtctccgcctggaacacgagcaggcctcccagcccacccctgagaaggcacagcagaaccccacgctgctggcagagctgcggctgctgaggtgagtagggacactctaccacttgccacatgtaatctactatggatggaacttatctgaggaaaccaaaggagtggggtagaatctgttgttcagtataaacaatcctgtgagcgcagaccactgaagagttcacccattctgttgctgcttcagatgtctgggttccattagagatcactctaagaatgtcagccattatcacagaacttggtaaataccagtctcccagctccaggaccagcagggcactgtttatacttctgtgattgctttaagaagaccactgtgctgcagtctgtctcttaacttgctaatttgtctgactttagagacacttggcgggaagaatgctttgcctttgctgtgagtatattctcctggcactttacagtca

SEQ ID NO: 25528 - DNA, 1041 bp, Homo sapiens
caaaaatgtgcaggagttgttctacaatgacccagttctgtctgttttgacaagaactctgattcttagagcagcgcatcgaccttggatgcacattgaaatcacccgagaagtttttgaaactactgctgcctaagcccagttccagacatcaatttaattggtcttggatgatacaacctgagcactgggggtttaaaaatccctctaggtgactggagtgcatggccaagtttgataaccactgaccaagagaaacgtttctggactagggataagccagagtcacctgccatgttagatgtgacccttagttgaaaaccattagttttggatagagtgcacaaggcaataattttagtttctctgttaatctatcagattcctctctgtaatctgcctcttggcaaaggaccagtactttactctttcaggccatgttttgcactttattaggccctaattagctcaacgttgaactagaaaagactagatgttgttgacactttaggcgaacttgccaaatatgagccaaatctctgggcttattaaaagttcaaaaatctgaaccctgaagttttcttgttttttgaaacctgtttggtctggaataagttaagaggaaaaaaaaaatctgtttagggaaaagttgaaaaggtgcatgtcatcatcttcctagccagaatgcagattaaataccatctctatcctaactttctaggaaaccttcttttcatttcacaacttaggaatgcctatgatgcctgagtgtctttgaaaaaaaaaatttctggttcttccttaggattcaggtttccctgattgaaaacaaccctggctttgaatttgatacagatttggaacttttcagtttgtaagtttttgttaagaccctgttaagtgttttgtttattacttcagaggtgatcaagaaacttcttgaaagagcaaattctgcttaatggcatgagagctccatgaaggaatttattagatacaccctgattctccactgccctaacacacgatactgagttgcta

SEQ ID NO: 25529 - DNA, 1026 bp, Homo sapiens
ctgtttctagaaatggaaatattgaagagagacgaggaaactttctgacttgatagaaatattccacatttcaataggggtgtgggttgcaggagtgtacatttgtcaaaacggattaaatgaaatacttttttttttttttttttttgagatggaatcttgctctgtcgcccaggttggagtgcaatgtggcacgatctcagctcactgcaagctctgcctcctgggttcacaccattctcctgcctcagcctcctgagtagctgggactacaggtgcccgccaccacgcccggctaattttttgtatttttagtagagatggggtttcaccgtgttagccaggatggtctcgatctcctgacctcatgatccgcctgcctcggcctcccaaagtgctgggattacaggcgtgagccaccgcgcccgtcaatggaatacttaagatctaagtattatatctcaattaaaacaaaaaggaaccaagaatgttgaataagggtttgattgaaataggaagtggctccccagggatttgcagtgtgtttcctgcaattttgaaatattcataataaaatgttttctcttttccttctcctttttcaattctttactttctttgaggagttatgttcacattaatattcacccacccccaaccagccacacacactcattttattcattcagcaaatacttcttttgttgctgtactgtgccagattggatactatggtggacaaatgattcctgccctcatggaactaacagtgtagtgacagagacaaacattaaacaaataatcacactactaaacataactacaaattattatgtgcagtggaggaaaaatgcagggagctgtggaagtgtagagcaggtgcctgatctattctggagagtaagggatagcttctgtgagaaagtgttacttgagttgggatctgaaaataagtagaagagaattcaatttcctaggaattgaaaagtaactgaaaaccaaagcaggccaagagctactgttgct

SEQ ID NO: 25530 - DNA, 1031 bp, Homo sapiens
ttgagcttcagaaaggtgactggggccgggcgcagtggctcacacctgtaatcccagcactttgagaagctgaggcagggagatcacttgaggtcaggagttcaagaccagcctggccaacagaggcgaaaacccgtctctactaaaaatacaaaaattagctggtggtgcacgcctgtaatcccagctacttgggaggctgagacaggagaatcgcttgaacccaggaggcagaggttgcagtgacccgagatcatgccattgcactctagcctgggagacaaagcgagactctgtctcaaaaaaacaaaaaaacaaaaacaaaaaaaaacccagaaatgtatcagtcacatacaaacataaaagaaacctaccagccatttgcaaagtggggactttgtttggatcttgactttaattgtaaatggacattttttaagatttgaggaaattggcagatggactgggatactaaaatatttttgtctgtgtttttaggtgtgataatggtgttaggttgtgtgaaatgtttttactatctgatagatgtacaggctcaagtattcccaggtgaaataattgcctggggtttgcttttagccactcgtccctgcacaaaatgttggaggaatgaaaattcgattagataacattgacaaaatgttgacattcattcaagttttgctatgggtacctgaggggtagtcattagattactctattttatgcaagttttaatatttctgtagtaaaaagttagaagaccatgtgcttaaggacctttcatgtatctataagagagagcctcactcagagtatatagtgttgccttataattaggcgcagttctaatgagtttgggatgggtaccagttttatgggagaaatagactgatgctaaaggcagtatccttatagaaataaaaatgtttaactggcaacatgaagtaacactgaaaattcttagatgtacacaaaagcttataaaagcatagcgctagggggtcatgtagtgatatttagtagattgg

SEQ ID NO: 25531 - DNA, 1056 bp, Homo sapiens
tacaatatatttgtcctatgacataacccagcacatgtctttttttgtttttgtggggggtgggggggcttttatcccttcagtgacttccccttacacttaaaagccgaagtctatacaatggtctacaaggccccataaaatctggttcctggcaacctctctaactttatttcctgccactttcccattgctctatcctcctttgttattctggttttgttccttgcaaataccaagtgtgcgtccacctcagggcctttgcaactactggttcctttgcctgatgtgcccctcatcctcatactcacatggcttatttgtttatgttattcagatctctccttaaatgttagcttctcagagatactttctgtaacttttttatctaaaatagcaccatcagtcactctgtttcctcttaccttgtttcagtttctgcatgacacttgccattatatgacattttaaaaattcatttttgtatttgtttataatctctaccctattagactgtaagttctttgaaagcaaggctttttttttttttttccccaccaaactcattttactgccagagacaaggactttattttacttcctgctctatctccctatctggcgtgggtctggcagatagtagatcttaaatacttacagaatgcataactgcatgtgtatctatatgtgttcatgacttactaatagtagtgatattcatgaggcattcaggttattaaatgatatcagtgtgtcagaatgaggcaggctttatttcttgtggggttttttttttttttttggttgttttgttttgttttttctttgagatggagttttgctctgtcacccaggctggatgaagtgcagtggtgtgatctcgggttactgcaacctccacctcctgggttcaagcagttctcctgcctcagccttccaagtagctaggactacggacacccgcagccatgcccagctaatttttttgtatttttagtagagacggggtttcaccatgttggccggctagtttcaaactgccgaccccaagtgatc

SEQ ID NO: 25532 - DNA, 1041 bp, Homo sapiens
caccactgcactccagcctgcagcctgggcgacagagtgagactccgtctcaaaaaaagaaaaaagaaaaaaaaagaatagcaaatttggaagactcacacttcctgattttaagacttacttcaaagcaatagtaatcaagacggtgatactggcatgaagatagaattgagactccagaaataaacccttgtatttgttgttgtcgatttttcaatgagggtgatgaccatccaatggaggaaagaatagtcttttcaaaatatggtgctgagacaacaactggatattcacaggcaaaagaatgaatttggatccctgccttataccatatgaaacacgaattcaaaatggattatagaccccttaatgtaagagctacaactataaaactcttagaaaaagagattagatgtaagtctttatgaccttgagttagtgccttcttaaatatactaccaaaagctcaagcaacaaaagaaaaatagacaaattggacttcaacaaaattaaagattttggtgcttcaaagggtgccatcaagaaagtaaaaagataacccactgagtagaaaatatttacaaatcatgtatctgataagggacttgtatccagaattataaagaactcttaaaactcagcaacaacaaaaacaacaccccaactaacccagttttaaaatgggtaaagggcaaaatagaatggtcgttatcagttgggaggagaaaatgggaaattattgtttcatcagtatagagtttcagatttgcacgatgaaaaagttatggcaacgtgaacatacttaacactactactgtactatacacttaaaaatggttaaggtggtaaattttatgttgtgtgattttaccagtgaaatatgtagattaggctgggcatggtggctcatgcctgtaatcccagcacttcgggaggctgaggcagatggattgcttgactccaggagtttgagaccagcctgcccaacacagtgaaaccccatctctacacaaaatacaaaaattagccaggtgtggtggt

SEQ ID NO: 25533 - DNA, 1073 bp, Homo sapiens
aatttatttctatgtatggtataatgaaaagatacaatttttttttcaatttggatgaccagtttttcagcactctaactttttttattatagtaaaatacacataacataaaaataacaattttaaccattgtaagtgtacagttctgtagcatgaaatacattcacattgttgcacagccatcaccactgtctccagagctttttcatcatccccaactgaaactctgtaccccttaaacaccagctccccattcttccctcagcgcctggcaaccaccattctactttctgtctctatgaattcgactactctaggtacctcatatgaatggaatcattacaatatttgcccttttgtatctggctgatttcacttagtataatgtccttaaagttcattcatattgtagcatgtgtgaaaatttcctttttaaggctgaataatattccatggtatgaatataccacattttgtttattcattcattgatggacatttgggttgtttccccgttttggccattacaaggagtgctgctatgaacattggtatctgtatgtctgtttaagtctctgtttccatttcttttgtgtatgtactcaagtgcaattgtcagtaatacagtttttaaaacaatatacataatggaataaaaatagattaacacaattttgaccaatgtggctgaatagtatggagtttccatatacccactctttcccatatggtttctcctattattaacatcttgcattagtatgctacatttattataattgataaactaatattgatacattgttgttaaagttcatgatttagagttcactctttgtattgtatagttctatgggttttgacaagtgcgtaatgtcatgtatcatttacatggcatgactgcatgctacaaccctgcaaggggctcacttgtaaaatactcaacagtacagacagaataaatgtcattacatggctatagttttaccttttccagagttggaaatgtcatagatttggaatcatgtagtatggagcctactcagattggcttcttttgcttagcagtatg

SEQ ID NO: 25534 - DNA, 1488 bp, Homo sapiens
aagactagcctagccaacatggtgaaaccccatctctactaaaaatacaaaagttagccagacgtggtgacccacacctgtaatcccagctactcgggtggcagacgcacaagaatcacttgaacccaggagactgaggttgcagtgagccgagatcacaccactacactccagcctgggagacagagcaagaccctatctaaaaaaaaaaaaaaagacttcctagggtcttgggggttctgatttgtaattttttgggataggacccagagcatatatattttaaaattgcgcaagtaaatataataccagccagagatgagaatggctggcaaacattatgtacatactcctttatgtgtatgggcatggtgggggctcctatagatcacacattgtcttccttccagtgctgtctagaagcctgtgtaatttgagataatccagcccaagtgtgtgtgtgtgtgtgtgtgtgtgtgtgtgtgtgtgtgtgtgtggaacagagaagagcaagtattttcccctggaccttggtagtaaagctaagaactaaaagacagtagtggtatgggtggctggcttgcttgcttttctcttctttctcaaacataaatacactttttaaaaatgcaaataccatagaaaactttgtatcataataagcacttgtaatagtggcattaggagggagttgagataggaaaagaggtgtggggatttggggtgagagtggaagcagtcgtctttggcaccaatagaaaaagtggatgcaaggaccctagagacaaactagtattgctgtctccaaggtttggcctctcggccatagaccacccatgtttgtcacaggtactgtagtgttcatctgtttttaaaatgtgagggctaatgaagttttgttattcttacaaatgaaaactaagctctgttgtttttttcccctctacttctttcagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccaca

SEQ ID NO: 25535 - DNA, 1028 bp, Homo sapiens
ggctcacgcctgttatcctagcactttgggaggccaaagagggcagatcacgaggtcaggagttcaagaacagcctggccgatatggcaaaaccccgtctctactaaaaataaatagctgggcatggtggcacgcgcctgtagtcccagctgctcgggaggctgaagcagaagaatcgcttgaacccaggaggcggaggctgcgtgagccgagatagtgccactgcactccagcctaggcaacagagcaatgactctgtctcaaaaaaaaaaaaaaaagccaggtgtgtacctgtagtcccagctacttaggagacagggggataccttgagcccaggaattcaaggctgggtgacagagtgagaccctgtgtcttaaaaaaaaaaaaaaaagaatttgagattgtaaataaatagatgtaaataaaattaatatgtaataatcagccaccatgtacataaataataatgaaaaagaatatatttgcggtaacaacatcaacaacaaaaaaattctgagcatcactgttttttttcttttcttttctttttgagacagttttgctctcgttgcccaggctggagtgcagtagcaccatcacggctcactgcaacctctgcctctcgggttcaaacgattctcctcctgcgacctcccaaagtgttgggattacaggcgtgagccaccgtgcctggccaagcattacttttttaagatatgtgcaaaatgttgaaacaactcaatacccaaaaagataaaattgcattcatttctcacactccaggacaaattccaaagaaattaaagttataataaatgtaaaatatgaaaccaagtactacaggaaaacatgggtgaattaatttcttttctttttttttttttttttggagatggagtgcagtggcatgatctcggctcactgtaagctcctccttctgggttcacaccattctcctgcctcagcttcccaagtagctgggactacaggcgtccgccaccacctcaggctattttgtatttttagt

SEQ ID NO: 25536 - DNA, 1022 bp, Homo sapiens
gatctcggctcactgcaacctccgccttctgggttcaaaggattctcctgccttggcctcccgagtagctgggattacaggcgcccgccaccacacccaactaatttttgtatttttagtagaggtggggtttcaccatgttggccaggctggtcttgaactcctgacctcgtgatccacccgccttggcctcccaaagtgctgggattacaggtgtgagccactgcgcccatccagcccgccgcacctgtcttgtctttgtattttcttggcagtttctttctcagatcagaaatgtttaatgaagtctagtgtatcacattttttcttttgtgaactgtgtctttggtcttgtatctaaaagtcatcataaaacccctagattttcttcaatgttatgttatgttctgggagttttagaaattttcatttttgtttaggtctgtgatccattttgagttaattttttgtgaagcgtgtgagacctgtatctggatttcttttctttttgacatgtggagttctagttaggaatttaattttgattttattttaactttaaatagccacatgaggatagtggctaccacaccagacaacattctaggttttacctggatttgttcttaaggtcttaagtcatccatagccttttaggatgcttttattttacttgcctaaactttgagcacttaatgctctaacaaccctccttaggaaaagaatgcttttcatttctactagcaaacactgaatttagtctgctggtctttgctcttattccgtttggtgtctacttcataactcacctgaaaagctttcgttagggaataatgtctgttgctgcagcttccctggaatggattttccagttaaggatatgaattattgcctaattactgctaattattctgtagcttcttgtcagagtctattcaaagagggcaaatcttgtttatcccaatatttataatttagctgtacatggcaaggcaaattttaaaccaactcttgatgattcc

SEQ ID NO: 25537 - DNA, 1033 bp, Homo sapiens
tacctttagactcccagtcagtgctaaatcccctcacatctgatttcttccctccgcattaagtggaatccgaatttacaaagctaattaaacatccctttgttgacaaatacaggggatacatttctgttgttatctcagcttctaggcagcatttgacattgttgaccacctaaaccttagaatacttttgtcttttctgaaacagcagtgttttctggttttcttctcatctctctggtcatttagtttatttcctagtttttcttctctggctcttaaacgttgatatattgttctatagcagaagccctcatctcttctcactctatattggctgatctgatttactggtatggcacaagttaccctaattaaagcttttgggcagtaaatgagccttttaacactgatagaactttatatatagatcactgtgttacttatttggacatttaaaatgtagcagtcatatagattatacaaaattcagactctgcacatctgtatatctggaatgaactcataatgtaatagtaattgaaatattcccgttatttaggctagaatcaaacttgaatcttagaggcaactcagttattctcgagtgttagaaaatataatttttaaatcctttttattaactgaattgggaatctacaagctaagaagtaaatatattaagcaccctttaaaaatctagctttaaatctatgtagtgttgattttagttattctgagtggttattcatattgtcataaagtagtttctaaaaattgtactttaaagtttccatgagcagttcagtggaatgaggtttgtttgataaacactgccctcctgtggttaacgtaagctaacagttttgcaaaactactgtagtcatttccgcttgtggaagataatgtaatggttcatacagcatgtttgctcagtaatatatgtggccaagaaagggtttttttccctcattctctccctcttggttttttcctagtgtgtctgcacattcttctcatttctatccatgca

SEQ ID NO: 25538 - DNA, 1047 bp, Homo sapiens
tttgccatatgctgtacttgccttttatcattagatgtggaagcactgaggagcacctactaggttaagctacaaattgctgtcaccttcagagccaccgaagtggttggctcttctttttgaggaattataacagggttctgagagttggattctgctgatgacaagttggacaactcagcagcagcagtggctcttttcattaattagctgacaaaaccttaggcaagttatttaatttctctgcacttcagttttcacatctgaaaaaaaatgggctgatagtatctacctcataggtttattgtaaaggttaaataagctaatatatctaaatcacttagaatagtgcttggcagttaaatgctagataagtattaactgttagtgttattaactctaaagagtttgaagagagtttggttgagagctttttttcttgaactagggagtgtgtataacctccagactttttggataattaaaagaatccaagctaggaaagactaaacccaagtgacttgatagagctgttcagaattgagggacccctaggtaaactatgcccatgagcttacaatgtcagcttctgtaatcttctctgtatatctgtaggtgcctctctgtataggtttcgtatttaagtattctcagctacttttacactcaagtttctgcgcccaaatctgtaaatttatttgcattttccctcaccttttatccttttttaaaaagaggcatttttactagtgtctgaagctaatcttgccacatatgttcctaattccatcagccaaccattaagtgttttagatctgtcatataataggcactagtaatactagatgaataaggctgggcatggtggttcacacttgtagtcctagctacttgggaggctgaggcaggaggattgcttgagcccaggagttcgaggctgcagtgagctatgatcatgtactccagctataaaactgcatgccaccttgggcgacagagtgagtccctgtctcaaaaacaaaaaaacggtgcactgtgataagcagt

SEQ ID NO: 25539 - DNA, 1029 bp, Homo sapiens
cctcatctagataattaggctgaccagttcatagggttgtaatggattaaatgtaaggaataagtggtaaatgtattgaagagcaggtagataatgagcagccaaaaattacagatatcacttgttgtaccttatagctaaagtgagagggagaaagcaaaactataaattaatgaattagacttctttcaccacagttctgttgggaagactatgtaactgttagctcaatgaggggtttctctgaaaccttagcacgcatcagaatcaccaggagggattattaaaacaaatctgggccccacccatggagtttctgattcagtagggctgggctaggcctgagaatgtgcaggcctaacgctcccaggtgatgacagtgcttgttgggtccgggtactacacttggagaactgctggtttaatgagtcttaagtgcatctgactgttgaggagtgttagttaaacctagtatcctggtggtgagacccatctgtgtaaaatgcaaatacttctctgacagcccaacacattaattcttctgcctgccccacccccgcccaaaaaaactggatcctcttatctaaaccatcagtatcattaatataagtggaaccttcatccgtcgttccccaataaatctagtttggcctcgagctgtggttttggcactgattgttgggaggatcagatgtctgtagtgaaaaaccttagaagcaaatggaagaggaggattccaatgtgctctccctaaacatactaaacttttatcaaagacccatggaaccaaaccactcagctatgtcaagcagtattcctatatcacagccacctttctttctagtgttttcctagcagagaaggaatgctctcaggttcctcacccgcattctccgatctgttggcttttggttccccttgccaggtgattggcatgcactacttctctcccgtggacaagatgcagctgctggagattatcacgaccgagaaaacttccaaagacaccagtgcttcagctgtagcagt

SEQ ID NO: 25540 - DNA, 1049 bp, Homo sapiens
tgaaacctcgtctcaactaaaaatacaaaaactaaccgggtgtggtggcacgcgcctgtagtcccagctactcaggttattgaggcaggagaatcgcttgagcctgggaggtggggttacggtgaaccgagattgtgtcactgcgctccagcctgggcgacagagcaagactccgtctcaaaaacaaaaccaaaaaaacccttcatacttgtaaaacttagttaattgtggaaagccataaaatgtgacttcagtgcaagctaataatagtttataaactgcacttattgtttatcagttcagatataagcaaactcaaaatgacatgattgattcttaaaattgttttctacctctgatattttctttaaaagcactttttaaaacagtaacttttaattttgtgaaagcagttacaatttgctgcttctctgcataaggttgtaacaagtttgaatcaattataaattcatctgataatttataagctgaagcataacccagaaattggtttatactttgacatgttactggctgtgtaatctcagacaacttacttcacttagccccagtactctttttcaaaaagagggtatttgggccgggcgccgtggctcacgcctataatcccagcactttggaaggccgagtcgggcggatcacgaggtcaggagatcgagaccatcctggctaacacggtgaaaccccgtctctactaaaaatataaaaacaaaattagccgggcgtggtggcgggtacctgtagtcccagctactcggaaggctgaggcaggagaatggtgtgaacccgggaggcggagcttgcagtgagccgagatcgcgccactgcactccagtctgggtgacacagcgaggctctgtctcaaaaaaataaaaaaaaaaaagatcatttgatcctaagatctaattcgatccattagaacctattaggtactacgatcctattcatctctgaaattcagtgaaactgtatatcatataacttctctgagattaagtcatctcatctgggaaatcttgtcttaccta

SEQ ID NO: 25541 - DNA, 1028 bp, Homo sapiens
actgcactccaacctgggcaacaagagctaaactccgtctcaaaaaacccaaaacaacaacaacaacaaaaaacaaaattgaatgttcactggctgagggttagggtgggtggagagaaaatgccagttgtgtggatctgttgatgtaaaacaaaggcctagagggtggtaaactggaagcagttcaatgggacagtgcttgatgggactttggaggtgatgaggtttgatatagtttggatttttgtccctgcccaagtctcatgttgaattgtaatccccagcgctggcagttgggcctggtgggaagtgtttggatcatggtggtggatccctcatggtggatcccagttctcatgagatctggtcatttaaaagtgtgtggcacctccccaccacctctctctctcgctcgcttgctcgctcctgcttttaccatgtgatgtgcctgctccccctttgccttccgccatgattgtaagcttcctgaggcttccctagaagcagatgtcagcattatgcttcctatacagtctgcagaactgtgagccaattaaacttcttttcttataaattacccagtctagatgtttctttatagcaatgcaacaatagcctcttatgagtttggaaagggatctgagcccatatgccaaggaacttgcctgccaaatctggactttatccttcaggccctgggagaccagtgagagggtggcataatccactcttttggaagggtaaatgtggctgtgtgaagtgttggtaggggaaggcagggggtgggagatgagcatatcttgctgcctccttctacctgtcctccagcccccttaggcctgaccatggctgactttgcatccggtagctctgagatacagtgcctttgccaaggaccatatttgaactgatcattaatcaattcattttgcagatcattggtttaggtgtactcaggagaccaacaacaatatcttctctttgtttgacccctcctgtgtcacatgtatgatcacagaagagaccat

SEQ ID NO: 25542 - DNA, 1033 bp, Homo sapiens
ctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgaggtgagcagggacagaagggagaagtgcgtgggacacgggttggggtggagaggagggacaggcacataggaaggacctgggaccctagacctcctccacctaatgagagggacagaaaactcattgtgtgtttataattctttctcagtgatgttaggtataggggcaggattggagaggagggtgctatgccgagtaggactcagagtgggtatgggttggatattccctcatgttcctgagcatcttgagggaatttgtctgtgagttgtcggggtgaagtcaggagaaaaatctttttttctgtatacccagtacctggagcttcgattcaataaaactgtgcgagtgtgtggaactgtgaccttcatctttcagatggtaagcagaatgaggatagaaaccgagcctagggcatgttgggggacctgaacgcaagcatgctgagggaattggagtctcccctgctctcagattggcaggattgaaattcctgctagaggttagcatctgtgaggaccccagaggcatcctgctgcccatgccttccaattccagcacagatactgtggtggcagcaagccagaatttgagaggagaaggaagagggaagtgagcctaggtgaggggaagccatgggcatattggcgctgaggcccatctttcttcctctctcttcccaccattctccggcccccatcacattttttccacatgcaacaggtgatctacatgggagttgtgctctatgctccgtcattggctctcaatgcaggtgaggagtcacacagcccctggctttcagccgtggtaggttaggaaagcacctttgggagaggcagatggaggagcgtatgtggaa

SEQ ID NO: 25543 - DNA, 1898 bp, Homo sapiens
ctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgcatctttcagcctgtgtgctgactcctcaggagggggaagtcaaataggtcacttgagaacaacagaatccctcctgtcccttcccagcctctggagtgacctcccacagacctcctgtcccttcccagcccctccaccctcagatggagggtaaaagccaccagtctctttactccccttcccctggctcacagcatgcctgggtccttggctcagggacagtcccatgtgccctgggcttggttgcaggagaatgctggaaggtaaggagccaaggaatccctgggagtcagtcgttctcagaggtccctgcatgccagtgggcctcaggctggctggagggaggctgggtccctttgagggagaatggctagaccatagcactgatgtgggcttggttctcaggccatctaaggtgtccagcggtagggacccctcaaccctgatagcagccaaccctgagtccaggtttaggctgtgaacaccaaggacctcttttacacctattccccctttgtcttaagaactgcatattttgacacattaagtcttaaaatcaggctcattaagggattgttgattttctctttaaaaaaaatcaaactcaagctggacatagtggcctgtgcctgtaatctcagccctttggaggctgaggcaggaggattgtttgagcccaggagttcaagaccagcctgggcaacctagggaaacccctgtctctacaaataatttaaaaattagctgggtgtggtggtgcatacctgtagtcccagctattcaggaggctgaggcaggaggattgcctgagcccaggaggtcaaggcagcagtcagccatgatcatgccactgcacttcagcctgggcaacagagcaagaccttgtctcaaaaaaaaaaaaaaatcaaactcactgggtttggtggctcatgtctgtcatcccagcactttgagaggctgaggcaggaggatcgcttgaggccaggagttcaagaccagcctggtcaacatagtgacaccctgtctctacaaaaaaaattaaaaataaaaataaattagctacgtgtggtggtgtatgtctgtggttccagctactcaggaggctgaggtgggaggatcacttgagcccaggaggttgaggctgcaatgaactatgatcatgcaactgcactc

SEQ ID NO: 25544 - DNA, 1046 bp, Homo sapiens
ggcaacttaagaattcttcagaccctttctcagagtcgtcctgctgtttgggacagtacatttgacgttttccctttattttctgagcacctaccagtagcttgcttagctgcatggtgaggggatgggataacaaaggtatctaggattctatccttggccctgggaggtcatgcctcgcagtgttctgggaagacccccaccactttgggagtttcagggagagacgaggcaggactgggggtgcccagagctgctccatggccagtagccgaggtgagccacgggtttccatccccaaccccagctctcagccatacccagctgccactgactaggctgctcaggggcagggccggccgggcagagggtgtggaggaagaacgcaacagtgagtgtgcagccagcatggacgtcagagccagttctgggccaaggaatggggcagaaggatgtgtttgtccagtgctaattgagggcacagggacagtgtgactgtgggtctggaggggggctctcattactcggtgagatagacaggtgagctggaaatcacacggtcactcccaagtggcctggtaagtgtgtatttgctagaaaccatcacaccaccataatggactgggggctctgtaaacagtgatgatttctttcatcgtttctgggtgtgggtgtctaaatagggctgcttggagctgggtatctgtgcagttggggcaagggaagcaggtgcagagtcctggaagggaaatgaccactatatccattgccaactcaatctaaggttgtgaatgggggaaatcttggtttagctgattgtgctaagaggtggccaagactctttgttgtggggactcttatcagctcaaccagtcatcttcctgcttatgaccatttgagcactcttgttttattactttttttttctttttgagatagggtcttgttctgtcgcccaggcagcagtgtaatggcgtgatcactgcagcctggacctcctgggctcaaacagtcctcctacttcagcctcctgagtagctgggact

SEQ ID NO: 25545 - DNA, 1034 bp, Homo sapiens
gggcaggaagtggtcccaaattgatctgctcagaggcaggctcccttccccctggccgctggatctgttcgggagtgacggcatgagaactggcacctacccaggggcatgatgtcacacctgcgccagcatctgctcgctgggctccacgcccagcctgtcattgggcatcactgcccagcagcccctagccctgccccatcaggcctctggccattatgtgtctgcaggcctccagtcccaactccctagaaacaagtccaaggggagggggcccagagcactggagagtccagaccaaccaaatatatccaggagatctcccagaggctggggtggtttgggtctatttgggctctgggttgggaaatgtgggatgaggaatctgaatgtctgggtccttcctgcccaaagggtcacttgggctggaaaagcaggcttgctctatgcttgctccaaagccttataccaccttggagttgctgcaggcacagggggcctgatcatctgtgggcaaaggaatccctgggcaccactcttctgaaatgaaccgtcagggactgcagatctacataccacctactcacccctactgctgccctgtcacttggtagtccctcaggcttgatgggcacagtctgggggacttgaatccatctttctccaaggctgcaggcttccagaactatggggctagaagtcagggacttggcttttcattccagctctgcctctagcttgttgtgtgactgttggcaagtcatgaagagtgaaaacacacacttctctgtttctttcccaggaatattgctgtctgccatccccacgaggtgacaaggagcagaatgatggaatttgggggagtaaagacagagaggaagtgcattagtctagggaatgtcctttgatatgcaggccctttggggcctcacttgggcaggaacacccagcaggggagcagccacaggggcctcctggtgccactgacctctgagcccatctcagcccatgccaggaataccctggcctccttg

SEQ ID NO: 25546 - DNA, 1050 bp, Homo sapiens
tttcttaattcctaaacttgattgagtgcctctaccagtccatttatcttagtctcccctccaattgctgaattatttatattgcatggctataattcatcgtcaacaaactttttcaagaaaggttcataggtgctgcattcattccctgagtggctcagccttctgagtagctgagactacaggcatgcgccaccacaccaggctattttattttttttgagacagggtctgtggggtccaggctggagtgcagtggcatgatcttggctcactgcaacctctatctcccgagttcaagcagttctcccacctcagcctcctgagtagcagggattacaggtgcataccaccaaaggccagctaatttttgtatttttagtagagatgagatttcaccatattgttcaggctggtctcaaactctggacctcaggtgatatgtccaccctggcctcctaaagtgctgagattacaggcatgagccatcgtgcctggcctttttttattttttagaggtggggtctcactatattgcccaggctggtctcaaactcttgggtgcaagtgttcttcctgcctttacctcccaaagtgctaggattacaggcatgagccattgcacctagcaacattgtgttgcttttgactttttgcctgttctctttgtcttggggcagagttagcgaacattttcttttttttttctttttttttgaggtggagtctcgttctgtctcccaggctggagtgcactggcgtgatctcggcttactgcaacctctgcttcctgggttcaagtgattctcatgtctcaccctcccaagtagctgggattacaggtgtacaccaccacactggctaatttttttttgtatttttagtagagatgggggttttaccatgttggccaggctggtcttgaactcctgacctcaagtgatccacccgcattggcctcccaaagtgttgagattacaagtgtgagccactgcgcctggcttcctagagtttttatgcttttttttttttttttttgagacggagtct

SEQ ID NO: 25547 - DNA, 1031 bp, Homo sapiens
tgggcgtggtggtgcgcaccttgatcccagctactcaggaggctgaggcaggagaattgcttgaacccaggaggtggaggttgtagtgagctgagattgccccattacactccagcctgggcaacgagagtgaaactccgtctttaaaaaaaaaaaaaaatggaagctttatttgtttacttgtttattgtctgcttcaccaaaatgtaagttccatgagggcagggaccttgtctgtcttgtttattgtcatatcaccagtttccttttttgtttttaatttttttattttattttattttgctagagaaggggtcttgctgtgttgcccaggctagcctcaaactcctaagctcaagctgccttcctgcctcagcctccctaagtgctgggattacaggtgtgagccaccgcacctggctcatattaccagtttccagaacagtcctgacatatagaaggtgcttagtaaatattgttgaataagtgaataatcagggaacttggttatgagtgtgagaatgagggagaaaagatggggaaataaaaatctgagctagtacaaatagtttttgtcctctactcatttgtgtgtctctgtatgcaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccaggtatgtaccttgtcctcttatctttttattccccatgccaagcttaagatgaaagagcagattgagctcataggatcttacaaacctgggtacagtgtaatcttttccatagaggtttgagttctggtcccatctcacagacccatattcttc

SEQ ID NO: 25548 - DNA, 1028 bp, Homo sapiens
actgcactccagcctgggcaacgatagtgaaactccatctcaaaaaaaaaaaaaaaggaaaagctttcttaacataataggatgttccttaattgtcccatagtctacccaccacccccatccaggtgaaatattgatagcagggcaccagagaactctttgactcattcttttttttaaagacagagtctcactctgtcacccaggctggagtacggtggcatgatctcggctcgctgcaacctccaccccacgggttcaattgattctcttgcctccgcctcctgagtagctgggattacaggcgcctgccaccatgcccagctaatttttgtatttttagtggagatggggtttcaccatgttggccaggctggtctcgaactcctgacctcaggcaatacgcctgcctcagcctttcaaagtgctgggattacaggtgtgagccaccgtgcctggccaactcattctttttaaaaaataaattcatttatttatttacttgagacggtgttgctttgttgcccaggctggagtgcagtggtgtgattacagctcactgcagcctcgacctcctgggctcaaggagcctcccaagtcttcagcctcccaagtagctgagactacaggtgtgcaccaccatgtttttttgtagcaaaggagtctcactctgttgcccaggatggtcttgaattcctggactcaagccatccttctgccttgtcctctcaaagtgctggaattacaggcatgagctatcgtgcctggccagaaaattatttttaaatgtttttatttaaaataccatacccaggctggagtatggtaacaccatcatagctcactgtaacctcgaactcctaggctcaagcaatcctcctgtctcagccttccaagtagctgggactacaggtgcgcaccaccatgcccggctaacttttaaaattttttgtagagatgaggtctccctatgttgcccagactggtcttgaactcctggcctcaagcagtccttcttccttggcctc

SEQ ID NO: 25549 - DNA, 1064 bp, Homo sapiens
gtgcctcagtctcctgagtagctgggatcacaggcttgtgccaccatgcccagctaatttttgtatttttactagagatggggtttcgctatgttggccaggctggtctcaaattcctggcctcaagcaatctgcttgcttcggcctcccaacatactgggaatacaggcatgagcctgtacctggtcctattctttcttttaatggatgagtttaaatgatatgtgtttattgttatgatacatgttttcggtttttttgtttgttttttgttttttgagacagagtctcaactccaggctggagtgcaggaacgcgatctctgctcactgcagcctccacctcccaggctcaagtgatcttctcacttccaattcctgagtggctgggactacaggtccctgctgcccaccatgcccagctagttttttttttttttttccctcagacggagtcctgctctgtcgcccaggctggagtgcaatggcactatcttggctcactgcaacctctgcctcccgggttcaagcagttctcctgcgtcagcctcccaagtagctgggattaaggcacgcggcaccacacccagctaatgtttgtattcttagtagagacagggtttcaccatgttggccaggtggtctcaaactcttgacctcgtgattggcccgtccgggcctcctaaagtgctgggattacaggcgtgagccactgcacctggccctgttttggtatttttctgtagagacagggttttgccatgttgcccaggctggtctcaaactcctgggctcaagggatcctcccacctctgcctccctaagtgcagggattacaggcatgagccactgggtcctgccctaaactcacccttttataatgacactgatctgactggtcagggtggagcccttgtggcctaatcatctcttaaagatcccacctcttaatactgttacaaatgggaattaaatttcaacatgagttttggaggggatgttcaaaccctagctcttggatttcacaatccatttgatgtttttgaaagtgcaggaattttttgt

SEQ ID NO: 25550 - DNA, 1034 bp, Homo sapiens
gtgcaagagaagattgtgctagcagctcaggcaatttcacgctttgcttaccagaagatcagtaatggagatgtgatcctggtatatggatggtatggtccagaccttgtgactgagcagattgggagttggaatgatctgaagaagggactacccacttgcctttgggaataagttagtcatcagttactgacatttataactgaatcctcctcttcattcactctagctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtaagtacagaggaaaaggactccaaagttggcggtgaaaaggtgtagtagtatagacataatctcaccttcccaaagttacagttttgtttttgttttgagataaggatggagtgcagcgacgtgatcacagctcactgcagtcttgacctcctgggctcaggtgatcttcccacctccgcctctgagtagctgggactactggtgtgtgccaccatgcccagctagttttttatttttcttgtagagatgggatatcgctacattgcccaggctggaactcctgggctcaagcagttccccctgtctcggcctcccaaagtactgggatcataggcatgagccactgtgcccagccacaattatttaaaaatattagaattatatagccctggcttggtgccatggctcaatgcctgcaatctcagcactaaggcaggaggatcacttgagcccaggagttcaagaccagcctgctcaacataatgagaccctgtacacacacacacacacacacacacacacacacacacacacacacaccccaccccacccccaccccgggcatggtggcatgcgcatgtagttccagctacttaggctgaggtgagaggactgcttgagtgc

SEQ ID NO: 25551 - DNA, 1026 bp, Homo sapiens
ataaataaaaataaaaaattagctgggtgtggtggcacgcacctgtactcccagctactcgggaggctgaggcaggagaattgcttgaacccgggagatggaggttgcggggagccaagattgcgccactgcactccagcctggcgacagagtgagactctttctcagaaaaaaatatgataattaaaagttgagacgttcttcgccgagagtggtcggggtttcctgcttcaacagtgcttggacggaacccggcgctcgtcctgcaccccggccggccgcccatagccagccctccgtcacctcttcaccatgccctcggactgccccaaggcccccgccgcagctccagcgccgcgtagccaccactgccgctgccgccgcctctccttagtcgccggcatgacgaccgcgtctacctcgcaggtgcgccagaactaccaccaagactcagaggccgccatcaaccgccagatcaacctggagctctacgcctcctccatttacctgtgcgtggcttactactttgacagcgatgatgtggctttgaagaactttgccaaatactttcttcaccaatctcatgaggagagggaacatgctgagaaattgatgaagctgtagaaccaacgaggtggccgaatcttccttcaggatatcaagaaaccagactgtgcggggagaatgcgatgggagagcgggctgaatgcgatggattacatttggaaaaaattgtgcattttgcattacatttggaaaaaaatgtgaatcagtcactactggaactgcacaaactggccactgacaaaaatgacccccatttgtgtgacttcattgagacacattacctgaatgaacaagtgaaggccatcaaagaattgggtgaccacgtgaccaacatgcacgagatgggagcgcccgaatctggcgtggcagaatacctctttgacaagcacaccctgggagacagtgataatgaaagctaagcctcaggctaatttccccatagccatagggtgacttacc

SEQ ID NO: 25552 - DNA, 1049 bp, Homo sapiens
ctctgaccacccaggctggaatggagtggcgcgatcttggttcactgcaacctctgcctcctgagttcaagctatcctgcttcagcctcccgagtagctgggacccaggtgtgtgccaccactcccagctaattttttatttttagtagagaccgggtttcaccatgttggccaggctggtcttgaactactgacctcaggtgatctgcctgcctcagcctcccaaagtgctgggattacagtcatgagccactacaccctgattctttttgctggctttctttctttttttttctttttttttttgagacggagtctcgctctgttgccaggctggagtgcagtggcatgatctcggctcactgcaacctctgcctcccgggttcaagccattctcctgcctcagcctcccgagtagctaggactataggcacatgccaccatgcgcagctaatttttgtatttttagtagagacggggtttcaccatgttggccaggatagtctcgatctcttgacctcgtgatccgtccgcctgggcctcccaaagtgctaggattacagacgtgagccaccacactcagcctctttttgctttcttgatggtgtcttttgaaacaaaagtttttacttttgataaagtccaatttgtctattttgtttgtttgtttttgttaagaagctttgcctaacccaaagtcacgagaattttctcttaggttttcttctaagagttttatagttttagctgtttctgtgatccattttgagtgaatttttgtgaatggtatgagggagtgatccaacttcattcttttgtgtgtggatatcaagttgtcccagcactatttgtttaaaccactgttcttttcccccattgaattatcttggcatcattgtcagagataaattgaccgtaaatgtgagggttttatttctgaactctcaagtccatttcattggtctacatgtccctatgccagtaatacactatcttggttactgtagctttttagtacgttttgaaatgtttttaaaatttgtttttca

SEQ ID NO: 25553 - DNA, 1053 bp, Homo sapiens
gaggtgaggaagagtccctttccgcagcacgaggcaatgcagtagaggataacaatgagagaacccaaagcaggaagtggaggcaagttcaccagatccttctttctgggctccaaacagcatcatcaccttgaaggggaagagaacagtttactttcccattttcattccagtgtgacacagatatcgcccttcaccccagatatataaagtgagtctctagctgtgttccagtcagcgtgattcttcatgaataatgctaacatagttatgatataaaattgctttgcattgcagaaatgtgaggcccttttggattccactgtttggggctggtctttctttttaaatggtagaatgtatgagacacccatactcatcttttcttctctattattacaaggttgtatcgcaggctctccaccatcccagccaaggtttgttctttcctcattcaagctgctttaagtctgttgctctgaccttttgtatctacctcccatcaactacagattgctgaggagctctatactaagggagatcggacaaaagatgccatagacatgtacacccaggctggtcgttgggaacaagcccacaaggtagggatgggtggagttcatgataagagaactctgccttagtggcattgtggcctcattccttgatacctgtttctcctcttcgcttggctccctgaaagctgacaaagagtaccaaaaaacagtctgagccactttgatccctagccatagggaaaggaagggatgaagagaggcccttgtttccagacctatctatcattctgaaggagcagatgggcttgggagctggggaatctgaactaccactcctaatgcctctggtcacattgatgactttgttcttgcgcctacacttcagagtccagtggttaccgtggtaatgggagtgtatgccccagccaaggcatcgcagaccttcccaccttagcagaatatagttcttcctctgcttcttatggacttggaattccccaacctcactagtagagtggcaatacccaaactcctg

SEQ ID NO: 25554 - DNA, 1077 bp, Homo sapiens
ctgtagtcccagctactcaggaggctgaggcgggagaaaaaaaaaatacggctttatcattttcctttttttttttttttttttgagacagagtcttgctctgtcatccaggctggagtgaagtggcgcgatctcagctcactgcaagctctgcctcccgggttcacgccattctcccgcctcagcctcccgagtagctgggactacaggtgccagccaccacgcccagctaattttttttgtatttttagtagagacagggtttcaccatgttggccaggctggtctccaactcctgacctcaggtgatctgcccaccttggcttcccaaagtgctgagattacaggcatgagccaccatgccctgccgattttactttttaattaaaggaagattgttttttaaattggtcttcacaattatggacaccagtggacatttggtctttagcttaagcatatataacaaagtggggcccattgttcattaataatggatatcactaaaacttataaataggctttgatcaagagaccccctgaaaccatcccagccaaccctaattggtctgctctaaatgtgatagtttctgataatgtctagaagattcaaaccaaactaaaatattcatcctctgcagtgaccagcctaactttagtcagaggtttgtctgttgccttccccaccatccacccttgcagtgctcttacacagtaggcattcaaatatacgggtgacttcttagagcatatgaccatcaaggtcattgattcatcagccttgtctcactgctgtattgtatcaggcttatctttaatgtgctcagtgctgccttcgaggggattctgtgagtaggagaagccacttgctcaatagttctagtctgctctgaggtaactccataagccccagagagtgatgacatttctgtgggtctggaccttttgagttaacaacatagttaaacaaaacctctacaattctaaaagagacctagcttcctaggcatcctagcaaaattatgtgtgttggccatactatgtatatgtgtggaatctctcttcttaaccctgtct

SEQ ID NO: 25555 - DNA, 1044 bp, Homo sapiens
ttaaaatccaaggataactgctgtgacatagacttgcaaagcactgtgagaatagagaaagggagatgcactggtgaagtgacggacggtggggacttatgctgtacttaaaaatgaatatgagtctgccagggatgtgcaaggttggcagagcatttctggcagagttcacagctgaaagtgtcaattgtggaaatgtacagcattctcaagaaactgagtagtataatgttgttagaacaaaggtagtcatttcacccaggaagctcctcctttgtgcttccagtaccccaggtccatatacctctagaacagtacttaccatgtttcatattgaaatattctgcttctgtttctcttcctcacttcagggcaaggatctcacattatcagtctttgaccgacacagaatgcctggcatttgataaatgtttgttgaacttgaagagacatatggacaatgaatctgcaaaggtgagttgaaaccagattgtgaattttgttgaatggtaagccaaggaattctgactttttccaataggcaatgggaagccatttgatttaagttttaaaaagagtaagtctagcagcagtgtagagaatagatgacatacaaagagagattggaggaagggataccagttagaaggcagcagaaatctctcacgttctatatgtcaaaagttgaaagcataatgccatttagattaatggttcataaatttttccaccaggatcatgcctaagacacacagagtaagaaccacttcttattatctttaaccctactagtttttctcctattgatccagcacagatgtatcaagataccttatcatgccttgcttattgttcaggattgagcgtgatggtagttctggtaatgagttagtgagtgagatgggaaatagggatactagagctccagatgctgttgtagctattggtccactaatgacccaaattctaccctgtggttcagtgtagtaggaattgtcatagtatgacaataaccagcatctaacagttacatttctcttaatt

SEQ ID NO: 25556 - DNA, 1534 bp, Homo sapiens
actttttagattgatacagataaaaagttcaataacttagggagagtatggagatacaggtattctttttttttttttttttttttttgagacggagtcttgcactgtcacccaggctggagtgcagtggcgcatcttggctcactgcaatctctgcctcccaggttcacgcctttctcctgcctcagtctcccgagtagctgggactacaggcatgtgccacaacacctggctaattttttgtattttttttagtagagacagggtttcaccgtgttagccaggatggtctcaatcacctgacctcatgatctgcccgcctcggcctcccaaagtgctgggattacaggcgggagccactgcgaccggcctgagatacaggtattctaatacattgctggttggcatataagttgacaccacttacgtggaggacaatgtaatattatgtgaataaattcacataccccttgagccagcaattccatttttaggactttatcctgtagagatatactggcttgatacaaagacttaggtataagaattttcattgcagtattgtttatattagcatatgactagaaacaagctaaatgttcatcgtagccatacagtgaatataatgcctgttaaaaaagaatgcagtacatctagaagcactgaaatgacattggtaagtaagaaggaaggtacaggacagtgtgtataatacaccacagtgtgtattaaaaacacagagagatacttggcatgcttgtataggcagtgactatcatgggaaaggtaaatagctggtaatgtggttgcctctgaagagggagggagattaattggagatcagggataggagatcagacttgtaacattgaactatttgaattatttttttcacatacatgtagtacctttgcaaaatacatttttgacactttttaataaactgattaatattatgaaatatcaaattattttttacttaagttggatcacaaggacgagtcataagttttgaggtacgaaaagaccaccatgatctggctaagaagaattacaaacactggcgtgattcatggaaattaagtcatgtagaagagtggccagacaatgtggattttattcataaggacatttcaggagcaaccgaagacataaaatctttaacatttgacgcagtaagttttctaacgtgggtcctgtgttattactttgactataaagaagataggggtcaggcttcttttgtatgggcaaaggtcttccttcgtttgcttcatgtctatctctagggattgaaagaatattttcgtttcatgccttttaatctcatggtgggatttgggacagagagacatactgagttaccgagttgggtgctgaagttgtcattgaatgtggggtaatgactgaaagctaggaccaaagactagttgagcatcatgaacctcagcatttctaggatgaatcatactttggaagcagcattggaagcatattgaacccggcacctaacctgaactgtgagatttggggg

SEQ ID NO: 25557 - DNA, 1054 bp, Homo sapiens
ttctttccactgcagagaaaccattgtatatccctggaaacatttatttctatttaaatgtgctttaaaatgcaactaagtaaaaagacagaactttttaagaagaaagcttaatataaatctagccagactagatttatattcaaagtcactttttggttcaaattaacttctactcagtggttttcaaactgtgtttggagacagagatgctcccacagttgattcagtcacagctactcactcttgttggttttatacattgggattccccttaggacttcacttaacaaaatgttctatttcaactaaacagcttgaaaattccacttttacaccaacagcgagttccccaggagtcagaaggaaatggtgtattggatgttacggtaacaacatttttctgattgtgaggaaacatcttagaaattggcatgtaacttttttttaaagtggtttttcaatgaaaatgtaaaagatgcaaaaattttggatatagtaagagggactcctttttgggaaattaataggaattcatggacatatatcaaattttacttctgtgaaatttcagtactccagagctaattaggtatactgaacagaaatattaacaattcctttcaggtaagctggagcgtgcatttcaatgccactggtgccatgtgcctctgagttcggaagctggttcggtagctggaacagcccaccccagtggaaattctacacagggcaaaatctgcacttgtttcgatgggaaaaagggaaaagtccctttaaagaaagttggtcctatgggaatgataatttataacagctgataattaatctagacatcaccatattttatcttgatgtttatatttcttctaatcctgctttgaattgtatcattccttaagtaagcaagtaaatgttagtaaataaaattgtgatcattgatcattagcttaatacatagtttccctttttttaaaaaaaaaaaaaaacaatttattggaccatgtgctcaatgtctacaggcccaatcctccacagctaggaacagccatgg

SEQ ID NO: 25558 - DNA, 1029 bp, Homo sapiens
atggatgtatgatttataagttttaaactgcgtgctgttctgagtagtgtggtctaatccggctccgtcctgccctatcctgcatggggcatgaatcatcctttgtccaagctgtacacactacctgcccattactgtacaggaagacacatggtgtatatagggttcagtactatccatggtttcaggcatccacttggggtcttgtaatgtatcccccatgaatgggggggattactgtgtacacaatcctactgaccaccattaccaatgatagtcatttaggaggacgcactttaaatatagacatttaagacaccaccaagttattggaagagaaaaacacacaaaaaaattttaatgcctaaaaacagaaacaaaaaacccaccaagcaccaagcagattatatgaactaatatattatgatgtccaaaagatgttattaattgggaaatgcaagctatgtagaattctatacaaggtctgatccaatttttgtaaaataagatcatatgtatttatatatgtacagacatctgaaatattccctttctacactgtcctggttttcataaacgtattttacaatggatatgtttaacattagcaattagaaaactggtaaagataaatgttattgccacaagcatttttaatttcagtttgtcctcggctgttacagagaattgatacaaaaaatgatcatgtgaagaatttgcatcttctgcagaactaccggtatcagtcagcagtaggagattgtaagtagcagaaatccagcttgaaggagctgaaacataagaaggaaatttattggcccctatcactgaagaacaggaagggtggttggatctggccttgggaaacttataagcagcaaagactggctggctctgtctctacttctcttgctctttgtaggttgaccccttgtactccatgtttacgtccttgtgggttcctgactggaaagtcttatccctgtaagctcaagtcgagagagtcccagagaaggattctgtttggct

SEQ ID NO: 25559 - DNA, 1040 bp, Homo sapiens
atgtccatgttttaaagagattggctttagagggatgtctcataataactcctgctgatctttcaatcacacttagcgtttacacagttgttctcaaaattctatttgatttgatgctgacggcattccagtggagtgtttttatgacatttgtttgacataagagcaaatcaggcctccgcgagcttaagcaggtttcccaaggatacagctagctggttactgcggacttgggcctgctgactgtgaagctaaattcttcctgtttcctttcccccatgttattgccatgattcagtagcagtcatgagaagtgctctcttcctccttgagtctacatggtccccaccctgaggggaatccaggcttcctgggagtgaacagcagtaggcagaggggcaggtgcagagaaggtggtggagtagggctagtgtgaaagaagtcttacctcagtccaggggcctttccaaggaaacgtgggaggagacaggtaggtgacaggtaaaggtggctggggacaggggaatgagagcagggtgcaggacacacatgtgatacgaaggccctgtaatacctgtatccttgttcccttcccctgaacacccagcctgcttccccatggctcctcacatgggcagccacatgcttgggctcgacttcagaagcatcagccagaccagaatacctacacatgaggagctgccttttctaccagtgacaggcccagtgggatgcaggaagcagcctgccctcgctgtggtcagttagggggtacattatctgtagaaaatttaagagcaatgataacactcacagtcattctgcttttgaatgtcaccatgcactggcaattttaaccaatggcagtggtaaaattccctccctccccacttggtatgccaccacttccttctcagggcagaagcactacttcaagcctgctggggtacagtcccggggagaaatacactcaccacagccgcctctgctaactccatcccacccacctctctgagggcccatagcagcagccaaccagg

SEQ ID NO: 25560 - DNA, 1049 bp, Homo sapiens
gctggcccgggagctagagcctgatatgagaacttggcctgaaagcattttcatcctcagggtggggacattggatcttccactggggagttcgttctgaagtgaggcaggaacagtgagaagcaggagctagtcttaggggagaaggagctgatagggcctggaaaaggactctgtccttcatccccagactcactgctgggtttccagactgagcaccagtgtgggctgcacagacttgagcagaacagcaagactagcagattaactccacacctaggtcaggggacccgggctcagagaggttaggggacttgtccagggtcacacagctagtccatgcttggctgaaatgcaaaatcaatttttcagattgtgggtccatatattttattttattctgtcacaaacataaaacttcttattatgtctaaagttcactgagttagagaaagtgtgtgtgtgtgtgcatacgtgtgtgtgtgtgtgtgtgtgtgtgtgtgtttgacttgtgatttggggaaagagaagaggtgatagatgaggattctgggtttcctaattaagatggtttgattattatattttagctttgcccagaggtactaaaatactacatttcagccatataattcaataaatagtgtcatctggtgttctgccatctgggccaaatgcctgtgggcaggtaacccaagaagaaccttgtgtggcttcgaaaggtaccaagtggtctttgttctggggacagatttcccttctccctccctaagtttgcctcctacatttcacattacctggggaatgaggcaggggaaagagatgtggaaagagatgtagagacattttcaatgcccaggatggaaaactgatttggattaaatatttgccaggaataattcattcaacaaattattgagtctaagactattaagtatagatcagtaaaaacaacaacaacaacaaaaaaaacagactgaaagtgtgccctcatggaacttgaatgcccccagtgaataaatccctcaggtggacaagtgggagctacc

SEQ ID NO: 25561 - DNA, 1028 bp, Homo sapiens
aggaagctgcaaaccatgctaaacacattcctcgtgagtgtgactgttggaccggccattccagcccatggagccaaagtcctgggaggcatggagaagtcccttcgggactaagttcagacgaggagaagggaccagaagtcaagcaggaagctctgaagtccaggttcctcggagtatggggtctcaggcaggtccaggcttctaatctcacccaagtctctctccagaatcaccctgcacagcttctgtgctggctccagcccccactctccacgtgcataaaaagcaagttagcacaaagctcaatttctagccttctaagctgataataaccttatgtattacgcttcttaaaatagttttcttgtcttatcatttgcatggcactgtgctcaaactcgtgtgagatggagctttgggtagaaaacacctgctgagtcccaggaagcattcacattgataatgaccaattctcacagacggacagtgaggtgaggcacccggtcatctgtggatgctgtcagagaccccatttctgccacagggaagggagaagcagctaaacttaaattgactgactgtaaattgcgttttccctccattagcattcagtcaccaaaagaaataatagtaaccacagctatgttgtaatgataatatgttgtgtatgcattatgttttaccaagcaatttttcatgtctcatctcacttctgaagcctaattcgggctatgaagctgggtgagggtgaagattagtattgtccttgggaggaggaggaaactgaccacgaggttctgaaactgaccagaaaggatatgtttagctgagccaagctcaggacccagctttctggaattagaggagtcatccctggggctgcgcttccctttttagcccatctccactccccacccccacacacacaacacagaagctcttggggctgcatttctgtccagctaaaattgggttgaaaacaacaaaggatcccttgaaggagaaaaatcacaaatgcataatgt

SEQ ID NO: 25562 - DNA, 1058 bp, Homo sapiens
tcacttgaaggcaaaagaagctcccaaagaggccctggatttctaaagcgcctgccgccggtgctgtcctgtgcagtggaggctgattgaggctggagttgctctcccacctccctgaggatatgtccctcctgggtcagtggtgagctgagggcaggagctagagtgccaggctgctgcagtgggaaggggtgtcttggctgagcagaggaaggatgctctggtgtcccgcaggaggccaggcttccgtggggagcaggccgctgctctttgaaaaagtgtcctgagtgcgggtggtatcagccctggaaaatgcccagcttctcactctgttgtttgacctctagggtatgccctagtgacccctaggatgtgacctctctgctgtcatccacccagctgtaagggtcacatatgtttctgccaggtgaaggttctgtgctttgtagagcggggacaccaaggctcacagaagtacagggagacaaggacttggtgccatgtggagtgctgaggctgcagcttagatctctggacccctaggtcagcttagagtccacgggagggggtagggggcagtgtcctgggtgctacttctgactttgctgccaaggacattcaggtgaagggatgcctcaggattatcagcctcttccagcaggatggtcccgtggagcgccatcgggtagctcagcactcagtggggtatctccttggcaggtggcacattttggtcaccactgaggaaatgctgtcagcccagggctcacacaactgggcaggaagttgagcaacatgtttttaagttgaaaatgagagttgggtgggcggaggggagggggaaatgtccaccaagctatttccgaaatctttgtcatttgctgtcacttttgagtacaaggaaagacatcctctaagacagtcaatgtgaaggctttattttggtgattgagcaaggaagcggtggaagccccagtaaatggtgtcccagtccctgaacccacagaggcagtcacagcagggcagcagagaaggggcctctgatccctgcccatgat

SEQ ID NO: 25563 - DNA, 1057 bp, Homo sapiens
tgagagattgatcacattatatatactttgcatcttctctttacttaagtatatattctagaaatcctactggtcagctagctcattattttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggcctagctcattatttttaatgactgcataatattctgcagtgtggatgtaacttattttattcagctatttccatttgatgggtatacactttatctctcatctcttgttgctacagacagagctgaaataatctatgtacacatattcttacatgttagagcttttgcttctgaagtataacttttgaggagtgggaattctgagtcaaaaggagtctgtaatttttatattatgtatattttaagattgctttgtaaaacaatctacattttcgttagcaaagtacgagagtactctttccccagcatcctctttggtataaatgtcgtcattttcgttttgccaacctaaagagtatgaaacgggatccaattgtaattttatattcctctgattaccagagaggttgagtatgttctcatatgtttattgcatgtaaggatcttgcccttctatgaggggtctattcatatcctctccctatttttctactgtacggtttatctttttgttgccaagtaaaagagctctttgcatgttattgatagttctttattagtcatatatgttgcagatttttttctgattaatttgttaatactgttgactttatggtatatattgccatataactttttggctttgaaaaatacagtcgaatatg

SEQ ID NO: 25564 - DNA, 1030 bp, Homo sapiens
atccccatgtatccctgtaaagattctcttcttcccctcagcctcactttccactttgactcaaaagagaaaagacagctatccattttgcatttcctcccaccatgaataattggtggaactaagaccggacgtaggatgctagagccctggcaggagtgccactggggcagttggcaagcaggaaagatgggtgaactccttggaggtttccccctttgagtgcctgtcaagcatggggagacagagcgggcaaaatcacctgccccaggtcactggatcaagtttgtccgaacatccggcaaacccatatggggtgctgctgtgtgggaagccctgtgtaggaagcgggggtgaattctgagggagtgtggagtgtgtagcagtggctctctgctggcccctccctcaccacttctgattcccgaacactgtgttcctcttagatgtattgctgtattactggaaagatacaactgtgtctctggggatgctgtttaatggtggaaggaactgcaaaatggatagctgtcttttctcttttgagtcaaagtggaatgtgaggccaaggggaagaagagaatctttgccggggtacatggggatacaagtttgagacaattgcttttaaatttaccaggcgttgttctgcatggttgaatttcctgtcctgatcatgtcactcttccgttagctcagaaaactgtggttgaagtttaatctcatccttaaagctgtttcactaaaataggaaactgttattccacagggctgcttattagaagaagaaggatttagggaggtcttttaaagtcattttagtgatttttttgaaagaagcatttgccgcaatccacttgtccccaaagcatctgctgtttcaaagcataacactagtggaagcataacaggaagggaaagccagcatcaggatagggaataggctgagcaacccacttttatttagtcagttgaggacacctgtcgtgggttctatacgttttgggcaccatggaccaggtagcctatg

SEQ ID NO: 25565 - DNA, 1109 bp, Homo sapiens
ttttttgttgcttttgtctgcgtttcttacttgcagctttgataacatgtttttaaaattggaaatactggtttttatgttttctaagaatcgatgtgggaaatgtgtatcagttttcttgtttcttttcctgtgtaaaaattgtgatttagtgtctcaagtatattttttatttatttggtttttgaggtggaacatagatgaaactgaaggaagcttatagctctatttatagagtcactctaagattagcacacacaagcattttcccataagaacaacagatcatttaaagaatatatttaattagttaccctgggttcagtgcggtggcttacgcctgtaatctgagcactttgggaggccgaggtgggcagatcacctgaggagttcaagaccagcctggccaacatgacaaaaccctgtctctactaaaaatacaaaaattagccaggtgttgtggcatgcgcctgtaatcccagctactcgggaggctgaggcaggaaaatcacttgaacctgggaggcagagtttgcagtgaatcaaaatcatgccactgtactccagcctgggcaacagtgtgagactctgtctcaaaaaaataataataattagttatcctggttataaagtaacatctttaaacatatcttgctctctatattatatgtatctatatatctatgtatatagatatatattggtgtagatagagtccctttaattaccttgttgtaccttcaggttctgctatgttctcttgaatatatggcaggacatttcttgacctttgaggttgtatttgttagaaatggtcaaagatcagctgtgtgattagattggataataaggtttaagggaggaatatgttagttataaagaattaagttgcctttctcctgggacatacgtgctttaaaatgtccctaccccaaagcgccacagtggcacattggaataagcttacagtctaagtaactgttaatatcacttatactatcgaaaattaatcttgttgctttttagacatgttatatccaaataactacctaatttattactaaattcatagttacttgacatctcaaatatctcagtatggtaaattg

SEQ ID NO: 25566 - DNA, 1029 bp, Homo sapiens
taatgtttttggcatcagaattatgatatagtttatataggtttaactttgtgtgtgtgtgtgtgtgtgtgtgtgtgttttgagacagagtcttgctctgtcgcccaggctggagtgcagtggcacaatctcgggtcactgcaacctctgcttcccaggttcaagcgattctcctgtctcagcctcccatgtagctgggattataggcatgtgccaccatgactggctaatttttgtatttttagtggaaatagggtttcaccatgttggccaggctggtctcaaactcctgacctcaggtgacccacctgcctcggcctcccaaagtgctgggattataggcatgagccactgtacctggcccatcttaggtttaacttttaagtttgtatttctctgagcttatataccaagtgtcggtggagagtgttgacctggaagtcctgtgattggcaggggacaaccaacttagcattacaaactgattgtggaccaatctgagagtggctaattgatgtgcaagcaattcaaagttgattgcacatgtatatgtctatgtttcagatatatatatatgtgtgtgtgtgtgtgtgtgtatatatggaatattgataatgtttgtgaaggagtcgaatattctgaaggaaagtttttttatagaattaaattttgatgctgccactgtaaaatttctatgttacccactgattgctgtcattttccagatgacttttacttttaacagatgtttatctgattactcttggtgcttttacactatacctgttttgttaaaatgtgaaataaaaacaaaaacaaaaacacagaataaccagttaagtccctagttaaaccaccatttgcatttctcccacagagtatgaatccagtttatttaatataaagtgttttaactgaataagaaaataatataattggtgtatgtataattagctagaatcaataatttatttccccgacttggtgagttaaagttgctctatattaatgagttgtaaatacattatt

SEQ ID NO: 25567 - DNA, 1018 bp, Homo sapiens
tatgtattagtgactgaaattactaagtgccattgctagtgacttgattttccaaaatggtgaacaattcttagtaaacttgtaaacaaaaccagtacagtcttccctcactttacatgatagttttattcctgggaaactcattgtatattaaaatcaatgcaaaacttatttctgtttgtatatgaagtggaattaatgtatagataattaaggctgtagatattctgtagtcttatggatggagaacagtctttgtgtatgaaactgtcttgtgtcagcatccctggaatcccactgagtcccaatagcatcttcaaattattgtgacagccaaaaagcgtgcatcattttccattagcctccttggatgaacagctgttcattggccttaccctgctgtatttttattctaggtatttattactgcatgacttactcatttgttgatttgtcttggggttatctccctcactggattacgtaagcttcatgagaacagggactttgtccatttcccatcctagtgcctgtcagtgggcacacaatatatacagttgttgaatgagtgctggataaatggatggggagggtggtgagaagtgaaacttgaagactccagaacagctatcttgaaggatcttacatagggaagtgataaagttggttttgtatttgaatagatcatatggctgcagtgtagcaaatgggttggaaggaggctggaagagataacgtgtagaccagttaggtagtccagatgagaaactatggtaatttagacagtgggtagggtgatggtggtagaagagagggacagaaatgtatatattcagtacatttaggagacaaattgatgatgggacttggaggtggattgagcttggggggtcaaggaaatgtcaaggatgactcctaaatttttggctatgctgctggttcgatggttgcattatttatttaggccataaggaccaaaatgtttttggtgggggtggggcaggaagataataaattc

SEQ ID NO: 25568 - DNA, 1054 bp, Homo sapiens
tactcactaatacagggaatataagagggacagatttaaggaaaaagatgagttcagtcttatacatgggttttgtgttatgtttagaactgcactttttgatactgtagccaccagtcacatgtatttattgagtatttgaagtgtggttatacaacttgaaatatactgtaagtgtaaaatatacactggattttgaacatgtagtatgaaaagaacaaaaatatctcagaaatctatcttgattatattataaaatgatactgccagattgtgtttaataaaatatcttaaaattaattttacctgtttattttttaaatatggctataataaattttaaaattacatatatggcctgcattatatttttattggacagtactggtttagaacatgaaggtaggtctggatggagataaacattttgaaattattggtgtatgaggagtggatgggaagaaaggatgttaatgccattgtttagagagtcaatctccagagagagtataaggagtaggaacaaagggggagttagatcagatggacataccagcattaagtggaagaggagataaagcagagccagtagagttctgcttagagagaactgagaatgagcaatatcacagagaggatgagctttatttagcaaagagggaggaagagtatcaaatgctgcacagaggtgaattaagaaccttgcaagagcagtttcagtggaatcagcttagaatctaaattggaatgaagaggcaaaaaccaaatgtgaaaaattattctctactagtttgagtatgacagaaaggagcaatgtttaaatgttaactgatttggtagatgacgagatccagggaaacacagtcacaggaggagtttttaaagatggaaactatgagattacttcagaatttccagtaacattaatccctaatttgaggtattggagagatttgacttaagattatatcagctatatgattctcgtttctcctcggtttaacctttcttgtgttacattttattcatttaggaaagaatctctaaggaggaa

SEQ ID NO: 25569 - DNA, 1065 bp, Homo sapiens
ctatgatgatgacaactatttacttcaaattagatgccttctgtatgtatattgaccagaatacattgctcaagtgatttttaaatatttgtataatttttaaaaattaccatgagacgatttgagctgttgcaactaaaatatttattcagtgtagtagctatatgtagtgtggatttagctacttaatcgaaacattctttagagtccttcaaatatttatagtcagtttttcagttactaaatatgaggtggctactaaagagtaacaaaaagtagatggcatttactgccattggctctctgtgcatttttgcattctcattaaatcccatgccgatccagtattttaaagtatttcaaacatttcctctttttttccttcagaagcagtttttaaaaagtgaaagttacatagaaaatggtccatatgaacaagatagcaatttaaagtatagacttttcacttactgttaagtctgggttgaccaacttcagccatttggaacagcaactctttacttggaattaagcagaaaagacttttgagtagcaaacgactatcatgtagtatatgcgtttttctctgaacctgggagtagcagtagattatgtcccagtttcagggcttactgatagtagccaaaactaacagctatttccagaagcagggaaaagagaatgtattagtgtaaacctaaagcagttcaggttcaaagaattgaggtgtatactaccttgatttcctccaagaatattgttcttatagtgagagtgagtcagaatattcttgtctaaggtgttcatttgtttcagaaagattttggacagctttgtcaaaataactttgaaatagaagtaaaaatttagtatcaaatgaattgaatcgataaattattataactgcactttagatttggcactgagcagccttctcacagccacctggcaatgagaaaaatagtgtcaggctgggtgtggtggctcacgcctgtaatcccagcactttgggaggccaaggcaggtggatcactttaggtcaggagtttgagaccagcctggcca

SEQ ID NO: 25570 - DNA, 1047 bp, Homo sapiens
aataggataggattaaaataggtgaggaagagtttaatggtcttttataatcacagaaggatttggcagatgactgtagccttgataagtacttgaaaagaattgaattggtgctcttctgatgggcttgtttttattttttgagatgttattatacctggtagtaaaatagctttttttacctaaagaggtagtatatatttctgtagtttaaatggatatttttagtattctgtatgactcatatttttaatcgtacccttgtaccctttaaacatttaatttatggattttaagaattcatcaataataattacatatgttatccttaccactattaatacatattccactttctaatgccaacacatttggaaaactttcatttaagcatcttaaatgacattttttttttttctgttttctttaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtaagttctagattttaacatatcatggtagatgttatatacttctggttaaaggtatcttttcattctaagctctgattttcagttttttatcactttccttggaaagttttacttctggcagcagtgtttaaaagtgaataaaaaatcttttgatcctttaaaaaggatcagattacaatagtggattatgggtacatttccaaaggcgactggtataattggattcacactgtgaaggcatccttgtttagacacttatttagtgggagttaagatcttttaacctcatttccaagtaggtgtgtatggtagattctctgaagttagttttggtggataaatccaatgttctttagagtatagaagagcactgtgtgctgtgccagtccttttccacatttccttttttgtaattagtcttttttttttttcccctttggtgcttagtttttactcacaattgccatcag

SEQ ID NO: 25571 - DNA, 1045 bp, Homo sapiens
tgaaacatttggattaggaggtcttctcttttgtaggtttctctaatttttaaaaccatttcctatatatggacttaatatttcatatttagtttggcagttctaagtatggtaagatgattccttctggatttgttcattatattagtaaagtacatgatgctctgtacgctctcagtaaatattaattaaatgtactaataaagtctaagataacattatattttttatgttgatgtagcttactgttggcaaatgtacttgtgatcagccaaagcccaaggccttttcataatattcagatggattattttctgttctcagacttttgtgtggttatttcttttttaccctaaatatgtatgtcttctcaattattgctgtttagtttttcttgtttagttcattatcgcagtctttttggattgttttccactctaattctgtattcaaagtattatttacttttctcaatcttttgtctgcttctgctcacaatgataaccatgaggaattatataaatctgaagaattttcaaaaaatcagtgtgatactacattataagcaatataattttagggtttttaatacatcctaattcttcagaaatgtgaaaccatatatattacttcttgaattgttgttgtaatcagaactttctcttcttcaaccggaaaagacaattgaatattgttattcactgagatgtttgcatattttgtcatgagaaaatataatttagacttaataaatactaatactttgggtgcagtggtgcttgtctgtaattccagcactttgggaggcggaggtgggcacatggcttgagcccagaagttcaagactagcctgggcaatgtggcaaaactctgtctctactaaaaatagaaaaattagcggtgtgtggtgtcgggtgcttgttgtcccagctacttgggaggctggggtgggatgattgcttgagcctgggtggttgagactgcagtgagccgagattatggcactgcactccagcctaggtgacagagtgagaacctgtctcaa

SEQ ID NO: 25572 - DNA, 1041 bp, Homo sapiens
catatcatatattttcttctcatagttttggctttatgagtctgtaagttttgtatgtgatgtgggaaggttggttcatatgaattttggagaacagagaaaattgatagttttggaattcagattgtagggcaggtttgggtatttgacagaatgagaggaaattaacattactcttgatgtcaagataaagagattgtaaagatttaagctacactttagctcagttcttttctttagactacagtgcaaataacacataatctagtttctttgtttttgagaatgacttctacttgaatgggaatagagaaagcttattatatagaattcttttcaacaagatgcctttttcaccctaccatggaagaaatatggaaatagctttatcagaatgcttttttataatggatattttgtatagatatttagaattttatgctattatgcatttttattaaaatcatggtggatcttagaaggttattttagaatgtgttagaattttgaaattttagtagcttaaatgcataaaatccatttaataaaatacagcttctgaatacctgttgcatccttgtcattgagagtatagagattattttatgcatagtgggttggtttactgtattaattgataactggtatttccaagtattgaatatgattctcttaaaggccatccaacaaagacagaaataaggaattgaacttaactgaggagcaagtcattattaggtgtattagtttgctagggctgtcataacaaaataccacagattaggtggtttaaacaacacaaatttattttttaacaattctggaagcttgaaattcaatatcaagtttctgtcagggttgggccccttctgacatgatcatatctctgtgcaggcatacttctggtgtctctttttcctataaggacaccagactcattggatgaggtccccactctaatggcctcatttgaacttaatcgcctctttgaagaccttatctctaaatagcactacagtctgtgctactggggattggttc

SEQ ID NO: 25573 - DNA, 1115 bp, Homo sapiens
tttttttttttttttcccttttgagacaggatcttgctctgtcacccagtctggagtcagtggcatgatcatagctcacgcagcgttgaattcccaggctcaagtgatcctcctattccagccttctgagtagctaggactgccagcctgtgccagcatgcctggctattttttaaaaatttatttttgtagagatgtggtctcactatgttgctcaggctggtcttgaactcctggcctcaagctgtcctcccacctcagcctcccaaagtgctgagattacaggcatgaaccaccgtgcctgacttccattcactttggggaaatcttctgccagctacctaaattggaatagccgtaatttatctacagttgtcttttgaagtaaaaattttgttccatgaggaaaatgtctggttcagcttacaactcaaaactacacaactgctttttcctgaaacatacttccatatgcagcagaaatgttttatcaccacagattgaatgcattttgtcatatagaatattaaaaagatacctactcgagagtcaagatttaatgaaattaggaactcccttttaaacttagtgtgagtaaggttaaaaaataggactgctagtgcatgttgatgatactgctttgatctttgttctaatgggccagtggttttacgctcccctcacctttgcaccataagtgcaaatgaaaaaagtaaataacttccttgcattcttatgaaaatagttttaattttatggactgctgcatagggtcttgaggaaaaccagaattccagagttcacagtttgagaactattgtggtagaccttaagagggtgacttgatttaaattgtgggaaaggtattggggaaagtatctccgggaacagattttttttttttttttttttttttgagacggagtcttgctctgtcccccaggctggagtgcagtggcacaatctcagctcactgcaacctctgcctcccgggttcaaacgattctcctgcctcagcctcctgagtagctgggattacaggcgtgtgccaccacgcctggctaattttttgtatttttagtagagatggggtttcaccatgttagccagatggt

SEQ ID NO: 25574 - DNA, 1073 bp, Homo sapiens
gggaatcacttgaatccgggaggtggaggttgcagtgagccaagatcgcgccaccgcactccagcttggcaacagagcaagactgcgtttcaaaaaaaatatatatatattttataagcttctttcatttgacttgggcctataaaccagctataataaaagttagtttatataacagccttttctttttgaaaccttcctctatttggcagaagttttattgataaaactcctgtgctgatgggacaccccagagttaaattaggtttaggaatttgtagaggggtatagatagagtttatgttcatagaagtggaaagcatgtgttaaataggttaatggaaagtgagaaagaaggcaaaaggaaagaggaaaaaatggaagagcgccaaggactaagaagaggaagatttaagaagatgagtagaaagagaggcaaatgatggctgatgtgatcgaattattttattctaattaattaattaagtatttttgagacacagtctggctctgtcacccatgctggagtgcagtggtgcagtcttggctcactgcaacttctgcccccaggttcagtcagttctcctgcctcatcctcccaggtagctaggactacaggtgcacgccaccacactgagttaattttttgtatttttagtggagacacgctttcgcctggctttggccaggctggtttcaaattcctgactgcgggtgatccgcccacctcggcctcccaaagtgctgggattacaggcatgagccactgtgcccagcccgatcaaattattttttgtaattagtatataataactgaattctgaatgaataaattttaaggtctaagtgtaaaattaataattgacagtcacagttgaattctcttgaaagaggcactctctgggaattatagtgtctttagagtgctttgagaaagtagaggaagaacatccttagagaaaggttaaattctatactaccactttctattcttaccttccacattaatccatttttgttctatatttcagccaggatcatcttttgaaaatgtaaatgataccctgtcactt

SEQ ID NO: 25575 - DNA, 1041 bp, Homo sapiens
caacttgataggctcctttaccagaggtatagggctagagtgactacgattaattaaggccttcactgatttcagtgaacttagtgtatgttccatattattgagctcccaattaaacgccactactatcttgtattgctgtagtagacagctgtgagtctcattttctccattcatatcttaagctacttcagattaggaccatttttaaaaaagagccttgttgtgatatgattggcataccaatgtgtacatttaaagcacacaatttgatgtttgacctatgtatgaggataaaactatcacaatcaagaaaacgaacatattcatcaccctcaaaagtttccttgtgttcgcttataattcttcctttctgtacctgtacctctttttcccctctcttcccctttctatatatatatatatatatatatatatatataaattttttttttttttttttttttttttttttttaaagaggtggtatctcgctctgtcatccaggctggtgtgtgggcgtgatcatagctcactgtaatatagaacttggcttaagcaatcctcctgcctcagcctcttcagtagctgggactacaggcatgtgccaccatgcctcgctattttctagaattttatttaaatggaaccatacagaataagctatttttgtttgactttcttccattcagtatatttatttttacccccttaaaaaaaagtatagttattttgagtgtcagtagttcacttctttttattgctgaagagtattccattgtatggatatatctctattttttcatataccttttgagaccaggaaacagtcattctgtgcgtgataagagaattgactgaattcggagaccagaggatgaaagggaaaaatagtatggagagaaaacgagaataattatctttgtcttcgaaggaagtgagttgttataatagttgtagggtatttgttttggtctgacttgacttcctgttggtttatcatttttctgtaatagtctgctaatgctactgaagaggagt

SEQ ID NO: 25576 - DNA, 1044 bp, Homo sapiens
gtaaaacagagaaataggatagtatctatatggtaaggaggatttttatttcatttgtgagattttaaagtgtttgtatatgaagtgagtcagtaggggaagaaaaattgatgcagggataagaggggacatttacctaagagggatccttgattaggtgagaaacaatggattaataataatttctttatagtaactcacgagagacattctcatttcatcaatttgctggtatttgactattatggtatgctacctttccagttaaaacttgttctaaatttgggagctgagttgaatcaacatataattaagttgagtttagtattcataaaaaagtagccagacttgtttcctttttgtaattaattttaaattggaataattgggagtgacctgggaaatggaatgttttagcctaaattacaaatatgttgatttccaagttaccccagattttaaaatggatatttgaaaatagttttggctttggtgtgtttctgtgacatgctgactttgtatataacgtataataaatgttataataaacatataaacatataaaaacataaatataaacatacaataaacatatataaatgtgcattcataggcaatttctatttcgttaacataggaagactttataagtatagccaagttttatcttatatggtttccagaagtaattattttcctttccaaggctatcttttttttttttttgaggtagaaaacaaatctttcattgttactgggtgcagtggctcatgcttgtaatcccagcactttcggagcctgaggtgggaagatgcttgagctcaggagtttgagactagcctgtgcaacatggcgaaaccccctctacaaaaaatacaaaaattagctgggtgtggtggcatgagcctgcagccccagctactccagaagctgagatgagaggatcacttgagcccgggaggttggggctgcactgagctgagattgcaccactgcaccccagcctgggtaatgggagtgagaccctgtctcaaaaaaaaaaaa

SEQ ID NO: 25577 - DNA, 1021 bp, Homo sapiens
gataaggggatgaaggaagtattgaggcttaaggtgaaaagagaaggtatgagttaattctctatcttaaagataggagagcagattcactacgttaatgtgatgggatttctgagcattttaggggtctgctgaaatttatggttattattttaaagtttatatggttgtatttctctttagtctcattcagctattcaggtaaaagtactgagttaagtggaaagttggttttaaactatgttttgactgtgatggagggagagaggagcagaggagtgaggccacagcaaggaaatgactgtgatgatggatttttgagtctcagactaggtaagaagtagagacgaaggacagtggaaaaatttgtagggtctgttggagttaacaggtttctggtagtgaactggaaaaattagtatattgagtaaagaagctgagatgcttgaaactgagatttttaaggtagcgtagttactggttatcgatatttcattatgagaataggggactggagtgggatggaagaaaagatcattgggtgtggaagtgattaccttctgtggatgtcatttcagtgattaatctgtagagcagattttggtgctctataacatattcaattatttcctcttcatacactgagagtttctgcttcctgttttattttgtttaaatattgcctcaacttgtaaatcacattgtgttgctctgaaatgaagacagctgtaaataagtaaatcgataaaagcaaattttgtttagtcagaatttggccttatcatatggcttgttagagactgtgtagttggtaaattcaaacattaacatcccaactgatgatcctattgcgcattaagctagtttagtcccacataagttcagtgagggctttatgccacatatgtttatctgtagtacattgctttgctgactctaattttgtctttgtctttttataggaccgcagctgaatgcacagctagaaggttggctttcacaagtacagtctacaaaaaga

SEQ ID NO: 25578 - DNA, 1035 bp, Homo sapiens
tcaacttcaagcatttgtgtcacttgaggtggttgctttttatggtccagatttatatttccctcactagagtactggacccttttgtcagacggtaaacatggtgtttttgaagccttcatttaaattggaaataggagcatggaggaatattggggcgttttgaaataaacgtggatggccgagcatggtggctcacgcctgtactaccagcgctttgggaggctgaggctagtggatcacctgaggtcaggagtttgagacaagcctgaccaacatggtaaaaccctgtctttactgaaaatacaaaattagttgggcctagtggtgcatgcctataatctcagctactggggaggctgaggcaggagaatcacttgaaccctggaggtggaggttgcagtgagccgagatcgccccattgcactccagcctgggcaagaagagcaaaactctgtcacaaaaaaagaaaaaaaaagaaataaacatggatagttttcaattagactagaacattctcatgaatttttggactaaaacagaagattttaaaagataattttgagtttaagtatcacctagggtctaagagtctgagttttattttcttcccttatcagtgttatttggaaaagctggagaggaattaattgaagtgagtctaagaaacaagggggttacttaaggcttcaaagtagcttggaggtaaaattaatgtgtttatttattgctaatttatagattatatgatttctcaattacactgaaaaatctcaggtataaaccttccaggagtctgttagctgcattcactgagaatatagcatgtgcaaataaactcctttaaggcagtgggcctcacgtttgtttgtttgttttttgtttttttttttgagacagggtctcactgcagatttgacctcctggactcaagcgatcttcctgcctcagccctggagtagtactacaggcatgcgccaccacacccggctaatttttgtatttttttgtggagatggggtttcaccatgttgc

SEQ ID NO: 25579 - DNA, 1025 bp, Homo sapiens
gggagctctaactactttactctaactactcctgctgtggttctcaactagaggctgtagtaagaactgtctgtggggccctccttcagatctgttcagtcagtcagtcttctttagtaatggggattgtctgttttcttctaaaactctgtatatgattctgataaacacttcttctctactattttgacattaggttattcaaggtcagtttcttctgaattggtgtacgattgactatttaaactgtgtgagggagatgggaaagagttggacactgattagtttatctagtcaccacgtttaatttgtatagaactcttgctgctgagactaccgtattggctgctggctcttcctgatttagtcatctgttgctagatggaagggtcctgtgatattatgccttatattaccatgcttggtactacttgcctctgcatttggctgtggtcaacaagtaatgcagaagtgactagaagttactatagatatgggtttagaggtggcttttctgtgcaggtagaagttaaattgaaatcccaaacgccgtgacgttctcagtgggagagttttccttttagagggaatgtatggctgaaatacagtgaaaaatgttggagaaggaggctaaaactgtatcctatatcatcttatataggattggtaaaatagtttgtgttttattctaattatgataggaagccatgtgaaatgacagagttcaagtaatttgactcatgcatttaaaaatgttataatggagcaatcattgaatgaagaacaatgacttaaaaataaaaaaaatctaaaaattatatatttatttttatagacagggtctcattctgtcacctagttgctgcagtgcagtggtgtgatcgtagctcattgcagcctccaactcctgggttcaagcagtcctcctgtcttggccttccaagtagctgggaatgcaggtgtttgtcaccacgcccagctaattttaaaattttctgtagagttgggggtcttgctttattgtc

SEQ ID NO: 25580 - DNA, 1696 bp, Homo sapiens
tttggaagagggaggagtattttatttaattttttgagacaaagtcttgctctgtcgtccatgctggagtgcagtggcatgctcatggctcattgcaaccttgacctcctgggctcaagcgatccttcctactcactttcctagtagctgggactataggtgtataccaccatgcccggttaatttctgtattttttgtagagacagggtttcaccatgttgcccaagctggtcttgatctcctgggtacaagtgatcttgtctacttcggcctcccaaattgctgggattacaggtgtgagccaccacacccggccaaaattatttaatagactttccagatacttatggatagccatatttaacgctatactgaaactctacatgcggtagttccttttttaaaaaaaatcattttattgagatatagttgataagttacatatatttaatatatctatgaaagtcaacacaatcaagatgtaccttttgaaggtaatttcttaaagattaattgcagtgtagaatttgaaaccatctcagtaaagttttcatattgtgttttcattaagatctatgaatctagttggtttatcctccactttggttgtatcttttttccttgcaggaattttcaaacatcatgcattagtcagttggaaaatatttgtttattgagttacgcagatcttctaaatgtttacacatttcattatttgttgtcaaagaatcacacctgttaatatcgtcaccattctctttagaaaagtgtttttgacttgggaagttgttaagcccatagtggtagaaactatgttttgcaaaattcgaattttttcgaagcttaaatattgttggttactttccctgatgtgacaagcccactagtcattttctttctttctttctttttttttttttttgagacagagttttgctcttgttgcccaggctggagtgcaatggcgcgatcttggctcaccgcagcctttggctcggctcaccgcaacctctgcctcctgggttcaagcgattcccctgcctcagcctcctgagtagctgggattccaggcacataccaccatgcctggctaattttgtatttttggtagagacggggtttctccatgttggtcaggctggtctcaaactcccgaactcaggtgatctgcctgccttggcctctcaaagtgctgggattacaggcgtgagccaccatgcctggctgcccactattcattttcaaggaaataactttcagatacccaagagtaagtaactagttgttctttcaagagaaatggtggtctataaaaaagcacagttcagcttgcaactctcataagatgctttttcttgagacagccatctttctacccatttaagtgcacagaatattaagaagttgtatacttaagggcaaagatttaatgtgtaatatttgcagctatatcaaggacattcttaagtgaaactggctttaaaaaatttggtgagtgtttggtaatgaagaatgtagtgactactactgtagttcggtgctactgctaatgagacaacagcagttttatccaatgttactttttaaattttttttatttttttcgagacagagtcttgctttgtcgcccaggctggagtgcagtgccccatcttggctcactgcaacctctgcctcctgggttcaagggattct

SEQ ID NO: 25581 - DNA, 1048 bp, Homo sapiens
agcagtggctcatgcctgtagtaatcccagcacttgaagacgccaaggtgggaagataacttgaggccaggagtttgacactaacctagacaacatactgagacctagtctctacaaaagaattttctaaatattagccaggcatggtagcatacacctgtaggcccagctattccggagacttaaacaggaggatccttcaagcccaggggtttgaggttacagtaagccctgatcacaccactgcactccagcctaggcctcagagaccttatctcaaaaaagaaaaaaaaagaagaaactttgcagtggtgtaagaaaggataaattagaaggggaaaaaactcaagttatgaaaatcctattaacaatttcaattatatataataattgttatgctaatggaaaaataatcactatcattaaataagattattttaattcttaaaaggtccgagtgaagctgaagaattccagcttgaggtgagtgggctactaggggagatgaactgcccgtatctttcactgacatctggggatgtgaccaagcgccttctcattcagaagaactgcctcctcttgctcagtaagttcatggctactagaatatagctattactttctgtttatgttttccatgactaataaactgaccatggttttttgtttgtttatttcattatgaatgtaattcaaaattcattttaaaataaaactttcttaaatttccaatttaggagctgagggtagacgtgtgcactggtagcattattgtttttgtaactgatactctttcaatatttcagcctcagtggtactcaggccgttgtgcttctcctaatgtgatcactggtagttttggagtgttgctcaagtgtgtgatcattaaacttacattttagactagaagcacatttttaagtatattaggaagatagtatggaaataatggagattttgtttagaaattcatttctttgaggagagtaagcatttataatagtagatacagttaatggttaatgtaatttaaagtattttgtcttgt

SEQ ID NO: 25582 - DNA, 1033 bp, Homo sapiens
atgtcttggctgtagggccatcaccttgctggcacattcctccagttcttctccagcacactcattttttatgtgtagctaaatttccatcacaatttttttttttttgacggagtctcactctgttgcccaggctggagtacagtggcttactacaacctctgcctcctgggttcaagcgattctcccacctcaaactcccgagtagctgggattacaggcatgagccaccagtcccggctaatttttgtattttcagtagagacagggtttcgctgtgttggccaggctggtctcgaactcctgacctcaggtaattcacctcccagagtgctgggattacaggtgtgagccactgcacctggcagtgatgatgcactgaaacactcagtaaaatttggtgcactgaaaccctcagtaaaaatgctagcctttggtttaatatactgagagtattggaatctcaacacggagttaactttttaatgagtgtagtgacctgctagacatgatatgttgtcaggagactgtgtattcctgtgaatactggagaacctttaaaagatattttagttcttggcttttaaaatacggtcttggctaacttacctttcttggggtctcctgtgtacatcctggtattgtaaagtgaagatgtcttgactaagaagtgtgagcacgagtggtgggacaggtagggaggcagaaaagggttgagaattacttgaaatggaaaatcacagtgttaagcttttttaaatctgatgagaaacatatccaaattatctaagtttcagggcctggctgtttaagttccttatcaaataataatgtaaactcatgccagatcttcttgcgtgctctatatttcattaagtgtaattatgtgattattgagaatatagtgcagtaggcctgtcactattttacatagtattgttaatgttttgttaaaaggattttcttacatatgtgatcagaaaagcctactgttattattttctagtaaaatgtagaattctggctgtatttc

SEQ ID NO: 25583 - DNA, 1064 bp, Homo sapiens
aatattttgtaccctagaagtcctctattaatccctgtaagaatctcctggaaacctggatgaaagagtttaatgccaaatattggctaaaaagttctgtctttctctctccctattcctcccccattgtttaattgagatatacatgttttaatgggcagtggatcagtattgtttctggggaaatccacaccttaaaaggccaggcttccccagcccaacttacctgtgacccacctacatgtgttcaccttttgggattctgaagaccctgctatctagacctagtctcctgtcataaagacattatttctatagtggtttatgtctctcttactctttgtcccaaatgacagagaccaatctagaaattggaaataaattattaacgtccaactttccaccaaaaaacatataaataggctcttagattttaaaaatattaaatctatagatattttaaccaattaaaacaatttctacatattccattccccacattttccatcgtcataacaatgatgcttctcatgatacgtacatctactccttgaaaaagtattctggtggtggtgtggctaatgattgacaaatatttctgtaaaatttctgcctgtttgcctctagaattctgcattatacaggcaaattttctttaaagctagagacttgtgctaaatttgcctgattttcatacagatatgctgtagtaatacagctaccttttcatttcatctttgtgctttggttaacaagcaggctcaagagactgctttgtgtaattaaatgaattgacctaaacatgagctgtcaggtgaatacttaatatttccatgcagatacagaattccatattgtgttcagtaaatttcttttggttcttcacagtgaagaaagaatgtttctaacctaacatttgtagaaggatactggaaaattccttccaggaaggaaggaaggaagatgccattacttggtgtatttatgatggatgaccacaaagctattgttctaccagttattaattaccttctaagatcttcagttactgctttattaatgtc

SEQ ID NO: 25584 - DNA, 1019 bp, Homo sapiens
agtctcttcccaaaagctcccagatctgataaaacaacttcagcaaatttctggatataaaatcaatgtatgaaaatcagtaccatttatacacaccaataatgcccaagctgagtaccaaatcaagaatgcagtctcatttacagtagtcacaaaaaagataaaataactaggaatatagctaaccatggaggtgaaagatctctacactgagaattacaaaacactgctcaaagaaatcagagatgacacaaagaaatggaaaaacattccatgctcatggatagaaagaatctattgttaaaatggccgtactgcccaaagcaatttacaaattcaatgctattcctatcaaactaccaatgacattctaacagaattagaaaaaatgtttaaaattcatatggaaacccgaagagccaaggcaatcctaagcaaaaagaacaaagctggaggcatcacattacctgacttcaaactatactacagggctgtagtaaccaaaacatcatggtactggtacaaaaacagaagcatagaccaatgaaacagaatagagagcccagaaataaagctgcacacttataaccgtctaatcttcgacaaagttgacaaaagcaatggggaaaggactccctattcaataaatgatgctgggataaatggctagccatatgcagaagattgaaactggaccccttccttataccatatataaaaatcaattcagacggattaaagacttaaatgcaaaacctaaaactaaaaaaagttgaagaaaacctagggaataccattctagacatatgccctggcaaagatttcatgatgaagacaccaaaagcaattgcaacaatgaccaaaaaaaaaaatgacaaatgggacctaatttaactgaagagcttctgcacacattagaacgatcaacagcgtaaatagacaacccacagaatgagagaaaatatttgcaaactatgaatctgacaaaggaccaatatccagaatctgtaaggaaccta

SEQ ID NO: 25585 - DNA, 1049 bp, Homo sapiens
acagtctcttcagtatgaaggatagacatattatccttattggaaaggcaaggaaataaaagtaccatttgctgatatcctactatgtgcatgattgtgtcctggggtgttttttaaattgtagaatcctatttaatcctgtgattatttggtgttattcccatttttctgttttgttttaaacggagtaatctgaagttcagaaagattaaataatttgcttaaagttagccaattagtgacagaactggaaattgagttcagaaatttatctcttcaaagctcatgctttttctcttgaatgaagctgtctttccctttagtcaaatagattatgacagggctaaaaatactgtaacatgatattattactaaacaagaatcttgtttcttgatgccatgaaagtataattggtgttaagtaagctttcttacgtatcgtgtagttgagaatggtatattcccataatgtttgtatttttaaagacaattttatgacatatgtttaattatactgtttactgacacttagaatggtaaagtcatctctctctgatttaggagcacttctcttgatgtagaacctatctatacattcagagcccataagtaagtatatgttttttctttattttaaaccgatatctctgtaaaatagcctggttaggatattttattttctttcacttactaggtattctttgtatttaggagtgtttttttaatgtaaaagaatttgacagataatataatgctaaaacgaagttcatcattgccaagtagggatttgtgcttaaattagattttatttacatggtgtttaagtgaggtacgtatttatatctttaaactagagccaactaggtttaaatattagaaattccagctttttttcctcatataatttggattaaaatattcaagtgcctcctttggtagtagataccctacaattggaaagatacagagattagcaaggcctcagtacaaggatgacacagattcacgaagggttccatatttttctttttcttttctttttttttttg

SEQ ID NO: 25586 - DNA, 2073 bp, Homo sapiens
ttgctagatggtagattgggaggtgctgtaagcatagaagtatttcttgattttaggaaaatatcccaaatagttaaacaaattattctagcatcattaaataatcctttgatttctcctatccaattgtgttttttttttttttagacggagtcttgctctgtcgcccaggctggagtgcagtggcgcgatcttggctcactgcaagctctgcctcccaggttcacgccattcttctgcctcagcctcccgagtagctgggactacaggtgcctgccaccatgcctggctaattttttgtctttttagtagagacagggtttcaccgtgttagccaggatggtctcgatctcctgacctcttgatccacccacctcggcctcccaaagtgctgggattacaggcatgagccaccgggcccggccactcctttacagtttttatatgtatcaggacagttaaggctagataggagttgtttatgatgccacctttgttctgttggtagtggcttcttggagtgctgtactgagaaggatttctgaggctgtatcttgtttttgaagaagaatgctgtgattgatgaatgataccaattaacagcatgggaacagggccatacaagtcacgtgtttgtcatctttggggtctacttctcaactctctagtctatcctattggtctgtctgtaaaacttttataattttaagccactcacaatagcccagcgataacatttgatcctatcatgttatttctgttttgcatgaagtgagtaagctgaagtctagagaaactgagatattgaaatcttattcaaagaaaatgcaaacctagcatcctaatttctttaggcccatgttggtaaaggtgactgagatggagacagttcataaagagcttaggcatgtagatcacaaaaattgtccctgcatgtattcagcttaagttttagcccttcaattggatttgtgattccagagttatttctaaatatagaaaaatgaaccatagcaacctttaccaatttgttgttaaatctaagttagatgtactctgaaagatcaacattttagggaaaaaaataaatacatggagagctactagagaaaactgatgcaaggttaggacagtagaaataattatgggaaccttgtaaatcgtatatctgtcatttcagtacatgtcttatatttcagtatgtggttccgttagtttacttaaaacaagccataataccgttgagcaaagtttaaattactgctttaaaatttataatgtacatattttttaaaactatgtgattttcactgagttaggtagtacagttatttaacacaacaaacgtatactttctgaagaaaataattgaattttcttattcagtggtaaagggaaactatctcctttatttaatttagcatgttttttcattagattgttaggaaaaaagcattgcctgacagcggtgaagatcgagatacaaaagaagctctaaaggagtttgacttcttggttacatcagaggaaggagacaatgaatctagaagtgcaggcgatggaacagactggggtaaggaagcatactggatccaaccagagatgttaagtaaataaaagaaattaatattttaccaggagggcaacatcttaactataatgttgaaatattgagcattctgtgaacttattactactagcaccctttatccagggtgaatgtgtgtgtatgtttaaggaacattgtataactacctcatttaaaaagaaaaaaaaacaacaacaatacagtatgaaaagaatttgaattactatacagaatattctctgttttctgtttagacagtggaacttgcaaatctagatttttgtggaaattgattatgagactttagttggaggatttttggagatctcattgctgacatcttacatgcgaaaagaagtatgagttaaaaaattgtagtcagtcatttatcataaagatttgacagttcgtaaaaggcatagaatttttcttctcaaaatgttctaaaaaatcaaatattttaaacacctaataagagttgaaac

SEQ ID NO: 25587 - DNA, 1942 bp, Homo sapiens
gttaattcagtgtagtagtgtattaatgcatttcctcagctgaatattaaatgcttgagatctagagcaatgccagttgatcagtgctgtgtttttttcctttgttttttaatattctgtcttttacttgagtgtctgttcttgtgacctgagatgtgcttaaatttcaaaataaatttttaaaaaatctaggctatttgttaaaaactgttctaaaactatattaactgactcaaaggagtgattttaattagtgttgtatttaaaagttttcataagttttggatatcaatttaggagaatagaagcctagatgcaatatattttttaaatgtttgtaagtaaacatggctggctgcagtggctaatgcctgtaatcccactttgggaggccaaggtgggaggattgcttaaggctaggagtttgagaccagtctgggcaatgtagcaagaccctgtctctgccaaaaaattaaaaaattagctggggatggtggcacatgtctgtagtcctagctactggggaggctgaggtgaaaggatcacttgggctcaggagtttgaggttaggttatagtgtgctaagatagtgccactgcactctagcctgagtgacagagtgagatcctgtctcttaaaaaaaaaaatcatcaagtttataagtaaacagcgcagctcagtagaaggggcttgcgctttaaaagcaggtagatgtaagtttgactctgccccaacattttaaatttccgtgatcctacttaatttctctatggttactccattcctgatctgtaaactaggaaatactctgggaatacttcctaactcaaatgtttattttcttagtgtacaatacctagttattctcagtatgtaatagttagtacctagtatcatttcatgtatctttccaaccatccattcatcttataaatatgatatatataatgtttttcagacctagtaccaaatccagtgaataagacaacaatgccctgttggatttttatagggaagatagacagttaaagaagtgattacaatgacatatgacatgtataatggataaataataagtgctattgagcgcagtagcacaaacctagtcaagtggtcaagaaaggcttcttggaggaagtgatgtttaattttgacatctgaaggacaagtaggaattaaccagggcaagtaaactgactatttgttgaatgggaggtgggagaaaggcagagtattagcagcagagcttctgaggtaagactggcacatttgagaaatgggatacctggatagtagtgggagagagggaaggaatgtttccagatgtagatagagagttagctggggggtaaaatagttacaagggccttgtgaaacatgttaagtagttcacgcttaggaatataataagcatttgaaggatcttaattaggggtttatgatgagatttactcttggattacgtgggctgtagtgtggaagatggattagagaggagcaacgttggagatggggcaactggttagaggattgttgcagaaacctgggcaaatgagtaaggtttccttgacaagggtgtgttcaggaaatatttaggaagtaaaatatgcaggaactagttctttttatatatacataaatttgattttatgctgatcttctctgtattattctaattttagtatatgtgctgccaaggcaagcacaggaactacttcttgattggatgtagggggtgaaaaaaggatgagtcagaagtgactcccacatttgtaatttaaacaactagaccagaagtagatttggaaaatggtgggttcacttttggatttatttcttaggtaaccaagtgaagatggccagtagacagttgagtatatgggtcttgagcttaagccagaagtatggatgtgttagagacataaatttgagaggcatcaac

SEQ ID NO: 25588 - DNA, 1542 bp, Homo sapiens
atcattgactagaaactatcaacttttttacaaaaaagaaacagttttagttcttatttggaattgagttaaatttagatttttagaaactgtctaaattttacgttagaagaaatgatttatttaaaataaaaatacatgtatatacaaaaacacaggatatacagagacatatgaagtagaaagtaccctagcctctctccattcctttttacaaacctactgtttagagagaaattctattaacaatttagtgtataccacattttctgtatacacacacacacgtgggatttttattgagcttgcgcttaccttggtaataattgggatgtttacatttcaagtcttctcaaacaagatttttcttaattccttaagtagagatatcctatacttaaatacctaggaataaagtaaataatttgtaggttttattactagtgtgagtgggatcttttttccattttatctcttaactggttatttccaacacatgggaaagctctgctgctgtgtgcaaagtcatttggtcaccttgcagaaatactttattatttctctcttttatttttctttctcatatttggatgttttaggtagaaaaaaatcaactggaaatatttctggtatttatacctctctttttctagtattttccagtatttatactggaaaaaatcaactggaaatatttaggtagaaaaaaatcaactggaaatatttccggtatttatacctctctttttctagtattttccagtatttatacctctctttttctagtattttccagtatttatacctgtctttttctagtattggctattaactctagagctttgtatcatgatggtcatgctacagggtttttccttaaaaaaaaagtttattttaaagttacatgaaaactgtataactgttaagtgtagtatttatcattgctttctaagaattactatgtggcatgttaaaaatgtttctagttttctaagagatgttaaaactagtagatgttgaatttcgtgaattgattttttgcgtctaagataatatgttgttttttctcatttaactaactaatgaaatcaagttggtcctgtagtatttctcttttgatacactgctgtatttgttttgttaatattttatttaggatttttacttctgcattcttttttttttctgagacagtcttgcactgtcgcccgggctggagtgcagtgttgcgatcttggctcactgcaactctgcctcttggttcaagcgattctcttgcctcagcctcctgagtagctgggattacagatgcatgccaccacacccagctaattttttgtatttttagttgagacggagtttcactacgttagccaggctggtctcaaactcctgacctcatgatccgcctgccgcggcctcccaaagtgctgggattacaggcgcgagccaccatgcctgacctctgcattcttaaatataaagtcattatgtatttttgataatgttattttgaactcaggtacagagaattaagttctc

SEQ ID NO: 25589 - DNA, 1033 bp, Homo sapiens
ctaaggacattaaaggagaagcttatattattgacgttttaatgaacctgctagaaactagtttgtctagaaagtaagattttttattttacaatgtcagagtctaaacttgattctcaagcctgctacacgtcagaaattttaaaaagcagaaacattcttgaagaccaggtgcggtggctcacgcctgtaatcccagcacttagggaggccaaggcaggcagatcaggaggtcaggagttcgagaccagcctgtagtgaaaccccatctctactaaaaatacaaaaaaaatagccaggtgtggtggcatgcgcctgtaatcccagctacttgggaggctgaggcaggagaatcacttgaacccaggaggtggagtgagttgagattgtgccattgcaccactccagcctgggcaacagtgtgagactccgtctcaaaaaaaaaaaaaaaaaaaaaaaaggaaacattcttggattccagtactgtcttcctgaatctgagtctccagataggtggctccaagatctgtatatttaaaatgttcttcaggtttttcttgtgtctagccatatttagccacttgtgttctaccaaagcactgaaatggttttcttccactgtgtcccatatattggtgggacttccctccctctcttccttctttccttccttcatttttttaaaaaagtgttaatctgaagcctttctaatacaaagtggagccagtaagactttattttctaggtctggaaaccttacattgttaacagtcatttccagggaatcaagtggttttgagatatctaagcaatgtatttttatagctttgtttcagatcattcaaatatttaaccttccttagtaaatatatttggttaaaatgggagggacaattgtacattaaaggaagaattaaaaacagaagtgggaataactgatttctaacttatttcacagtattaaaatatgggaattggccgggcatggtggctcacacctgtaatcccagcactttgggaggccaaagcgggc

SEQ ID NO: 25590 - DNA, 1032 bp, Homo sapiens
tggcacatgtatacatatgtagcaaacctgcacattgtgcacatgtaccctagaacttgaagtataaaaaaaaaacaatgcatggattcacttgtaattgtcaactagacgtttctgttttctcttaaatcctctacaactggggatttacttccactccactgaaacagcacttgtccagccattactgatgacagattgcccagaacagtggtcagtattctgtcttatttgatccatctccatcttttcaccttgaaacacttaaaacgtctttaattttgttctgaaattgataaatacaagagtgtataaaacaggaagcataatatgaatatctgtacaccctccacccaaattaaacaataagattgttatcattgctttgcacagtttgtgtgaagttttcttcctgttcgtggcttcccaagacgctgttaggttttggttcctctcccacttcactaactactacttcttgttcttttttaactcttcctcagttcagggcatttttttttttttaatctgtacatattccttcagtgatatcatctaattgtatgatttttactatcatctataaaataatgattcccaggataatgtttactccacctctttcttatctaagtggcatctcagagttaacatacccaaaccaaattcttgatttctcctcccaaacctgccctttcccccatgttctctatctcaggaaatgaccatttcatccttctagttgctcaagggaaaaccatagagtcatttttgacttccctctttttctcaaatttcatgttgtattcaccagcaaatcctatggtttcatccacaaacaaatccagagtttatttatcatctctatggttaccgctattatctctcatctggattattgcatctgcttcctatttggtcatgatgctttccatttatggaccatatagagtattcttagaagtcagagtgagcctgttaaaaacatttagatcacgaccctcctctgcttcaaactcttactcagagtaa

SEQ ID NO: 25591 - DNA, 1034 bp, Homo sapiens
taaaaagggtctttaatatttgtaattttataactttttcctatgtcaacaagtcatttttaaacactttttaaatacgtacagaaaacacataaaacaaatgtacagcttaatacatttctgtgagtcaaacattcttgtaaccatgtggtaccctccaaaatgactcccagtcattcttgctgtgtggttttctacatccttagtgtagtctccttccacagtgaacaggattaacctgtgtaaccaacaggattttgtggagatgatggagttgattttttggtcataactgcagctcttaggtcattctaactttgaagttagatgactcacttgaaggaagtcagtggtcacataataaggatactcaagaagctctatggagaaggtcacacgattggaactgagtcctcctattaaaagccagcacaaactcatgagccacaggagtgagctaccttggaaatggattctcttgctccagtcaggccttcaaatgactcagcctgggctggcatcttcactgcaacttcttaagaaagtccatgctaaactaagctaagctgctaacaaattcctgacccatagaaactgtgagataacaaatgattacagttatcttaagctgctacatttggggataatttgttatgtagcaaaagttatcaggaagtagaaccttatcaggcacctgggagccctctttgtcccctatccagttgcaactctcttttggttctaagaatagtcactattctgttttttatggcaatcatttccttcattttctcgatagttttgtcatccacgtgtgcatctttaaacattacagtttagtttacctatttttattataagttaaaaacgtgcactattatatacagcatttatggtaattcacccgcttcctctaaacctcagattcttcattggtaataacagcatttttacacataatggtttaacacttacccagtatatcacacatttttatcacatttaaccaccactaacaactctacaaggtagga

SEQ ID NO: 25592 - DNA, 1111 bp, Homo sapiens
tctttttttaaaaaaacaatatctggttttgattaatgaggctatattcaaaagaaacactaaatgatgtggccagttagtgagaatgtagccttatctttactgacctcattttaatattcctactctggctgggcatggtggctcacgcctataatcccagcactctgggaggccgagacgggtggatcacctgaggtcaggggttcgagaccagcctggccaacatggtgaaaccccatctctactaaaaatacaaaaattagctgggtgtggtggtaggcgcctgtaatcccagctactcgggagtccgtggcaggagaatcgcttgaacccaggaggtggaggttgcagtgagctgagatcacgccattgcactccagcctgggtgacaagagcaaaactcagtctcaaaaaaaaaaaagaaaaaaaaagatatatatattcctactcttattaaatgaatatagcatttcttagcaacttcttttgatttgtgagtatatattttcttggcctcaaaattaaagtaaaaagtatcctcttactcagaggaggacaggggcaagagcctgggaccttatttgctaattaaaatgcacacacacacacacacacacagaaattttgagagccattttaatataattgcctccctagaaacataccttttagggaatttttatcactaaaccacatgttatttaaatacgtacatgtttaacataaatacatacataaaattcacatgcatacttaacacttatgttaaatatattcaatgtatatacatatgtacacaatatatgcatatatacatgtgggtatgtggtatgtgtgcatgtgtgtgtatggccagctacataatttgtgggactaagggcaaaatgaaactgtacggccctcgttcaaaaattaggtgtggggtgcttctaagcacagtcttgtgcaactgcacaggttgcatgtccatgaagccatcctgtgtgtgtgcacatatgtgtatgaatatgtattttatataatacatatatatgcatgtatgtatctgagaagaaatgtttaaaaggctacatacaagcttttccaggtctctactatctgttaacta

SEQ ID NO: 25593 - DNA, 1117 bp, Homo sapiens
gtcctcaaggcagaaagcaatggcagaaccttgtgatggcttttacatgttctgctcagcagtggcatacatcactaaacatcattgcccagagcaaaatgcatggcccagctcaaggcaatgagggtggagaagagtaatcctctcactaggaggccagtgcagcattgggggcaatcatacaacctacctcagagccacttttatactgttcaaaatctatatatatatatatatagagagagagagagagagatttattatgatatatatatatatatatatatatatatatatattttttttttttttttttgagacagggtcttgcttttcacccaggctggagtacagtggcacaatcatagctcaccactgcgcagcctcgacctccttggctcaggtgatcctcctgcctcagccccctcagtagcaggactacaggctcaaaccaccaacacctggctaatttttttttgtattttttgtagagactgggtttcaccatgttgcctaggctggtctcgaattcctgggcttaagcgatccacctgtcttgacctcccaaagtactaggattacaggaatgagccacggcgcctggtcatattgtttatatttttgaagctttctccagaatctgtattgcattttgctattaaaatgagattccatgcttgaacccgggaggtggaggttgcagtgagctgagatcgcgccattgcactgcagcctggtcaacaggaatgagactccatctgaagaaaaaaaaaaaaaaagaaaagaaattccatatctctaatttgttattagtgtagccgttaattttaaaaatatatctctttatttttaattgtggtaaaatatacaaacataaaatttaccaccttcaccatttttaagtgtatagtttagtggcgttaaatgtgttcacattgttgtgctttcatcaccaccatacatccacagattacttttcattttgcaaaactgaaactttacacccgttaaagaactcctattctcctctccctacagcccaatcaactaccattctactttctgtctgtatatttgactattctagatgcctcatgtaagtggaatcgtacggtat

SEQ ID NO: 25594 - DNA, 1064 bp, Homo sapiens
gagtagctgggactacaggcgcccgccaccacgcccggctaattttttgtatttttagtagagacgggatttcaccgtgttagccaggatggtcttgatctcctgacctcgtgatccacccgcctcggcctcccaaagtgctgggattacatgcgtgagccaccgcgcccggcctcttctttttttttttttgagacagagtcttactctatcgctcatgcgggagcacaatggcgtgatctcagcttactgcaatctctgccttctgggttcaaatgattctcgtgcctcatcctcccgagtagctgagactacaggtgccgcgccaccacacccagctaatttttgtgtttttagtagagatggggtttcgccatgctgcccaggctggtctcaaactcctgagctcaagcaatccgccagtctcggcctcccaaggtgctaggattataggcgtgagccaccgtgcccagcccagctcatattttataaattagctaaacaaataaagctctggacatccgggaacttatgattgaaataaaaaatggcctattatattttgattcaaatttgtttattatatttagatttctattttgtgacatgttttggggttctttttttttctttttttttttttttttgtgagacggaatctcgctctgtcacccaggctggagtgcagtggcgtgatctcggctcactgcaagctccgcctaccgggttcacgccattctcttgcctcagcctccccggagtagctgggactacaggcgcccgccaccacgcctggctaattttttgtatttttagtagagacggggtttcaccgtggtctcgatctcctgacctcgtgatccgcccgcctcggcctcccaaagtgtttttggggttcttaagaagataaggtataagcttttaaaaagttatgaaaaactttaaaaagttataaaaaattttttataaatttatatttattgttacttttaacatactgtgaattttatacccaggtcaaagactaagtgccttttcatccaaatggaattctgtgataaagg

SEQ ID NO: 25595 - DNA, 1028 bp, Homo sapiens
acagagtcttgctcttttgcccaggctggagtgcagtggtgcaatcttggctcactgcaacctccgcctcctggattcaagcgattctcctgcctcagcctcccaagtagctgggattacagacatgcgccactgtgcccagctaaattttttgtatttttagtagagatggggtttcaccatgttggtcaggctggtcttgaactcctgacctcgtgatccgcccaccttcgcctcccaaagtgctgggattacaggcctgagccaccgcgcccggccactgccttttattttatcttgagagtgagaactgctatgttttttttcagtatgttcactttttccttttgaatgtcctggcttccattctaaaactatgtgagaaccacagcaatggtttaataagggaatgtagacagttgtctattacatgaggtgttttgtggttgttatgagggatgtacactgacactgccatgttccctgttccttttaactaggaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtaactaaaaataaattctcatagccataataggatggaaggaaattgttatttactatgtatgggccactggataaggctattaatcatcacgattaattatcacaattccctctgagagacactgttatctctccattccgaaggtaaggagaaagtgaaaatctcttccttgctcctcctcttgctgcagacttgctctcacaaccctctgttacatcctcagctgtctgcaaaatctcaggttcagctttcctgactccattgtttcatggagagccttgttcacgtgccggcttcagcgcaggctgtttaagtgtagtcttgtgaagagagttttaacatatagatgctgcatctgggggctcc

SEQ ID NO: 25596 - DNA, 1052 bp, Homo sapiens
ggattacaggcactcgccaccacacctggctaatttttgtatttttagtagagacggggtttcaccatgttggccaggctggtcttgaactcctgacttcaggtgatccacctgccttggcctcctgaagtgctggtattacgggcatgagccatggcacctggacttatcatgacttttgaaaagccaggagttgactgtgactgcctggggtgatatgttacgttagacttgccctgggaggagtgagaggactactctttgtgagtcaagagtttctgccaagtggatctttcttattcagaaggagagaatcaaatttgttttattgtccatttcacaagtgacattaaagggaaaggagtggggaggcgggggggtgggggttgagcatgaaatgtcaaaataacagtggtttttatctttaaggtttggcatggattttaaagaaatagaattaattggctcaggtggatttggccaagttttcaaagcaaaacacagaattgacggaaagacttacgttattaaacgtgttaaatataataacgagtaagtagtaaatgtttacatttttttgaatggcaaggtacgctgaatctgcactattcttttttatgcttctctcttctttattagggtatcatttatttctttctgatcctcattaaacatttcattctaccaagaggagtttggcttactccgagatgatctcactttactgtggttatttcaataaaaatggatataccattgatcatccttttggtgctatcttcagaactgaagctatagagtcatttgctttaaagtgacatgcaaattcatgaaatgctccgtattttaaaaaccgtggcaccagatagaacctatcattacccacaaaataggtgatctttgagatgttctagtcttaccttcttattttatagatgaggaaactaagatccagagatgtgaagtgattttgtctaagataaaagctagatggtaattgttctctggttgtctgttattgtataaggcactgctccaaaatgcagtgctta

SEQ ID NO: 25597 - DNA, 1032 bp, Homo sapiens
cttcctttttcttacttggattcatagacataatttgaattaagtttttaaatccccgctccacttttcagggaaactatattcagtattcaggggacccactgcaggatttcactctaatgagatttttggatcgatttgtataccgaaatccaaagccccataaaggcaaaggtatgcttctatttagtgaattatttggctttcatttttaatacataataaacaatatgagcttataactaggttttgcattatactgtcataattttacatttcagaaaacacagatagtgttgtgatgcagccgaaaagaaaacattttattaaggatattcgtcatcttcctggtaagtataaaccttagacagttgaaactgaaaagacaatataagacaaagatgcataaattgtattattctttgttctaatttatcagaataaaacctgagcatcaaagacattatccatcttttttcccaagaataggtattcttaaatctactgtatctgactgggcctttttttttttttttttaactttattacagcaaatttgaaacatatccaaaataaacaaaatagtatgatgaaccccctccccattaccatcacccagctttgacagttgtcaccattttatcatccgtagcttcatccacaacccctatgtatataattattattgcttacaattcagaccatcttaaagctctctaatatcagcttagcagcacaaaaacccacagctggttttgtcacagagcatcattttaaacttaataacctacttctatatttgctagccatcttctggatctgagtctgttgttgtattcaaagcagacatttctttgcataccagatctcatctcccttttgttcagagaccaggattaaattagaccttatagatcatttaatttccagtgacttacttcacagaggtccagagatgtaaaaggacttacccacagttagtaagttagaattaaaagccaaatctccttttactcaggatgagtcagcaat

SEQ ID NO: 25598 - DNA, 1035 bp, Homo sapiens
tggtgctcccaaacacttctctttaaccaccttacaggcatagttatctgtgatatggtccatgcttaccttctagcctcatctcccactactccctacacaaacctagttgtttactcttctgaactgttttctgcaatttgcttgggactgtttttcccttgtctacaatccttcctattaaaattcgaggaccccttaatttgtggctcatctataaagttccctgactactcctctacactgcagaatttacttaggctaaaaaacatttgggcttttttattatctttttttatttttattgagacggggtctccctctgtcacccaggctgaagtgtgcacaaacacagctcactgcagcctcgacttcctgggctcaagtgatcctcccacctcagcctcctgactaggtgggatgatgggtatgcaccatgggccacccacacctggctaatttttaaattttttgtagagatggggtcccactatgttgcccaggctggtgtcaaactcttgcactcaattgatcttcccaacttgacctcccaaagtgctgggattacaggcatgagccactgcacccagccccatttttttcttaagtattcattcttttcataattgacttttctaatcttcagaacaagactgtgagctccgtgaatgaatacctagctccggttccttatacctagaatgaactttataatcaccagacacactgcagtttgttttcctctctcctgtggacctctgctgggaagctgcatacatctctttttcctgcctagtgaaggcttttgaatttgcaactcctggttctgtacccgtcaagaataagttggctggccctctttagtctgctgatactgataggaaggacaagtacactacttaaaacattatttaactgccccatagaagttaatagaaccagtgctggggaatacccccatctggatttaaccagcccatgtaataggtagatcttttttgtttttccaaaagtactaggcctaatcataggatt

SEQ ID NO: 25599 - DNA, 1821 bp, Homo sapiens
agacacagagcagctaagtgacttgtgtgaagtcagagagcaaattagtaagagatagtggaattaaacccagatctcattattaataaatcagtgattttttttcctaatacagtgtacctctcaagggcaaaggcagtagatccaggaaaaaagaaataactcccttgtacatttcatagtatttgaaatgacttccatctgtaggttgtaatcttattatttagttttttctgtaacttctctgatcttctgtaaattaatggcaaaatcaaggccttgtcttggtactgtgatcataatattttgctaagttaagacaccagagtaaaagcttttgaaatcctttcacaaaaattccatcttctcttactgcttagccctagtgtgagatttttaaaggataaaaagagtgctgcggcataaaggactgaaaatgaggggttggtataaacctacagaagagcctggaaaagattagtaggaaaaagttagtgcatcttatacactgaactgcacagagaacttacctaggaatgaggacagtagaatagaggtatgtcaagagccccacaaatgatgctgttacgccacctatgcccagttgagtattactagattaggaaatagcagaaggacagagcaagtggataaggtgttacatttttcattagtttatattttatcttgaacatgaaagctccttagggaagtataagaagtgcagttacatgtctgaattggttagattgttcagggtatttttaaacaagtagaacttgtagcatggaagggctttcagggtttactttagtcagttcaagcatagtctcaaaaagaagaactttattttccaactgtttgggtttttctaccaggtgaacaaaaagcaaaattaaagaaggcatgaattaaaaatttttgtaacctgaggggtaagtagattttggtaactatgaccctttctatatgaagggaataatcaaactaaattatagatcacccagttcaatgtggctcatttcattcattcaacacacattcaccgattattgtatgccaggccctgttatatactagggacacaaaattgaataaaacataatccaaatactcaagcacaaaatcctaatacccaactaccatctagctatatgaacagattttgctgtacctgcttgcatcctcactgccagaactgatgtcctgagatctttcagctgccttctataactagtcatgtttgtaattcagagaagttgggtaattctacattaatatgttcaaccaagggaaggaaaagaagtcagaaaaaaacaagagacagagaagtgcaagggagaagtaaggggaggagaaaaaagaaaaaaaagggaagaaaaggaaaagaaaaggacaaaacaactggttggagaagagcactataaaatgcctcagattgatagtgtaggcaggtatttttctttttctttttctttttctttttttttttttttttttttttttttttttttttttgagatggagtttcgctcttgttgcccaggctggagtccaatggcatgatctcggcttaccggaacctccacctcctgggttcaagcgattcttctgcgtcagcctcccgagtagctgggattacaggcatgcacccccacgcctggctaattttgtatttttagtagagacggggtttctccatgttggtcaggctggtcttgaactcctgacctcaggtgatccgcccacctcggcctcccaaagtgttaggattacaggcgtgagccaccacgcctggccagaagaccaggcagaaaacca

SEQ ID NO: 25600 - DNA, 1060 bp, Homo sapiens
catttttcatctaaagtcaacaagtttgataatacactataaaaacgtggcaaaacaagtacatactcaatatattacttgcagaagtataaattggtttgaccgccataaagagcaatttggcagtatctacaaatttcaaatatgcgttttctttgagccagcaaatctcctagaaagttatctcatattcagactcaaaaagtgggaaaagatatgtacataggattactcattgggtattgctcatactcacaagagattggaatagctaaggtgtatttagcttatgacgagttctaatctcttttatttctatttttctggataaataatagttgtacatatttatgaggtacatgtgatattttgatacaagcatacaatgcataatgatcaaatgagggtaattgggatatccatcaccttaaatatttatcatttctttgtgttaggaacagtccaattctactcttctagttattttgaaatatacaataaattgttgttaactgtagtctacctatcatgctaccaaacactggatcttattttttctatctaactgtagttttgtaatcattaaccaacccttttattccccccacccactacccttcagagcctctggtagtcatcattctactctctatctccatgaggtcattttttttttaaatttttcacatacaagtgagaacatgcaatacttgtctttctgtgcctggcttatttcaccaactgaaatgttattctctacttctgtccatgttgttgcaaattataggatttcattctttttatggctgaataatattccaccatgtatgtgtatcacattttctgtatccatttatccattgatggacacttaggttgattccctgttgtggctattgtgaattttgctgcagtaaccatgggatcgcggatatctttttgatatcttggtttctttcgggtagataccctgtagcgagattgctggatcctgtggtggttttatttttggcaacctccgtgctgtttttcatagtgactgtactgatttacattccca

SEQ ID NO: 25601 - DNA, 1031 bp, Homo sapiens
tattactaggtataataaaatgatatttagtgggaagacattcatcaaagtagaagtagttaatttgggccaggtgcagtggctcacgcctgtaatcccagcactttgggaggccgagatgggcggatcacttgaggtcaggagttccagaccagcctggccaacatgatgaaaccccgtctctactaaaaatccaaaaatgagccaggtatggtgatgtgcacctgtaatcccagctactggggcggctgaggcacaagaatcgcttgaacccgggaggcggaggctgcaatcagtcaagatcgcgccactgtactccagcctaggcaacagagcaagtctctgtctcaaaaaaaaaaaaaaaaaaaaaaaaaagtcgttaacttgcatacagttttattcatagatattttactactttattttggtagttcatcttataaaaactacttaagtcagatacgttgtggagctcattacctcgtgagacaacctgttccattgttaggttgttggatatggaataatgtggtagaaagaacttgggctttggagtcagggaaactagtttgaatctcatttctatcacttactagctatagtcacaggcaaacaacagcttctctaaaattcttgtttcttttctggaaaatagagttaaacctcctagagttgttgcaaggatttaataaagtatcatatctcactttatgtgtttagcataaagtaaaggcttagttgttaattccttcaactaattgctgtgaaaattgctaaaacttactgagcacttactgttagccaggtgttgttacagatagtttgtaccccgtagctcaatccttgcaacctgtgaggttaagtaagaagtgctctcatcttcatttttcgtctaccctctgcagtgatactgaataaaatcaattctcctattaacacttattcaagtatttgaaaaccacttattctgtttggttttgttaagcacatttttatcacatgacattatttttacctttgcgtgcatgatt

SEQ ID NO: 25602 - DNA, 1082 bp, Homo sapiens
cctctcaggaaaaacttgagataatgtgcttatgagatattttcattttaatgtaggaaaaaaaatttttccatttctgtggttagtttattgtggcagtatgtgagaaattgctcattggctgctaaccaatcagatttcttagctactactggtgcagagactaacatctgtcaagctcaacatggattcatattgcattgccagactggcagtccataatcttattactggataaacttttcagttcctgagcagagcagatatggtgtgctctctcagtactctctgacagtggaaggactgagattcaactgtcactggtccagatgagcagaattttagaggaaacaatttagcaaatgctaagctcttaggaaaagtatgttaatctaaagtaataggtatttttgaaaatatataaatcattgtcgggattgctacaagatatgatttttttaaaaaccaacgacgtagacacttgagtttttaaatacaacatacaatataaaagcaagaacaattactaagcaaagtcaaacctatgtcaaaacatggacatggactttaggacgctggtcagaattgcattgaaaaaggccacatacttttacgtggtaaaagaatactaatattaatacatgtcaagaggcgtggacacaaccctccacgtcattagcatttctagtacacaaaacttaagttgaacctggaaaactctttactgggaggaattcatgttataataaatattgttattccaataggaaaagcattttatctcttcactttagcctttgctgagtattgtacaaaaagaatgatgctgcactaaataatgaacttctttttgaagaatttaataactagatgcattttgccttcctggaatccttttgtctgtctctttgcatcgttgactcttgcttatccagagatctcagcttaaatatttccttaaaggtacctttcctgagattccagctggaattgagtccccttagtatactctgccatatcacctcttgcagtttataattacccagctgtttgtatgaatgttatgtctgtgtctcacatca

SEQ ID NO: 25603 - DNA, 1434 bp, Homo sapiens
gctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttattt

SEQ ID NO: 25604 - DNA, 1022 bp, Homo sapiens
caggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggttggtatctatcttttggttttttagtgactaatcttattttcctgtgactttccatcctttgcagtatttgtactccgactttgccttcatgtgaggaatgtcaaaaggatgtcttctgttttgttcagatgtagaatctttatgaattgaagattttttctttaaagttataattttaatgtactttggttagcctaaatctgtactatcctctggatagattcttagttgtaggcctgattgtatcagacggtgggcagggtcagagtctgtaatgatttttttctttgaggaaagaaaatataaacaatgaatgattttcaaggtaaggaaaagaagtttggaagtggtgctttcggaaagcaaaagaagtttcttcctaatattggcaagcagcaatgcaggagaaatgctggatggtagacaggtcttcattgccttccatgaagatggtagtgatttcctgatgtactatgaggaacaatcccgtagggatttcttaccaaggaaactttgacctttgtgttttggaaatattaattagtaaagcaaagcgccatgaacagagaaccatgctccgtcgtaatcttttacctcgaaccagaattcaaagccccaggctgtgaactcttgcctgcaagtatctgctaaggaaagccattttgtgtatctgcctccggtgtgctggaattacctgtggaccgcttatggatgtcatt

SEQ ID NO: 25605 - DNA, 1028 bp, Homo sapiens
tggccaccatccctgggacttcactgggtcagacctgaaggcagcacagcaatgggtcttgcccaaggcccattgtgactattgtgtggttattgcctgtggtcagtcaaggcccagaggttctacaatcagcaggtggcaaatctagcaagttccctctggccttgggtgggtccagagatgctctctggtgatccgcctgccttggcctcccaaattgctgggattacaggtgtgagccatcacacctggcctttgtctcctttactcaagcaggagactctcctcatagccacaacatctgggaatgtgctgggtcacacctgaagccagcacatttctgaatctcacccaaggcccatagtgagtactgcctggctaccactactgcttattcagagcccagaggctcttgagtcagcacgtgatgaaccctgccaggacttggtcatacccctcaagacagtgggttcccttccagcccagggtgtgtttagaaatcttgtctgggaactggggactgaaattggggccttagggctctgccttatgccgcattctactttggctgagctggtatccaaattgcaagacaaagtcctctttactctcccctctcctctcctcacgcagaaggaaagactctctctcagagctgtgaactacactgcctgagcttgtgtagggggagtgacactagcagtcccttggctgccccagctggagtcttactatatcatatgcaccccaggtccactggctctgagcccagcccagcaccaggacctgcccaggaattgcagtccttgtggcctagatggcctttcaagtttattcaggacctcagagcactgtagcccatggtggcaggactggctgcctagggctggtctaaattcttcctccatgggtgctggctgagttctttccactgtggcagggcagcgctgagtttcaatgcaaaaattccacagtcactgctttcgacttccctaagcacatagattgtctctccacaccatgtggtt

SEQ ID NO: 25606 - DNA, 1049 bp, Homo sapiens
gttttgtttcagatcttaaaggaaaggctttcaattttttcccagttcagtaagatactagctgtgggtctgttgtatacagcttttattatgttgagatctgtttcttctgtaccttttgaggatttttaccatgaagggatgttgaattttatccagtgctttttcagcatcaattgaaatggtcatatggtttttgttcttcattctggtgataacgatgtatcacactcattgactgactgattgattgattgattggtgtatgttgaactgtccttgcatccctgcctgaccctaggtgatgatgaatgatctttttaatgtgttgttgaattcagtttgctagtattttgttgaggatttttgcaacagtgttcatcagggatattggcctgtaattttttgctgagtctttgtctggttttggtatcagggtaatactggccttgtagtattggtttggaaatattccctcctcctctggtttttggaatagttgagtaggattggtattagttctttaaatgtttgataaaattcagcaatgaagccattagctttcgggcttttctttgttgggagactttttattatggctttgatctcgttacttgttattggtctgtacgggttttagatttattcatggatcaatcttggtaggttgtatatgtctaggaattgatacatttcttctaggctttcccatttattggcatatagttgttcatggtagcctctaatgatcctttggatttctgtggtatcagttgcaatgtctcctttttcatctctgattttatttatttgggtcatctctttttttcttagtgtggctaaaggtttgttgactttgtttatctttttaaaaaatcaactttttgcttcattgatcttttgtattgtttttatttcaatttcgctaacttcttctaattttgggtttagtttgctcttccttttctgtttttttaagatgtatggttaggttgtttatttgaagtgtttcctcttttttgatgtaggcacttattaccatatagttt

SEQ ID NO: 25607 - DNA, 1033 bp, Homo sapiens
catcctccgcctcccgggttcaagcgattttcctgcctcagcctcccgagtagctgagattacaggcatgcaccaccatgcttggctaatttttttgtatttttagtagagactgggtatctccatgttggtcaggctggtctcaaactcccagcctcaggtgatccgcccgcctcggcttcccaaagtgctgggattacaggcgtgagccaccttaccggcccacttggatcttaatttcattctttttattccttttactcccagttgtgatgatttatggcttttgtatgaacctttattcttccagcctatccattgtgaaagggagtcagcttgccagcagtcaggagcgggtgtgctctgatacatgtaggcctggcaggacaaccaaccctttgatcacttgagcccaggatgtcgaggacagtgagctatgatcgtgccattgctctccagcttgggtgatagagcaagaccctgtctgtgtctgtctgtctcgttttctttctctctgtctaactaactaaataaatggttacatagttgtttcactttgttgctagggagtatacctttcctttggtaaaatatgaatttgtttcttactgtttagaataggtaaggtttcttaattgctgataattatattatgtagaacgtctttttggcaagggctgtatttattcactatttgattatacttaaacttcaggctgggcatggtggctcatgcttgtaatcccagcactttgagaggctgaggtgctgaggtgggaggattgcttgagctcaagagttcaagaccggcctgggcaacatagcaagtgagaccccatctcaaaaaaaaaaaaaaaaaaaaaaaaaacttctggtgatttcagattgccttttgcagttgagttttattctataaatacttctttttttcctatttactttatatgtctggtggaataggattacttttgcatttctgagttttgaggcttttgtctccatagtagtaaatagtatcagattagtgtttttg

SEQ ID NO: 25608 - DNA, 1047 bp, Homo sapiens
aaagcttcatcaaatgttaccaaagctagaggaatcagaaataaacgagatggaagtgtttacaatattgtttgaagtccttattgcagcattttaggagagactttcttggttacgttcctgaacctgttgcctgaaaatactctgtcctttgcagcttttccagctttaagtcccaaatgtatgtattgcctcttttgcagtatcataaatattatggcacccctatcatcacatatttccattttggatttgagagaacataaattacagatcttttttcattccaaactctttgttccagtaggttacattaactgtttctaaagtaactggttttatttaggctatttattgaaaaatacctcaagcaacaaactgttactcataaacactgactactcaaccaccagttttagaacatttagggagttaagccatcttgtataatataagttccttttgtgttaatactaactgtttttggaggagactttttttttaaggtaattaactccctacctccttccctcactctgccaggacaattttgctatttagcttgtacattttttaaaaaattattttaacttttttagagatatcgtctcgctctgttgcccaggctggagtgaagaggcacaatcacagctcactgaagcctcaaactcctgggctcaggtgatcgaccctgaagggcctcactttttagcccagcttggtctcgaactcctgggctcaagcagtcctcctgttttggcttcccaaagtgctgggattgtaggtgtaagccactgtgcgtggcccagcttataaattttagttcagaatttcttttctttctctttttctttttcttttcagatcaagtctcactctgttgcccaggctgtccttgaactcctggtctcaagcaatcctcctgcctcagcctcccaagtagctgggacttacaagacatgtgccattgagcctggcttcagaatttctttgttctcacaaatttctttcctttaataggatacattttgtatagattggagaatg

SEQ ID NO: 25609 - DNA, 1045 bp, Homo sapiens
taccaaccatgcctgttaaaaaaatagacaaaaaccagaactatatctttttttttttttttttttttttttttttaatttaagtggtctcactctgttacccaggatggagtgcagtggtgtgatcacggctcactgcagcctcaacctcccaatctcaagcaatcctcccacctcagcctcccgagaagctaggactacaggcgtgtgccaccatgcccaactcttaaaaaaacttttttttttttttttgtagctatgggggtctcactttgttgtccaggctgacagaactgcatttttaattctatagaaatataattctttataggacttcctggtcaatacagtaatgtaagtttgagctcttgattcttcatcgccataattcccttctgcatatactgcatatggaaacatataattgagcatctgtgttccaggcattgtggctctaacccaagttgtctgagtatatcctagaagtctctgaagtactgtttatcttctttccctttttgttacttcttcacactttccttttggccacctttacagtgagtaaagtaggtggatagagacctttgaaaaagtatatctgtgttcctcaaacaagtcagttttagtgactattacctttggagataaagtccagttccttagagtggcttctgcagccatccatgatctctgaatctcatctcttgcccttcatatgtcaaataaactatagtttttgctgttccttgagtatgccatgttttttcctcaaatattatggtattcttggctcatcttttcatgggggccttccctgacatctaggactatattacatcctcttcctaactcatggtacaggttgtatgttttattgatattactttagttgcttatttttttctggctactttaatctctgtcatgggtgggccctctgttgattatcaagcacctggcacaagaactgggtcttaggagatacttacattttaattgatgaatctctttcccttctatacattttcactttgagatggtacca

SEQ ID NO: 25610 - DNA, 1044 bp, Homo sapiens
ttttttcttaaacttctaaaaaaccaactaatgctttctttacaataagagcaaaactattgtttgttttagcaaaatcaccaacctccacacttggtcattgtgatattttagcagttattacttttgagttcttttttaaagtgttttacttggttcataatttttttttttttgagatggagtttcgctcttgttgcccaggctggagtgcaatggcgcaatcttggctcaccgcaacctccgtttcctgggttcaagcaattctcctccctcagcctcctgagtatctgggattacaggcaagcaacaccactcctggctaattttgtatttttagtagagatggggtttctccatgttggtcaggctggccttaaactcctgactttaggtgatccgccctcctcagcctcccaaattgttgggattacaggcgtgagccaccgcgcctagccaagcttcataatttttatggaatttttgtgttacgtatacttaatactcttgagttgtcggaggtatttccccaagctatttgattatcatatttgcttataaactaggtaagggcagggccaggcatagtggctcatgcctgtaatcctagtactttgggaggctgagatgggtggatcacctgaggtcaggagtttgagtccagcctggccaacatggggaaaccttgtctctactaaaaatacaaaaattagcttggcgaggcattgggcatctgttgttccagctactctggaggctgagacaggagaatggcttgaacccaggaggcagaggttgcagtgagtcgagatctcaccactgcactccagcctgggtgacagagcgctctgccttaaaaaaaaaaaaaaaaaaaaggtaagggcagatgtaagactcctgagtaaaatgcttaaatttcattcattcaggaaatatttacaaggaacctgctaggctaggtgtcaggcactgttgtaggtgctggtagagaatggttaacagggtgattgggatccttactttagtggcacactcattctgtgg

SEQ ID NO: 25611 - DNA, 1050 bp, Homo sapiens
ctcactgcaagctccgccttccgggttcatggtattctcctgcctcagcctctgtagtaactgggactacaggcgcccgccaccatgcccggctaatttttttttgtatttttaatagagacggggtttcaccgtgttagccaggatgttctcgatctcctgacctcgtgatctgcccgccttggcctcccaaagtgctgagattataggcatgagccaccgcgcccggccttaaattgttaatcatatattgattgtttattcgtatctctttttattgtcggagagtgggcatctgtttcagtgcctagtagcgtggtagaagaaaagcaagcttagaagctaggttcagatctctacaaataagttttagtttcttaaaacctaaaaaaaaacctacctgaaaagttctaagattaaaagataatgtcttggctgtgtgcggtggctcgtgcctttaatcccagcactttgggaggctgaggctgcaggatggagctgagcctgggcgacatagtgagactctgttgctaaaaaaaataataatagtaataaagataatgtcttaaagtgtttggcatgtactaagtgcacaaagttatcatctcttctcttgagggtaggacatgaaggggctggggttagttttcttttgggactagaggccggaatgggacaggcaaatagaggaccatacttagacaaataattagcttttttcccttgatagttttagttgacatactgtgtacctaccttataaaagggcttttgagctgcttatagtgaatacctacaaaaaataatgtagacagatgcttgttctaagctttcacgtagatcatagagactttatgcatatttgtgagttaagtttatcgttaagcttatatgttctgaagtagaaattgccgtgtgctagagttgttgaggaatacttcatggaagagggaggctttgtcgtgctttgaagaatgggtagatcttagagagcaaagtgtaggctatgccactggtttgaagataaaaaagataggcagtattttggta

SEQ ID NO: 25612 - DNA, 1050 bp, Homo sapiens
cctgaccaacatggagaaaccccctctctactaaaaatgcaaaattagctgggtgtggtggcgcatggctgtaatcccagctatttaggaggctgaggcaggagaatcgcttgaacctgggaggtggaggttgccgtgagccgagatcatgccattgcactccagcctgggcaacaagagcgaaactctgtctcccccataaaaaggatagcaggaagaaagtaccaacctgaaaatatgatggcaataggataatacttggtagatattatagaaagaagtagaacaattagtaaaggaagtagaacaattctgtttgttatggtcatggagaagcatgaagtattcagaagtgcaaagccaaaataacttttacagatgattttccaagttatggaacgtgtctctgtgtgcttgggtatatacacatattgctaaacttggatacagttttttaaaaatgtgtgtatttaagtagccaccttcactacctactctgagacaaatggctgtgtggtgtatggtcggatgatagttactagaaacaacttttaagtcataaaagactaacatcctctgttttcccaaggagataatatgtacttttgattgaccttggatttggtcttcggaccagtacaagtagaatgtaggggattcccttgctaagctactagcttaataaaaagtattcatacaactcctgttcatacaactttatgattggtccccaaacaaccacttagaggctagctggatatcctgctggccagtaactctaataacttgttggagaagtatgtaactggtgaagaatacttatctaggttctctagtaacattttatcttttattgcaaagatgctctgattgtggcggcaatgcttctttaatcatagggaggataatgtagtgggaaaagaatgaggaatcaaatgagtgatttcacttaagctctcagagcctggagccctcatataaggtagtgataatccgtaacaaggctgtcgtgggaaacagatgatagggtgcaagtgttttgtagtactt

SEQ ID NO: 25613 - DNA, 1016 bp, Homo sapiens
agcaatacaactaccttataaatcaaggaaataatgtttagaatgctttcaagagttgttcgccattttggaaaattatatcatcaacatattattgggattgccattataatacacaagggtcagttttcatttgtagctgtcacattcatctctgtcttctgttgtagccgtacctgagtatttatgtattacaacgtacattttatcgtaaattttatttctcccttaacaattaagagttttatttggtttttctttaagttgtgtgtgtctgtgtgtaggtaggtattatctaggaattttatttcagcagagtaaaaggatatcagattgggtggggaaccattgctgtaaacaaggtaataatctgattctgtgttgaacaggtaacctaggttgatccaaagagaatgacacctaggatttgttgaagaatggatgaggaagtgctctcgctaaggggtgtggtctgcctgtgtaaggttaggcctgggactgttatagccattttgctgtcttgagggaaactacctagtagagaaaaatggaatacacagtggaaaccaccttgagcataggctagtttggtatttcgtgcaaaatacacccatcttcagagttctcttttgagtttgaaaacacaacctatgtattttaagggtctccatttgcctaaatctcatctttagcagtttaatctacaaacagcacaatcaaatgaaagcactgacaattgtttgacaaaaggcccaatttttttttttttttttttttttttttgagacagagtctcactgttgctcaggctggagtgcagtggtgtgatctccactcactgcaagctccgcctcctgggttcacaccattctcctgcctcagcctcccgagtagttgggactacaggcgcccaccaccacgcccggctaatttttttgtatttttagtagagacggggtttcaccatgttagccaggatggtcttgatctcctgaccttgtgatctgcccacctcg

SEQ ID NO: 25614 - DNA, 1034 bp, Homo sapiens
ctcccaggttcatgcagttctcctgcctcagcctcctgagtagctgggactacaggcgtgcaccaccacacccagctaatttttgtatttttagtagaggcggggtttcacttcattagccaggctggtctcgaactcctgacttcaggtgagccaccgcatctggccaattttacttctttatattcctgctttatattcaccatatttcttatatttagtataaaaaggtgaagtaatttactctgatacttcaaggtgatcttgaaagtttgatgaagtgaaatattaactgttttttactttttacagatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttat

SEQ ID NO: 25615 - DNA, 1006 bp, Homo sapiens
gttgaagcacaatactattaaaactggcagaaaatagaaattgctatattgtagtcttgggattggtcaccgaaaagcacctggtattgcctattgtcctaaatggttcaaattgcctacatacttactttaatgaccattcttagctgtgagttttagcttactttctagtgtttttcttttgaactgtagtagtgtgtttgtgttgtgtatgtgtgtgtgtgtgtcttcaaggttccatagtctatatggcagaaaagattgaaaccatctctgttttgtcaaaacagtaagtgtggtatagaatgaaaatctcattacagctggtttagtgaatgtgtaccttgattatttttcttagttattcctgtaacagagtaaacattaaacatggttgtatgggtagttctgatcctgcagtaaaaaacattgggtgttttttgcactttgataatggagggttacaaaaaatttgccattacaagtttgtagtatagttgtagagtcatggcagtcagctgaaggctaaaaactggttaaatattttgccaaagtggattagaaaaatctgtgaaagaataaatgaaggacaaggaactctgctgtagtagtgtggaaacagatttttttcttagtgtaagtctgccttcctttataaaatattttaccgaaaaatagtataaacaaaagctgttatataccctgccaaaattttttatttttaaaaagcctattgtgaaattctttgatagttgtggtgggattatgtaggggggtatccattctgagctatgtccattaagatatttaatctgaggttaatttgttccacttttctagggaagtaagcagaattggggtataggaggaaagagagcgaataaagaggcagagaagagaagtaagatgagtaataggggaaaaagcaaagatgggggatgtgtgctagtgatattgagcctttttacaaatattgcaaatcacaaatgtatcccttcagatcagc

SEQ ID NO: 25616 - DNA, 1072 bp, Homo sapiens
tgttgacagtagactacccctgtctctataaggaccttctaatgattatataagtggcacattgtcctatggaattataaagaggtgggtgtctgtggtttatttttcctctcttcttgtgtatttagggctttaaaatttattttcttaggcagatgtcagaaaacaagttgatgagcaaatataaatggaaactttgggaagcagtgactattttgatgttaattagtaccatgacatgaaggttaggaattaaagaaatagaactattttaagttagtaatttgaattactcctggtgacctttgcatttttagactctaaaattttgatttgatacttagtctctggtaaagtctaccgtatgtgaatgtcattcagttaatttgcgtcattttgccctcaagattggtagttatgtggatagaaaattctgaaataattggaacaaattagtgtgtaattaagagcttaattggcataaataggtgtaataggagtttcagttgtatgaaatgaacttgcatgagaggtggctgctattaaggctgaaagaaccttgaacagcttccaatagaaattttgcttcaaaatgttacaatttggaaactttccctttatttaatggaatgtgtgggattataaacagtatagaaactgcttatattaaaatggtgaatcaccaagttcagtatgtagtaagcttatatataaaaactagatgcataggtaagaagctcagaagaaaatataacaagatattaaaaatggttgtgttgtgtcaggataaaattgcttgtattttttaacttttgttatttttctatactgtatgcattataatcaagagtataagagtatttaaaatacatgttgtatttctttttccccttctctcccattaaaggagatattaggaaatgattagttttacaatacaacatttgggaggacacagtttgtgcactaaatctgttgtcttctcctatgtttttatttagaaattggtaaagatttttaaattgatggagttaaaagcattgatcctaccatgtcccttagcttttttgtt

SEQ ID NO: 25617 - DNA, 1050 bp, Homo sapiens
ctggattacaggcatgagccaccacgtctggcccagcatttggttgctgtgtctcttagtctccatatagaatcttccctccactggtttttgatactaactttttgaagagttcaggccaatacagttttctgtcgtccttttattttacctttgccacctgatttctaagaatgaactgaaatgattctcttaattgtatcttgcagtttattattttctaattattttgagagtaaaacttgttatactttaaatacatgctgtgtttggcaggtaggtattatttagagctcttcctgctttattcatttccagttatatttaagaatgtaatgatgatacatgcacatttgcttgttgaatttcatctagacagagtctgattgttaatgttgcttaagaaagtgttgatttacttagggtatagtcagaatgattcatttcaaacttagtggcatgtaagggatatctgtttaaccataggaaagacggagcataagcaattcaaataaattccaaggatagaattagtattggcaaaggactgagtttattttttggatttgacagtagcgtgagtagttctgtggttactttatatatttaaatcagttcctttctttcagttgtgacataaatttttactggcagggcactccatttgttatattttcctaacagtctttataataaagaaaaattggtgagtcatttaaaatagccttaaagaaatttaattttcttaaaacaattgttaaattttaatggtaaaatagcgctttcagattagtcttgttataggagaaaaaaactttaaaaaatttctttttgtatagacagggatgtacacggtggaagtcatttctgaagttacgatgcaagagaagtgcctgatggcatttgtaaatacagatctttgtcttaatggaacttgaataagtaaatgaaagctatttgcattttcaaagtaattcgtacagatactacgtttaaaaataaactttaagaccatattcttacattttgaaacatcctgcctggcatact

SEQ ID NO: 25618 - DNA, 1037 bp, Homo sapiens
agtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttattttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtgagatcttgtttaactgaagtctttctgtattattattaaattcactggtagtccaacacagaaaaagctcattattttttttggagacagggtcttgctctgtcacccgggctggagtacaggggcataaccacgactcactgctgccttgatgatctcttgggtttaagcagttctcctacctcagcctcccgagtagctgggactgtaggcactgccaccatacccagctaatttttatttttgtagaaatggtcttgcactgtttcccaggctggtctca

SEQ ID NO: 25619 - DNA, 1029 bp, Homo sapiens
ccgacgccgctgccgctgcgggcccgcgcgctcccggtgcgcccggggctgccgggactcatgggtggggccgggccaggttccgccccacgcctcggtgtatcctaccacgcgtttctgcttgtgttcgggagggtcaccccgcattatttagaacgttaagaattttgtcaaaagtctagtttctcagggatttgcggactttcaccagttttacgactaagttttgtcttggatagagggcattaaatgtgctttacccaatcttgaggatggcccgttttaaggcaaataagtaattgaaacttgggccagattttgcgtaacgtgcattcttctatttgcgtttttaaacagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaagtaagtaagatgttatgaatcttctgttcattaaaatatactgtggctagataatgaacttagtgctaaatttggattctgaagtctggaagagaccttaaatagctggtcatagtgttaaatgctaaaggcacacgaaggttaaagaagatagcggagatggagttagggcttggtaaagaccgccaaagtttgttgggggggaaggagtggttggaaagagtgagtggttggaaagagttctttttaaatctataagtcctgaatatatttttaactttagaattttgttaatttgcttttattagggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtattt

SEQ ID NO: 25620 - DNA, 1022 bp, Homo sapiens
gttttaatgaatttatacttgctgattctgctgagagcattaaaaaattaatgaattaatacttgcaaagtgcttagaactgtgcttggcacataatgcatgctctcaaatgttagcagttattggctgggtgtggtagctcacacctgtaatcccagcactttgggaggccgaggcgagcagatcacctgagggcgggagttcaagaccagcttggccaatatggtgaaaccctgtctctactacgaatacaaaagttagctgggcatggtggtgcatgcctgtaatgccagccaatctggaggctgaggcaggagaatcgcttgaacctggaaggcagaggttgcagtgagctgagaccacgccattgcactccagcctgggcggcagagtaaaactctgtctcaaaaaaaaaaaaaaaaaagttagctattattatcatcatcatcattgtactcgcatagagtttgcagtatagcctgagtgttaagatatctgtataaacaattgtaagtgctaggtagaaaatgttaatgtgtattgcatataaacagatctctcttctttgaaagccctactttctcttcttagtctctgatcttgaggattccgcaagattttccttgcactgtttcttctcactattaactctcccttggctaccttagactcatgtgatttcagctgtcatccctgtgccgagaactcccagattagtatcttcattcctgacctctgagctctagaatgaaacacccctaatatctgacagcttaaatacaagtcagaatttttctccttctctgttccttccttctctaataagcccccctcctaattccatattcatttaatggtactatattctcaaggtaaaaacccaaaaccagtggctctcaaattttaatgtgcaataaggatacttagggagcttattagaattattattttctgggccctatcccactaccattgaatatgagtttctgaggaaatcatctttcaactagtttacctgtctt

SEQ ID NO: 25621 - DNA, 1033 bp, Homo sapiens
aaaattattttctgtagctttctgcttattaaagcaccaccattaatgttggcatcagctacttattgagcacctactatgcagtcttctagaggtggaaaggaatttaaaaatatatgccatagttcctgcccttgaggggacttgcattcttactgggaagacacaacaaacacataaagagataaacaagttacaccacaagaagtcacaaaaagatgaagacacttaaactgggtcttaagatcggcagagaggaaggaactagagaaagggcatgaagcaagagtgagcctggggaaggtgcacagctgactgggaaacggtaaaaacccagtttacttgaggtaagtcagtccacctaggactctgaaaaatatgagatggtagccagaaagaaagaaagccttactggagagagcaagccttggatgtcacatcaagaagtttggaatttcactgtagacaagtaaaaacagaagagtttcacataaagcaatatttgggaataccgtattagagacatgcaggatagatgggagcaaagagtacttggagacagttagaaacctcaggaaaacttcaggtatcaagtgatgggaactcacctggagagtaggcaagtacgtagcagcgttaattattactagtttcataagctagtttcataaaatacaactcaattattttggagttatgctacagatgtagcatcaagatttttcagaggatgctgccaaaataaaattggtgaagtgtgtgatagtttttaaacctttctactaactgatcaattttagtgataaacagaagatgaaagggaaaagaattttattatgttaacattttatttaatagattgtgacttctgtagtatttcactttccacgtccagtcgatttggcgttgtgcttgcaagcactgccggccacataataagagaaaaatctaatttcaaatgaattcataaacttctgggaaacaaaaatcttggcttaaacttagatcctggaaactcaaaaaacttggcagt

SEQ ID NO: 25622 - DNA, 1047 bp, Homo sapiens
ttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagcccacaagtgtattatttttgcatgtatttattttagagggcagtatttttgaaatcattagtgattctcatttagctcatatatgccatatagaaatattttgcatttttattgtggtctttctttggaggcacttttttcctgtatcaagttataaaaggataaaagaagttccacatttcctctgtgtcaaatctgctgattgattgtagtgagtgggaggcctctgggatgaaaactagtaatttaaagtgaccttgagtgtcacctggatgaagtttcagagtgctaaggcatttgtattccataaaagaagttttgagatatcacgttccctgacaggca

SEQ ID NO: 25623 - DNA, 1084 bp, Homo sapiens
caaagacagggcagagaagtggccacgtacttagtgctgccacacatacattcaaagccctgctccacaccttgccctggccaggtccacctttgaggtgatgacgacagttgctgagaaaagagaaaagaccactggctcactacttgtttctgctgctataatagagaggagaaaatgatgaaatgctctttttaccttcctgtttgaagattgcctggtcataaaagggagtcagaggtctgacttctccatttccatcccttaggggactctttaacaacaaaaagaatgtattacaagtatgtcaagctgataacgcaaggcttttcctcctggaagattgctgtaggtgatgagtttctaatcccaaatatatttgcatttaccaggcttttgtgagtttaagaagttatctatcatatctttttttttttttctatagaaaaatgcttgtttctatcaagaatgactcctttataaactggggagtatctttaagagtggtttcaaccctgactgtatagtatcatctgttgaggagcttaaaaaaaatatgtaggcccagcccacactagactggcattggtacctggtatcagtattttttaaaaacttcccataggattctaatgtacagccaagattgaggaccatttgtctgtcatctgggattatgcttaataaattaatactgttttttaaattaattagatttcacttctaagtcattatcagtaaatttactcagtatctaactgacaagaatttctagcatatatttcttgattagtgcatgtaaaattctaaaagaatttctatagtattttccaggcaataagacaactagtgccccaaatttaccaaatgcatgagtctaagcctgtgctatatataaatatactcaaagccaagtttacatctgtgtacacaagtgtgcatgcatatgtacaattaaagactatagttgtaacagtcatgagcttgtgttttgattttactcctattcctgtattgtattaagtgtactatcatgttcttgaggcatatctccaggagatatgtttatttcttttccaggaaa

SEQ ID NO: 25624 - DNA, 1099 bp, Homo sapiens
tctcaaacttctggcctcaaacaaacctcctgccttaaccttccaaagtgctggggttatagatgagccactgtgccccgccatggagtcatgtgatacacatagtaagctgtcagatatttttgataagttcaaatagacaccaagtaaaaaaagattcccatttattctccccagcttgccaaccccctaaattaagtaatgaaatgaaaccagcaccttttcagtatatctgacttaaaatcattatttattctgacccatttaactgtttgcaggattttttccctagagcagacagctataggcctgtatcattaaggattctcaaataagtgaactattgaaaccacataaaagccatcagttgcaaattctacttctctttgtttaagtagctaaaaatgaaagtggtggaaaaaacaggagataagcatattaagttctctactagtgctgaatctttaaatgactagctaagcagcgaagaagaaatcattctagaatgcagtgctctggatcctgctttgttataaacagttataatagcattaagttaacagtatttcacttaaacagctggacaggtggagaaaacattgtttcaggagttaggctttgtaatcttagacttgagggttttctcaatttctctttgtttatgataaagaaaaaccctattactactccctttgtttttggttaaaaactgaaaataactgattttgaaatcaaataaaccagtgtaatataaagccatccatgtgttctgctaatcccttaaaacctatcagttgcttttgtgtattaaaggtcttctccacatgcttttgtcttcacttttgcctaactaacagatgtgcgagtgccagaggatcacccagagcctccaacttgctacccactgttttgccaccagagtgaatacctatttccttgtttccctcagggcctggcagaaaagaactgccttgactgcagtcatatgtcatcccaacatattccactcaaagcagtacaaagttccattgtttaagtttttcaaaaggcagagtttgactagaatttttttttatcagttataatactatactattct

SEQ ID NO: 25625 - DNA, 1205 bp, Homo sapiens
tgttatttttttgtatgtgtgaacttgtagttaagtcaaatgccatttcaaaagataatattataaaaatataagacaaattctaaactccaccaacttgaaatttctaaaaaatctgctggaacagccctctttaaatttattatacgttaatgaaaggcctagtggtaaaattggcagcttaaatttcatttgagcttttcaaatgcattcctcttatccagaggagacaaagatcagtcttaaaatctgcaagtaattttagtcccatgtttcaaatgctgcctggctccaaaattattatacaggctgaatatccctcatccaaaaacccaaaatccaaaatgttctaaaacccaaaactttttgagtgtcaacataatgctcaaaggaaatgctcattggaagttttgagatttttcagttagggatgctaaaccagtaagtatgatgtaatattctgaagtccagaacacttttggtcccaagcatttcagataaaggatacttaacatgtatttgaatactagtcagggtacaccatctactctccaccaaattctttagtagcttttaattttgcaatgtatcagatttaagcccttttcgtctacccagtggtcccctgatggtatataatggctgctaatacactatctgtgcttttcagtgcagcgaaacaaatctcacagactgcacactactgcttatccatctcttatttctagaccagcactgtcctatagaaatatgtgagccacatgtataacttcaattgtctagttagcctcattaggaaaagcaaaaataactttaatacattttatttaacccagtatatcagaaatattgtcatttcaacatgaaatcaatataaaaatttatgattgagatattttacattccttttgttctaaatctttaaaatccagcgtgcattttacacttacagcacatctcagttcagacaagccacagtcagatgctcaataatcacatgtggctagtggttgccggactgtacagctcaccttttgaaaggctaccttttcaatctagatcaccaataattttttaaattaatttcatgtgaaactttaaagctcttctaagaaccctttttcatttgttcgttattaaatcaaaacttcaatccagtcacctttaactctttcatgaccatttccacatgcccttaccgttgg

SEQ ID NO: 25626 - DNA, 1057 bp, Homo sapiens
acctcatgggctcaagcagtcatcccgcctcaatcccccaagtaggaggaactacaggcacaaaccactatgcctggctaatttttttattttttgtagatacagggtttcaccaggttgcccaggctggtctcgaactcctgagctcaagagatccacctgccttggcctcccaaagttctaggattacaggtgtgagccaccgtacccagcctgaccctctacattcttgataaaaatattgagttcattgattttctcttcctggaaaaatattaaagcctatatgtttttgcttaaagatattaccagttcgtttaagaggaactggaaaggctctggatatatctgacggtatgtcattcaatctgtcaacgtatatttcttgaatacctactaagtaccaggactacgtcaggtgcttagaaaagtgaaaaatacacagtcagtctgctcacctagcttatagtcatgctactcatgatatcccatggtctccggtacacagacatgaaaagaaacctcaggacccattcactgactcactatttggcccctgctcctgtaacatcctaatggttggtatttatttatacaaactgaaactgtccaaagtcctctctcagatctttataaacttaactgatcttcataacatgttctctttttttttaagacagtttcacttttgttgcccaggctggagtgtaatggcacgatctcggctcactgcaacctctgcctcccgggttcagcagttctcctgcctcagcctcccaagtagctggtattacaggcacccaccaccacacccggctaatttttgtatttttactagagacaaggtttcaccatgttggccaggctggccaggctggtctcaaactcctgacctcaggtgatccacctgcctcagcctcccaaagtgctgggattacaggcgtgagccactgcgcctggccataacatgttcttaagtgaaaggaggaagtttcagacccactttagagtatgatttcataaggtgttttaaggtgagctgtgtgatttattgagt

SEQ ID NO: 25627 - DNA, 1071 bp, Homo sapiens
attatatgtatttaaattacttttatcagtaacccactctagcctcagaaggtataaagctaacggagaaggggacatttaaaaccaatgtatttttattctgtaaatctttaacttaaaatagtattttgaattcaaggttgtctgatatttaaatcagttattatctcgatgaccacatatcaatagattggaagtatatttctgttttgtgataaatccatgaatttgctttttggggaaaaagctattataaacatgttattttaaggctaaacctaggatgggtcttagtgagaatcagcctaaatgaaaattttccaaacaaatacattctgcttttgctaaatcctatgctaataaaagacattgtgcttcttataaaactttgacccacattatgtagcctaacagaaataaaggcatctgctaccctctatgaatttactattggagtctaccagtccctaatacaaataggaaaagaatgctcccaataaaagactcaagttactgaactttcccctccttaaaaaaaaaaaaaaaaaaaaaaaagatttacaattaaatgtgggccttgataaaatttgagttatagaagtgagtgatttctcccccctattatgggagatgtctttccccctctttatgcagaagacaacagcccaagtctcttgtgctggtgagagcagcctttctccacaacttaggataatactgttaaggagagacgggagtaggtcaggcctaggggagtgatcacactcagcctcttgttttacttcatggagatgtgaatgaaaagtaggtcctttcatggaagggattggagactcctatatttatgattgacctctcattgtgactacttgaaataaaggcaattaaaggttggaataggaccaaaccaacatattctatcacatttaatagttttaatagcttataagtatttgtaagcatctttaagtagttgtgagatttttagcaaataatttaaaaactgtatttaactttagctactactttataagttccaatttccagttgcatgctctgttaacatgattt

SEQ ID NO: 25628 - DNA, 1028 bp, Homo sapiens
ttagctttgggtcttgtccatttaaactcttctaaataatttattttaatctttcagattacttttttttactgtattgggctactttttattagttgtcattctaaatatttagtagccaagatagaaataatcattttgtagttacatttaaggagaattttgtcagcaatcattgtgctttttagaacactgaaaaaaatttctaggttgctttaattttcaaaattgtgtaattttgtaattctaatctatttggggaattagtgaataccttctcagtgagacttgtaaaaatctacttttacactttcccttacttacatgagctctaggttttctgtcatctatgtactaataatgtctttttctttattccagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccata

SEQ ID NO: 25629 - DNA, 1048 bp, Homo sapiens
gctgggattaattaaaggtgtgtgccaccacagccgactaattttgtatttttagtagagacagggtttcaccatgtaggccaggctggtctcgaactcttgacctcaggtgatccgcccacctcagcctcccaaaagtgctaggatttcaggtgtgagtcatcatgcccagagtgagttccttcctttctttacatacatctctttagagaacttgttccatttttattgtctgccttatcattcaactgtttgctctgtgaagaatggagccctattatctttgaattctcatacctattacagtgtctggcatttaggctttcaataaatgcttgttaaaaaatgagtggcaaaaaatatatatacattttcctttaaattcttatgtcttatattttaaagaaagtttaactgtaaattttatataattacctttattttggaaacttaggtagaatgccttaaactttacaaagtcaaaagataagtttagctattaatagtataagactgttgaacacaaagaaacaataaaatggtggttaccagaggctggagggtaggggagtagggagatactggtcaaatgacacaaaatttcagttaggaggtgtaaattcaagagatctatcgtacatcatggtaactacagttaataacaatacattgcatatttgaaaactgctaagaaagtagatattgtgttctcaccacgaaaaaaagtatgtgttaatgcacatgttttaagtagcttgatgtagccattccagattatatacatctatcaaaagatcctattatataccataaacatatgatttttacttgttgattaaaaaataaattaaaaatagtgtgactttaatgctgctgacactgaaaaaatactctttccttcagcagttaaagatagcagtcaagtcttcactctttaacttgaaaagttaaagttaatttttttatgaagtaaaaaaacttcctttgtgcccttttgaaaaccatattgcttcaataatgtgatttttgtatgtgaagtttaatttac

SEQ ID NO: 25630 - DNA, 1030 bp, Homo sapiens
agctcatgctagaatctagagcaccattttcataatagttttatacaagatagaagagtagcgactctatttctcctgctaaaatcaagatacctactctctttttccccagaaatcttcaaaaccagtagattctggtctttttaactgagccattagaatttagtttattgattggtgatattaatgatggcaaaattttgggcagttcggattttgtttaattgttttgtgaaattatcacaatgaattttagatgacatgaactgttacttctggtttatagaatacgaaagtacatgtccaccactgagaactataaaaacatgtctggcttcagtattctaaatgtttataccttacctagttgtacatatctatattctttgttgttgtcaagttaagatttgttttctagaaccaaaagtctgcccactcttatggccatgtttgttgataatactctactggaaacctttaatgagagctgttataacatataaggattttattattcatcagaaagaactgatttactctcttacttgagaatattgggatctcttctattaaaattataattagtagtcatataatttttgcttagagactttcaaagacatacataattgtgctcgcatagtcgtgccccataattaaatctttctgtgtttgtaatggtaaattatttatgttttaccttctttattttctaaggaactggcatttgatccatatgaatcgtatgctcgagatattttgcgacctggttttcatgatcgtttccttagtcagttatcaaagcctggggcagcactttatttgcaggtatagtaatttttaaatgaagatgtacaatgtctgaaaagtaaacttaaaaaaaaaattaaatcacttttttttccagtcaataggcgaaggtttcaaagaagctgttcaatatgttttacccaggctgcttctggcccctgtttaccactgtctccattactttgaacttttgaaggtaagaaaactctttattgttatt

SEQ ID NO: 25631 - DNA, 1085 bp, Homo sapiens
aaatccaactacattagtaactcagtatatataaactgatgaaactcagcctatttaaagagagtaattatatttgatttttaaaaattcactttaggcctggcgcaatggctcatgcctgtaattccagcactttgggaggctgaggtgggtggatcacaaggtcaggagtttgagaccagcctggccaacatggtgaaacccggtctctactaaaaaaaaaatacaaaaattagctgggcatggtggtgtgcacctgtaatcccagatacacaggagtctaaggcaggagaatttcttgaagccaggaggcggagttgcggtgagcctagatcatgccactgcactccagcctgggcgacagagcaagactccgtctcaaaaaaatgaataataaataaaaataaaatccactttatgcagcttataaaagattttcttaaaacagaaccacagaaatattttaagataaagggatgaaatatcataacataaaaactaatcaaacctgtataacaatattaattcaaattaactgataaaattacacaaagtaagcactgaggaggaaaaaagagaaacacttcctaatagtaaaagggatactatcatgaagatacaacagccattaatgtgtatgcacctgattataaagcctcaaaatataagaagtagaaactgacagaattataagaaatgaaaaaaattgctatcataggaaattttaacaggtctccatcagaaattaaaagatcaaacaaaaaagattaggccacagaagattagactaacacatttgattttacacacacacacacacacacacacacacactctctctctctctctctctctctctctctccctctctctctcattccctcacactcaattagccctccatatccatggcttccacctctgtggattcaaccgactgtggattgaaaatatttttggggaaaaataagcataattgtatctgtactaacataatgttgagcacattacaatacattacatcagggtacattacaataccctaaacaataaagtataacaactctttacataacgtacattat

SEQ ID NO: 25632 - DNA, 1048 bp, Homo sapiens
accagtaatgggtgaaaattcacatttctttatgtctttaccaatacttgatattcttagattttagaatttttgtcaaaatagtaggtgtaaaataatgtcttatggtttttatttgtatttacttgaatacaaataaatacaaggctgaggcttgagattgagattgagattgaggctgagcacctttctaatatttatggggcagttgtgtttccccttccatgaaatgtctgtacatgacttttgcccattttagaaaactgaggatttgtttttattaaaactttgttattatttatcctggatatttcctttataggttatatgtgtcccagtgtgtgacttatctttccactttttgtgatatgttgattaagcagtagttcttaatgaaattgaattagaatttttcttcattttatacttcttgtgtctttctaaataaattctttcctaactcaggttataaagatatcctgctatgcttttactaaaagtttctgaatcttttgcttatcaccgttatgtacttgatccatcttcagttggtttttatatatggtatgtgatagggaataatttgccaatgtcctagcactatatattggatgatccatcctttcctcatgaatctatactactggctcttgttttatattattttcatacaagatctgtatacaagctctccattacggtggtctttctgtttctgcactaatatcttagtatcttaatcactgtagcgtaatcatgtctttatctggcaggaaaaatagttttttgcctgatttttctttaggagtgccttagttgttcttggctcttctaaatttaggatcagcatctcaatttttcagaaaattgtttcaattttaataggaattataatgtttagagtataggacaattgacatcttgagatattatggtacttccttaatactatttaaggtcttctaaatgtcattcattaaagtttaaaaatttttcttcataaaggattttctttcttttttttttttttggagaaggagtctcactc

SEQ ID NO: 25633 - DNA, 1049 bp, Homo sapiens
aaacaaacaaaaaaaaaattagcagagagtggcattgtttagtattttttgcaaatctcttaatagtacgatctggattctcattttctgtttctacattcaaccggtttgtgatatgctgttttagttgaaatatatgaagaaaaactcagcctcctacattcaatatttgaagagagttaaggtatgtaacagctttttcagatattatcaatactgtatttttctttaatgtcaaaccccacaagtggtagtttcttttaggttaattgcaacatggaatctgaaactatagcaatgaacttttggttccttccagtaaaagtagcaatgtatccttttaaagagactggaaaggccttccatttggctttccatgattgccactccatcacattcaaaagtcaaagtcgttaagtgatctggcctcctactatctctctgatctcatctccagctctgctggctctgctgactctgctgtagtcacactggtctccttgctgtttgctcctctaaacaatctcgtgtctctgggcttctgtgcttgtcattccctctcatttcttaacaaatagattagatattgtgttaaataatcttaatttagtgaagacctaccagaatatatttgttgagtgtgaaaattatctctgaacagaactgcttatatacttggcaatggcattgtaatcagaaagactcaacacctttatgtcggactctgaccctcttatgtcttggtggaagtgaaagtgtaagtggtaccaagtcatttggattgccagtactttgctatagagtacacaaatgtgcctcattgcaataacactagaagttgtttactactgtagtttactaagaactaaccacatagatgatcatgcatttcaggaaaatatgatagaaataggaaagattctaacccaggtcttaattattcacatacggaagaatggcctgtatatcttcattatatgtgtaggggaaaatagtgcctatctttcaagatcattggaaggttagagatccttttgttaaatcatgtt

SEQ ID NO: 25634 - DNA, 1012 bp, Homo sapiens
agccaccgcacccggccaaattttttatatattctgaatgtaagttccttatcaaatatatgaatcgcaagtattttttcccattatgtgaagtgaagtcttcttatagatatagtattgtgattaataacaaatagttaatttaggagagtagagtacaagctgtagcagtgggagttttgtcagcacacgcttttagaaggtttcttccactgtatgaccgtgtattgatgaaaggaatgtgcctgaaactgtaaccaaaggagacatgcttccagaaaaatctcaaggaaaagtattgtaagcaacagtagatgttggatcagactctaaagtaaagggtggagagttaaccagttaacatgtaagttggagatagagttctcccagaatatgtaggcaccaaagtagttctagacaacaaggattacttctcatttaaagatggtgacattcttgcaaactatatagactgaaataaatcatattgaaatggcatcaacatgaagctgcccattctgtaattctgaaatcttctatcatgtaaaataattttcatgtctttcttttgtaataaactaatgatatctaaactaatgatgcccagtgtttctaaaatttagttttgctgtattgatataaacatttcctaataaaaatatgtaaatttaaaaatagttaatttaaagcttatatagattccaagaaataataatgttcagcacttaaactgttttaatcaagggttaagaattaacttcactgggcaaagtggctcacacctgtaatcccagcactttgggaggccaaggcacgtggattgcttgagctcaggagttcaagacatgcctgggcaacatggtgaaactccatccctaccaaaaatgcaaaaaattagctgggcatgatggtgcatgcctgtaatcccagctactggggaggctgggatgggagaatcacttgagcccaagcctgggaggcagaggttgcaatgagctgagatggcgctgct

SEQ ID NO: 25635 - DNA, 1024 bp, Homo sapiens
tcaaaagtttatctttttagtttcttgataatgtcctctgatgaacgaaagtttttaattttgacgaagtcagatttatctgttttttctttcattgtcttgtgctttttgtgtcagatcttaagaattcattgccaaatccaaggtcatgaggatttgcccctatgttttcttctaagagatttatggttttagctcttatatttaggtcattgatatattttcagttaatttttgtgtttggtatgagttaggagtccaacgtcattcttttgcttgtggaaatccagttgtcccagcaccatttgttgagcagggtcttatttctccattgaatggacttggcacaaatcagttggtcatagatgtatcagtttattttggtatgctcagttttatgctgttggtctatatgtctatgctttttcagtaccatattattttgattactgtagcattgtagtaagttctgaagtcagaaagtgtgagtgttccaacttttttttttcttgattgttttggcttttcagtgtcccttgcagctctgtgaatttgagggtcagcatttccgtttctgcaagaaaagattttggaattttgatagagattgcatcgaatctgtacattgctctaggtagtattgatgtcaacaatattaagtcttcctactcaataactcagaatggcttttaatttattttggttattttaaattttctgcagcagcgtattgtagttttcagggtaaaactcacctccttggttaaatctctttctaggtactcttttagatgttattgttcttttcaatgttaaatggaattgcattcctaatttctttttcagattattcattgcatatgcatagaaacacaactacttaaattttttttttaagttatttatttttttgagacagggtctcgccctgtcacccagactggagtgcagtggcgtgatcacagctaactgtagcctcaacttcctgggctccagcaatcttcccatctcagcctcctgagta

SEQ ID NO: 25636 - DNA, 1035 bp, Homo sapiens
agctttatacttgtagctttcatagactctgtggtccatttcaagttaattgttgtgttgtgatacaaggtaggaattgaaatacatttatttttaatgctgatatctagttatttcagaactatccgttgaagaaaccctcttcttttttttttttttattgctccttgcagagcagggctgtgccataggcagtatgcctagagtagtagcctgttgaagagattttcttttctctattggattgtgttgatatttttatgaaaattacatgattcgtgtgtatgtatatatgcagtcagtcctctgcatctgtgcattcaaacaactgtggatcaaaagtatctgcgggaggaggatggggggaaattgcatctatactaaatttgtacagatttttttggtcattactccttaaacaatacagtacaactatttacatagtattagttattattagtaatctggagatgatttaaggtatgtgggaggatgtgcacaggttgtatgcaaatgctacaccatttcctgtaggattactgagcatctgcagattctggtatctgagggaggtcctggaaccaatcccccatggataccgagggatgactatatacatacatgcacatacacacacacacacacacacacacacacacacacacacacgcacacacacacaactgtatctgtatctctgtcagtttatttctaggctctccattctccatttatctaattgttgatttctctacttatagtaagttttgacgttaggtagtgtaatactccaattttgttcttttaaaagctatgttttagtatttctagatctttttgaatgttaatctttcattgctgtgttaatgaaccatggcagatagtattttattgagttcctgctatgtgccagtatcctaggcaatattgtgtacatgcttatctctgttgtacccattgacttttgaaagtggtaatgtcccagttgtacagctgaggaaatagattttatgaggacaaactgcacaagatgtt

SEQ ID NO: 25637 - DNA, 1024 bp, Homo sapiens
tgcgtttcggagtcccaactacgcggagcgggcgccgcggccggagcgtccctccacacgtcctcccccagccgccagctccgccgcggggccagaccgggcccgggagtgcagccccggcgggcgggcggcggccgcggcagagggcagcccggggcggcgccggcgggccggggaggggcggggggcctggccccggggcggtggtgcgggatgccgccgcctccgggccgcgtccgttctccacggctggtacctgtgtcgggtgggtggccaggcgcgggcctcgccccccagccccctcgccagggctagcccggctgcgcggcgcccggagggggccgggccgtccggtggggccgcggccctgttccgcgctgcgagctcgccctctcgcggctccctggcccggccgccgccgcccctctccccgcccagaggcgccccgggggcaccatgcaggcgcagcagctgccctacgagtttttcagcgaagagaacgcgcccaagtggcggggactactggtgcctgcgctgaaaaaggtgaggagcacgcgggaccccgcttcccggccgcagccccccagcgcgggcgctggggaagggctggggaggcggggcgcgcgcagggccgtctttcttcccggtctcgccgcgtctccaaaaggacggcgcacacggagaggcccccctcatacggctggctctcggtgttgacatccaccgggtgtgtgggaatgccgcagggagccggggggagtttatccggataatccaacccctgagaggtgaatgctttgccctttgattccaggacaacaacagttggaggagcctcagttttcagcggaggtcaaagcaggccacttttccgtcttcttggtcttagcccggagctgctgtcagcctaccgttttaggtgtccagtacgctggttttagtggcttgagaatgccctggccgtaaggcttgctcaaaggaattgcgagctcgcctgccagtaggaacgtggcctgctctgctc

SEQ ID NO: 25638 - DNA, 1057 bp, Homo sapiens
ccctggccccctagccagtctttcactgaataccagtgtctgggtacgttattcatccattgtgcagcgtgggtctctgggtcagaccctggcaatttagcttctggttcttgaactgcaaatcgtttttagaacttgtaataagaattaagttcccccaaataatttctaatataggtttctccccacttctgactcttagaagaacactggcctagaggtgggaggtagtggacagcaaaattacttcccagagctagaactggccctgtaatcacagtgatagcaaatgatttctgcccacgatcaaatgagcagcatttatagaggcacatattggagaagcaatggaaaatttgggagctaacattaattttcaggaataactttgttttgttatatgttttttattactttcagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttt

SEQ ID NO: 25639 - DNA, 1013 bp, Homo sapiens
aagatcattttttgctgatggtatgattatgtacatagaatataaaaccctattaataagttactagagttagtaagagaattcagagttgctggatatgagtaacaccaaagaatagctttcctaaataatcagtgaaaaacttaattggaaaaaagatccctttcacaaaggcaataaagtaacatacataagaataaatgaaatccaaacatttttaagatcattatctaggaacctccaaattatttttttttaagacataaaagattcagcaagtgaagaactacatcatgtccatgggtagaaagacttaaatgagaaagatgccagttcttcagttaatccacaggttcagtggatctgcagtaagaatcccaacatgatgttttgtgccacttgataagctgctcttaaaattcatatggaatggccaggcgcggcggctcatgcctgtaatcccaacactgtaggaggctgaggcaggagaattgcttgagcccaggatttcaagaccagcctggacaacattgggagaccccatctctacaaataattttttaaagtaaaaaataaatttatatggaagagccaaagaccaagaataagaaaataaatgttgacaaatcgttttctacccaatattgaaacttactataaagccatagtgattaaggtagtgtggtaacaacacaggaataaataggtagaagagtgagacagaagaaaaggcccagaaatagacccacatgtaaatggaaattcgtggcattatgtattagtggggaagaaatgggccattcaacaaatgatgctggtacaattgcttacctgcagaaaacaaaataagatttattcctccctgaatacatgccaaaaagtatattaaaaatataaatataaaaagcaaaactaaatcttgttctgtttatgccctgtgcttcagtaattctatctatgggtgtctaccctcaagaaagatttgtacatgtattcaagatgtacaaaaatgt

SEQ ID NO: 25640 - DNA, 1034 bp, Homo sapiens
gagtatagtagtagtaaatgccagatggcttttcctataagctacatgactttgagaaatttacctctattattgctagtaaaatggataatataatagtacctgcctcatagggtgctaaggatgaaatggaataattgctataaagcatttagcacatttaggacttagtaaatacttattagttgcctttatttatggtagttattcagtaaataattgttgattgtatgaacaagtagtaatgtgagtgaataaaactgctgtttaattttagagaaatagggtttttgtttgtttgcttgttggtttgaaatgtaatcagagcagtacttacagattgggggcagttagacaatttttaaagatgttaataaccgcagcactgattctttagctaatgcaaatatgctgagtattttggtggtcattttagacctctgccatatctgtttgtacattgtttcatttttaaccttttcgtcaacatttcttactcattttagattgtcttagaattcagcatctgaaagcattgtttttgttttgttttgttatttactttataaaacttccataagagaagaattcaagtggactagtgaatagtgacattgtttattgtgtaacattcaatcttggtgaataaatcagtatcacattttctccagtgctctcaagatgcaatatttactgtaaacagactttttagcaaatttagccatatttcattttctcttttataaagcctaaaaagtaaatcatgcatcctacttttcattaagaccgtattaattctgtaatttcattaataaaatatgttaacacacaatggggatttataggtaaatgaattaaaatatacatatgaatccctgagccatgggctatctgctttttcatattcacttattcaaccattctcttattgttagagaactcccagaaagattctttttaaaaaagtggaatgctggctgggtgtgatggctcacggcttatacctgtaatcccaacactgggaagccaaggcg

SEQ ID NO: 25641 - DNA, 1050 bp, Homo sapiens
aggatactcaagtgtacttgattcatccttgtagaatggatctagacaagtctgatgttgcacatacaaataagaatatgttactaattgtgtttaatttcatatgtatttagccaaagaagtgccctttctagtacaaataataatttatgttgtggataataaaaatattttttcacctaatagtttgagctgctattgtggtttgcttttttaaaaaaaaaaaatttgcaaagtgctgttttgctttcatttttacttaaaatgaagtattttttcctatttgggtaattttgtggaccaaactatgacttgattatcaaatgctgcatatcattgattttgttcttttctagcctcttgttgctgtaccacatagaattcactcaacaagtagaaacgtgagagaagaaaaaacacgctcagagataacctgtaagtatatactatacacagtttatgatttaatgatagaaaataagttataatttagttacagttatttttgttttatttccttctgaatagtttttcttactaaacactgttaaaggtaaagtttaattagggcagtaagaatttcattttccttattcttgtggaatttttggtggcaggatgggatgtatttatgttgttactgtttgggaggataagttaattcctggaataagcagggtagaagtaattaaggcagtgccgtaaatgcctgtgtgcatgtaactcacctagagagcttgttaaatgcagtttcagattcagtagacctgggatgggatctgaggttctactaacaagctcccacgtcattcatgcactcatgatccaagggtaacagagaaatagaggtctgcaaactgccctagcatctgagtaacctggaaacttttaaaaagggattctcaggcaccacttttccatagagtccaattcagtaggtcttggattggcccagaaaccttttaaaataggcctccagttatttcttaggggcagccaagttatgggcccactaagacaagccattcattcacatgggatccaatactg

SEQ ID NO: 25642 - DNA, 1022 bp, Homo sapiens
gtggtgtgatctcggctcaccgcaccttccacctcccgggttcaagtgattcccctgcctcagcctcctgagtacctgggactgcagccacgtggcaccacgcccagctaattttttgtgttttagtagatggggtttcatcatgttggccacgatggtcttgatctcctgacctcgtgatctgcctgcctcagcctcccatagtgccgggattacaggcgtgagcctccgcacctggcctaatttttgtattttttatagagacggggatctcactatgttgcccaggctggtctcaaattcctgagctcaaatgatccaaaatgctgaaattacaggtgtgagtcatcctgcctggccttccctatgtattaaaaaaactcttcagtttttcttcagcatactttagcaacatccaacatactgtaacttattgcaggttcccattttcatatgatccaggtacaaaacactttttctcttctcttttgggcacaacagaaaagactagggtattctgccctgtcatctttctagcttttgaaaaaccaactggacctgctgttcatggttgtaaccactcttgtacagctttgattgccccaccttggttaaggtagaggtgtgggagtttttttgttttttttttgtttgtttgtttgagacagagtctcactctgttgcccaggctggagtgcagtggcatgatctcagctcagtgcaacctcccggactggagtgcagtggcgtgatatcggctcactgcaacctccacttcccgggttcaagagattctcctgcctcagcttcccaagtagctaggacgataggcacacgccaccacacacagctaaattatttatttatttatttattttttgagatggaatctcagtctgtcacccaggctggagtgcagtggcgcgatctcagctcactgcaagctccacctcccgggttcaagccattctcctgcctcaccttccgagtagctgggactacaggctcctgccaccacaccc

SEQ ID NO: 25643 - DNA, 1300 bp, Homo sapiens
cttgtgaaagaggatttgaccttatatgcatgtgtttattttgggttttcttttctctattccgttggtctatatgtctgtctttatgccagtgccatattgtttgattgctgtagctttgtaatatgttttgaaaccaggagtgtgagacctccagcttttattcttttttctcaagattgttttggctatttggcgttctttgtggttctatctaaattttaggattgttttttctatttctgaaagaaaaaagttgctgtttgttctccagattacattgaatttgtagatcgcattgggtagtacgaacattttaacaatgctctttcagtccataaacatggcatgtctttacatttatttttctaattaaacgttttgtaattttcagagtacaggtcttcctcctccttggttaagtctattactaggtattctttttgatgctgttgcaattgggattattttcttaatttccttttcagattgttgttagtgtatataaatgcatttgactttgtatcctgcaactttgctgaatttgtttattagtgctaacagtttttttgtggaatctttagagctttctatatgcaatgtcatgtcatcttccagcaaatataatgttactttttccttttcactttggatgtcttttatttctttttcttgtttctggccaaaggacatttaacatgatccaggataaagaatcagaaggatgagaattattccagatgtatcaattctaaataagagctacttatttcaaaataatatctagtagaaaactgttccttcatgtttatttttttcaggtgaatttaagtataattttttcaggattcaactggcatttttattggaattacattaatacagttattaattcataaggtacttgctgtctttaccatagtaagttcttctattcagaagggaagtgtcttttgtttttttcaggtcttttatctcacagaatactttgttttcttattttccttttgtcatctttatttctgtcttctacatgtttaacatcttcatgactctcataagctaacatggttttccagaagcatcttgacagatgtcattataatgaaataattacttgcagtatcaaacagctatttaacatgaaaactaacaacagagcagattctgttttaaatgataatttaataatattaaattaaatatttaatatttaaataaaatgtagtttaaataatgtttaaataatcattttaaagattttaaaagcaagtttaaactttgtatggagcctatgggt

SEQ ID NO: 25644 - DNA, 1045 bp, Homo sapiens
gatttggcttcaaggatgtttatttagtacttaatttagttagaaggaagatacggagatatggttcctgccttccagtaacttgttatccaatgtgaaaactagaatgtttatgtaagtagcagcctaactacggagaacccattgagcagagtgtgtgtgcatatgtaggtggtggtgctggcagtaaggaacggtgatggctgtgactagaaagacttaattcatgggtcactgaagatccgcctttgactatttactccgaaatactctgggttgggaatatctaggtaggatgctgtgtgaaagaatacacatagtgcagagtggctgatgtagcctaacttatatttggtgggttccatagaagctgtgagttccacttcccttgggataaggaagtaaaacttcagatgagccttcaagactggctaggattttgctagtagaataagagaatggagggtattccacatgaggatagtataaaagcaaaggtagtatgaaagtactaggcctgtttggaagtagtagtttgatttgtctagagtagtatgctctatgtgagcatggtgggaaataagaagtggaaaactgatgatagtttatggaaagccttaaatactagcccaaagcagccaggcccagtagctcacgcctgtaatcccagcactttgggaggccgaggcgggcagatcagctgaggtcaggagttcacgatcagcctggcttggtggctcgcacctgtattcccagctacttgagaggctgaggcaggagaatcacttgaacctgggagacggaggttgcagtgagccaagatcacaccactgcactctagcctgggtgacagagcaaaactgcatctcaaaaaaaacaaaaaaaaaaactagcccaaaggtttagattttaccctgtaaaacagtgggatttcgtttgtttttacaggttagtaacatggtcagagtataactgtaggcagattcagtgtacacaggcagatgggagagaagccctgctggtgagaagacatgttactgttgtg

SEQ ID NO: 25645 - DNA, 1024 bp, Homo sapiens
aaatggaatttctttcttgatttctttttcagattgttcacttttggcatacaaaaatgatactactttttgaatatttattttgtgtcctgcagctttactgaatttatcagtttaatagttttttggtggagtctttagatttttccaaatataagatcatataatctgcaaacaaggataatttgactgcttcctttgcaatttggatgctcgtttatttcttgctcttgtctgaatgctctacaaaaatttaatatataaatatatgtaatatatattatatgtataaagggatcaattcagcaagaggatgtatatagatagatgtgtgtgtatgtatacgtatatatatacatatatatatatagagagagaggatatatatgtagtgaccttcttagctcttcttaacagtttctattttgaaatcttttttttctgatatagctactcctgttcttttcttgtttccattggcgtggaatatctttttccatccctttattttagtctgtgtatcttcataggtgaaatgtgtttcttgtaggcaacagatcattgggccttattttcttatccattcagccactctgttttttgattgcagaatttagttcatttgcatcacatcagtgctcaaaaagttgtggattttggagcattgtgtatatcagatttttgaattagggaaattcaacgtgtattggcaagagttaaacattccactctttcctggagaacctaagtcactttgacatagagaagcagtcttgatttacatcccagatggcagagcttcaggtaagagacagtgttcacatccatcgtaactttgttgcttataaggacaaagaaccttgggttcattttataatccaatcctgaagtctgcccctttacatacagctctcctttgctctaagcctatcaaaacaccacttcatttaaatttcacctcacttccattttattcaaaatattacaaaaactcttatcttttcttttggtgagatgccctaag

SEQ ID NO: 25646 - DNA, 1090 bp, Homo sapiens
cttgttgtagcatcatgtaatatattctttggtgacttgatagatatctctagagaactgagtagactccggttttatttggggtatggaggagggaactacttcacgagtggtgttacgctcacatttttctaaggtagaggggtgtgtgtgtgtttaagagacagtgtcactgtagcccaggctggagtgcagtggtaggatcgtggctcactgcagtcttgatctcctgggctcatggtatacttctacctcagtctcccaagtagctaggactgcaggcgtatgacatgacacccagctaatttttattttttgtagagacagggtctcactatattgcccagtttgctcttgaatacctggtctcaagagacctctcacctcggccttccaaactgctaggattacaagcatgagccactatgtctggcctaaattagagtttttgatggctagtcttccattttttggaaacaaaaattaagtctgaaatagtctagtgcaacatgttggattttaagaatttctgtctagagtttgttcctttttcctttttttacagctgataagcaatttgaacctgaagcaaaataaaaacttacgcagaccttttgaccaaattgtttaaatgtgaagttactccaaggtgtctgactgttgcttctcatcttaattatgcagctttaaatttaaaaaatttaaaaaattttgtttaatttttttttaatttgtgatggagtcttgctctgttgcccaggctggagtgcagtggcccgatctcagcttactgcaacctctgcctcccaggttcaagtgattctcctgcctcagctgcccgagtagctgggattacaggggtgcaccaccacgcccggctaatttttgtatttttagtagagacggggtttcactgtgttgggcaggctggtattgaattcctgacctcaggtgatccacccgcctctgcctcccaaagtgctgggttaacaagcgtgaaccaccgaacctggcctaatttatttttaattttaatttttattttttattgttttgagatagagtctcgctctgtcacccaggcagtggt

SEQ ID NO: 25647 - DNA, 1043 bp, Homo sapiens
aagcatatgtatgtcgttctcatttcactgattttaatgaaagatatacaactgacccttgaacaacacaggcttgaacttgaactacacatgtccacatatgcagattttttttaaccaaactcagtatttgtgtaatgtgaaacccatatatatatggctgacttttcatatacacaggttctgcaggggctgctatgggacttgagcaagtgtggattttggtacactcaagggtcctggaaccagtctcctgcatataccaaaggtcaagtgcagatccagccctcaaataataggcacaaattctagaaattggttcattcaccccagatttaaacataagtgatcttaaaaaatgaagtttgttgctcgctttgggagcacatatactaaaattggaatgatacagagaagattagcatgggccctgcgcaaaaaatattttaaaaaattaaaattttaaaaaatgaagtttgctatacatagctttttttaaaaaatggatggattgtaatgacttcaggtaaaaacgggattctgaaatggataggttctaagttttatgactgatacgtttgaaaagtatattctcttgtaaaatggaaattatcttaagtaaaaggcttctaaggagatagattttattgggtagaatatgttgtgtttttataatgtacttaatctggactaccatcagctgtgtaaacattctgtttattttacacatttgccaccagtttgtacatttttgtgtttcattctctacattcacaggtgaagtcctcagtaatttaatgaaaacattttctaatgagctcacttaatcagtttctccaactcaaaacaaattggaggtagggatgctgtacacacagtcagtaagaaataaccactaacagcctgatgagagagaaggagaaaaccaaaatgcctcaaattaagtaagcagaacagtccagatttacttagagaagtggttcttaaccttatggacacctggcttagtcccctttattctgttataatggaatacctgagac

SEQ ID NO: 25648 - DNA, 1026 bp, Homo sapiens
gaattaaaatgtagagaatatttctataaggtaatactgcttttatagaaaataatataaaaaggtgaaatttaaataaactgctttataagattttagacaatgtatttttaaaatataatttaacttattttggtgggctttagaagaaaaatctgtaaactaaacttattttgtctggcagtaaagggatctagtttttttttaacactattgtttgcagaaagtattcacttattaatacatgataaaattagttgttttggatgagaaatacctttttgttaaacttatctttttaagttcatactatttaaaacattatttaaaatatttcacttactatataagatttttaaaaaataaactttattttagaatatttttggatttacaaaaagtcacaaagactcctaacccagtttcgttttttgttaacatgttaccatggtacatttggcacaactgaggaccagtatcagaacatgactgttaactaagctccaccgtctatttggatttcactagtttttctctaatgcctctttctgtctcaggattccatccaggataccatattctagttactatgtccccttaagcagaattttctggtgtgtgacagcttcacagacgttttgataactttgatagttttaaggagtgctggtcaatgttttgtagagtgtttctaaatttaaggttttttgtttttttttttctcatggttagattgcggttatagattctagggagaatgaagtatgtatgctgttgacataatttatcactggcaatattaactttgatcaccggcagtgttaactttgatcaccggcaatgttaactttgatcacctggctttttagttaaccaggtttctgcactgtaaaactacttttccccacttttccattttgttctgtttggaagcaagtcactaaacacagcgccacactcaagaggtaagaagttaaacttcacctctttgaggaagggagtagcttcgtaaattacttgaaattc

SEQ ID NO: 25649 - DNA, 1033 bp, Homo sapiens
acagtctccctgccagggagaggcaaggggaaaaccaccagttgtatgggaatctgagcttgaatgtagtcagcccctttttctgagaaaagaggtgcccccaaattcccagctgctcattgtccatttaatccactctgagcacccagggtcattcgtggaaaccctcctcctttcaaaatcattcccaagagaggatttcttctgtcagcaaacacaacaagaaaccattgaattaagaggtaagactgccacccaattattttgggtccttgattccactggacagaaacacataaacaggttgaattatgtgggctggagtgtttgttcctagtaatcagagagaggtatgtctagaacccagtgttaacctaggttcttaccaagacccgagatgagacgaaggtttttttggagataatttattttgggagctggggactggaaggagtaaaagagaaatagggaaaaaggtaatccaaggatgcactgttgagctgatcaccactgtgagaagctgggatctgatcctgtagggcccctctgaagacctgtataggatgcaacccagaattgtctgcttaaggagcaaaagaggagaatatccaccagctcctgtctcccattggtcaagagtaggatgactttcaactccctcccaatttaagacttccatcgcatagtttaaaccctaacttacagaatatcagatggaactagaggaggaatggaagccacccagaaatcatgttcttgacatggatgtgttacccttgtcagaaggggagaggatgagcaggtttttctgtcaagtataattgcatattttacatgcgaatattggttggttggaggaagtttaaatatcaaattaagaacagatattgatgttgggcatccaaagggtacatcaaagtggtgaattatcgtattttccaatgtttgagtcccacctctccaaggcagaaaccagaacaccagcttttccgacctatattataggtagaatgggggccagacactgacatat

SEQ ID NO: 25650 - DNA, 1044 bp, Homo sapiens
gggtcaaaggttatgtacatttcatatttttgatacatgattgctaaactgttgccccaaaaagttacttcagtttctgtcttcaagagtactcattttcccatccacttcttccttgctcagtagaagaggcttccctcttcctgcaagggtttatcctctcagttccttcctcctcaaggatcacactctgcccacttctcatttttatcttctgcctactcatctgccggttctttccaggagattcatttatcccttccccagacacgtttggaagtctttgcatctcccatgcacttgcatgtacttggccccggggattacagcagtgaatacgacaggcaaggtctctgaccattcattgtgagaagacagatggttaatcagtaaacaaactggataatgtcagatcatgactggtactgtgatggacataaaacaaaatgttttgctttagagtgagagaaaagtagtggctaccctagctaggtagtcaggaaaggcctctctgggaaagtgatatttgactgtggggcgtgagtgataagaatgagtgataaacgcagggtgaacagcaattccaaatgtcctaaggtgagaagcagcttggtgagtttgagcagctgaaggaaggtcagtaagcaaagaaagcaggcagtgacatcaaaaaggtaggtaagggtcagattgtgtaggagccttggatgccagagtaagggggttagaatgtatttgaagtacagtgcaagcaactgaggagttagcaaagaatttacatttgtcttctgtgtggaaacggaagacagagtgggaggggcgacaagaatggaaacaagacctgtctaccagattgttgctgtggtccaggcaaactatgaatgaagtagacaaatatgtgatacaatttagagacagaattgtctagctttgctgatggattagactagggaaagctacctaagcttcttagatttttgctgggcatgaggcagattccccttaactcttggtcctttagctgccactgtttcttttcctgta

SEQ ID NO: 25651 - DNA, 1034 bp, Homo sapiens
cagctgtttttagatacttggttatgatttcattctagatagaaaaaaacagattgtatatataaataaattttcaggtaagaaacatgagaatgaaatattccaaatgccttatttctctgagtgttgtattaaatatgaacagttacaagcagtaaagaaaaagagaattagtagcttcagcagtttttgaagtcataagcaccaaaattcattctccctactattttaaggtatcatacctatcttcacaaagagtgaactgtttaagtgcattcacagataggattatttgattctcacagtgagtactattttacaatctattaaactacagtaagtcctcatttaatgtcatccgtaggttcctggaaactgtgacttcaagcaaaaggatgtataattaaatcatttttaccataggctaattgaaataaacaagagttcctatagcatatttctggtcacaaaaatttcacaaacttctaaataggttatttagaacacttctgatagtaaacgctgaaataacacttctaatgttaaacattgaaataaatgtaatctatacatacatttaagaaagattgataaaaacaagtaagataattatttatccaactgttccagttaagttattccagggttttcactggccagatcctatcttggcagctcagggcacaaggcgggaactagccctgcataggatgccatcccattgcctggcacactcacacacacccacatttacttgcactgggaccacgtaaacataccagttacctaacaggcacactctgggatgtcagaggaaactggggtactcagagaaaacctatgcagacatggttcacccagacagtagccctggctgggaattggtattttttcttatcaatatcataatgaaaccatgttgaacgaaacagtgttattcaaggacctgctgtacttctgataatatgcttattctacaagaaatgtaggccttatgataattcgtagaataatgttgctgcttttggttttga

SEQ ID NO: 25652 - DNA, 1023 bp, Homo sapiens
gaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccgacttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatccttattttttttttttttgagaattgctaaatggaaagctagcctagaagcaccaagtaaatatattcaaggaatataagttgtttaaacattagaaaaatttttgcactcattttttagctgtattaggaatgtcaataatcctgtagcaaattttcacagagaactttaagaaattcttgcattggtcgatttcaatttgaaagctttttggtttgtttgctttttaaattttcatgttctaggaaactatgattctggttgttcaggattgttattattatagttgtgtaaaattattttattttgtgtgtattgtgcacagcttggggggggggcgggaaatgcactaattgtgctcttccttataaatggtacatattactgacacagacaaataaagtttctaattgtttctgatttaatcactagtgatacagcatattctgtatgaaatgttttctcctttctcattgtcatctacttcattttttgttttcatgttttgaagaaataaaaaccaaaatggtattattgtgcaactggtatcatcatccaaagaaaaaaacagacaccaagtattcaaactcttgcaaacgtcaacccttcggtcatgcaatgttctctttttaatgtcccaggagaacacagtgtcagaatatttgtctgtc

SEQ ID NO: 25653 - DNA, 1030 bp, Homo sapiens
aactcaactttggaagaatgaaaataactacaacatcatgactcgcacctgctgccaccccactttcacaacagctgttgtgaggccacagcttccatctttagaaagacaaacaaaacgtgaacaacttcctgctgtggtctagctggagaatctgactaacctgaataagagtttgattctaagacattgggtggggtgaaataacttgactatattttctttgtgatatttttattcatttattattttaataacaatttatgataaaaatactatatttggaactataataaagcacagtgaaggaaaaaaaatgacctgtaagccaattgctcagagataacttctattaatatcttgatgggattttttgacttgttctaaaggagtgagttccagggcatagcttagacaatccaatggttaaggcatttactaaattaatgtgtttttcttttcttattattgtgatctgtgtttttctgcttttcctccttatgatgatgacaaacctattaatactgaatgctatattttgcctaaaataattctgtggccctgctcaggggagctatgcattgggtgaaatctctgatctttcatacctatctgatacccattcttgaagaaaaaactcacagtacagaagtttctcgattactgtttgtctgaaagtgcagctggttaaccttgctttcctcttctctatgttccttctcttctctttcctcttccccttgttcgtcaatttctattctctgtttcagcaaaacaatatcagtcaaggtaattgatgatgaggagtatgagaaaaacaagaccttcttccttgagattggagagccccgcctggtggagatgagtgagaagaaaggtgggggagctgctccagggctgagcccaacagcttctgctggcctgtgccacccctggatgcctgcactcttcagaacatgacttacaatgcacacatccctccacctatgtaacagggcacagatctcatgctgagccacagtaggcaggc

SEQ ID NO: 25654 - DNA, 1053 bp, Homo sapiens
ccatgtaaaaagcctccaaggtcaaacaagagctgtgcttctccacttttcctttttccttgttctcaatggtttctcctctatgaacacacacctctaaagattaatctccatgacccaactccgctccagcatcccaattgaaaggggcacaaaacttgggttccccaagattaggagaatcctacatgtagtcttccctgcttaacttctccaacaaagatctttatgattatggagattatatcagaccaagaaataggatttgactttgagtgttacagagggaaagcccagtttcctgtgaagcactagctaatattgctttctaagtcaaaactttagtgtaagttaaaaaaagcactcaggggtaactccctgccacaaacgttgggcacacagccagggcactgtgctattagcctcggggtgagcccagattcccagaacatgcaagtcagcatttttcatccaacgatagaggtgtcctgctgaaatctaaaatagaagaaacaggtctaccaatctctgcaagcaaggatgttaattagttttttttttttcccccagaagaatgttttcatctttcataaagcattatggtcactagataaatgtaatcatttataatcataaagtacataagctaaggtctatatgcctccttttttttccctttgctttatatacagaaaattccatatacgataatattaggttggtgcaaaattaattgcagattttgccattaaaaatgggccatattaaaagtaatggcaaaatagtaaaagtagcggcaaaatgttaaaaagtaattgtaaaaaccacaattaattttgtaccaatcaaatatgtaatggtaattttaacctacttggtcatatcaaattttttgttatttagaaacagtctttctagctgcctagttttattcaaaaattctgtgcctaatttattgccactcccttcttcacaatacagtaattacatgcaatttgtaatgagtttatcaaaggaaagcacagctagcaacaggaaatgggacatttttat

SEQ ID NO: 25655 - DNA, 1027 bp, Homo sapiens
cctgaagaaagtgaggtctggaaaacccagaatccccctcgtattgaaaggaggacagtggctcagtcttgtgggaaatcaccaaggattcctccgagtccatttttatagcaaattatacatctggattgtacctaaaactttatttcggcttataactaggccttgcaagtcaactgattgccatgtgtttttctcttcccctggcacctttaggagcacacaggaacatatgcaatcagatacctagaggttccccaaatttgagatggtccaagaaagacaaagtcaagttagtggagtattttgtctttaacatgggctgtacttgccagaactcagtgtgttgtgcccgggtagtgcattttgtagcaaagctatcaatgggtgcctaaaatatatctcttccttccactttccccagccagtgctggccccctgagaactctagccaccaatcaggctcagaatgtgatgaatgtgtgtgcaactaagcgggtaataactcttgaagtaaaatctcctcctctttgggaaagcttctttcctgctacaggggtgtggcaaggcagggtgagggacttcaaaacctagaatggctcaaggtttttaaattgaatgaacatagcagcgtatggtcagctgagaattgtacttctggaaatcatcacttatccaaaatgaatcagattttggcagtgtgtagtaactgtatacagattcaattcattttgctagtgcttacagtctacaagaaaggaagaattgaaaatgtctcattggttttccctcttctaaatgtttagatctccatgggctcccagggcttgcttgacagacttacaagatcctgtggcctagttttagaatgttatggataaggccattcttgcaggagtaaggtggtatcacattgtggtttggaagggaacacttcttcactgctggggggaatgtatgagtacaaccactgtggaaaacagtgtggagattccttaaataactaaaagtggaactaccatttgat

SEQ ID NO: 25656 - DNA, 1063 bp, Homo sapiens
catttaaaccttttactctgaaatatgttgttcagtgaaggaaaagacaggctagactgaaagaaaatactggcaaatagtatatctaacaaaatatttatatcagaatatttaattaatgctcaaaatttaacaattaagaaaacacagcaaaaaattggtcaaatatttgagcagatatttcactaaagaaaatatatgttaacaaataagcacatggaaatatgctcaacatcatttactcactagggaaatgtaaattaaccccaatgaaatagtaatgcacactgaatagagtagctacaattaaaaattgaccatatccaggtactgtgactcacgcctgtaatcccaacattttgggaggccgaggtgggaggttcgcttgaacccagcagttcaagaccagtctgggcaatataggaagaacctgtctcattaaaaaaaaattgaccacaccaaatatttataaatacatggaggaacccaaactcaactacactgctggttggaatgtaaaatggtacgactaccttaggagaccgtttttttaaaagttaaacatacacttatcatataatccagccattctacaccttggtatctacccaacagaaaagaaagcatatagctatacaaagacttgtacaactcaaaacaacctagatatctattagcaagtgaataagtaatcaaattataccatttccatacacagcaatactactcagcaataaaaaggaatgaactatttatatatcacacaacatggatgactcttaaaataattaggctgagtgaaagcctgactctcctccttcccctccccaaagtacataatggattattctatttgtgtaaaattattggagattcatactaatccacagtgacaataaaattattgattacttggagagggaatagctagagaagagaactttggggggtaatggatacgtttattaccttgattatggcaaaggtacatatatatgtgtgtgtgtgtatatacgtagtatatgcagcatatgtatacatatattttatacacacatataca

SEQ ID NO: 25657 - DNA, 1155 bp, Homo sapiens
ggcattgggacagataatcattgagttgcagctgtttgggtcatatgcttctttatagtgctactctgttaattttgcattatgctgtttcctggtacttgaattttgccagacaaatatttacggaatgagtgttaatagaaatttaaattggggattgaaaaaagaagttaggatgggcaagtaagtcagaatccagatttgttttatgttgaatagattaatcactcagttatttttagctaaggaaattgaccttttttaaaaaccaggtgaagaaataatttgagattcagacatgacaattctatttgcaagacctgtgagctttttatggacagtaatagtgtcttaaagtcttaagttacatccatttgtatatcaaattatgaaagggaaatattgacagaatccaggatgattatttatcaaggaaacactgcaatggatgtcagtcttcacagccatttaagaaaaattattatcaatcttgtaatttttctatgataaagacactggaagctcgagaacaaaagcattatagttgcctatgtgatgttgctttacaaataagaatatttctgtaaatgctcctaccttctgtcagtaatctctgtccatcattagtttaagtgttatataatccttcaattttaaattataaaaattattgaactaaaattttagcaaaaatgaaatggaatatgcctcttcttttctgaacaacgctaaatatgtctctatttatctttaaatatgaattataaaacctaccagagagagttgctctaaggattaaatgagattctgtgtgtggggtgtgtgtggtgtgtgtgtgtgtgtgtgtgtgtgtgtgttacccaataaatggtggtaggcactatataagtggcatttattataatcatcttatttcttattaaattggtagtgttcaaacttggttttatagatacttgtgaaggcattattatttttgttattatcattatcattatttttagagatagggtcttggtctgtcacccaggctgaaatgcagtgatgtcatcacagctccctgcagcatcagactcctgagctcaagtgaccctcctgcctcggactcctgacttgctggtactaaaggtgtgcaccaccatgcccatctaattt

SEQ ID NO: 25658 - DNA, 1042 bp, Homo sapiens
cactacaattgatgctgaggaaatgaagattaaggaattagtcttcacacttaaggagcagagataccctcaaggagggaggcaggcatgtaggaatataagggtaatgtttgatatctgtggaaggaactgtttaactgggggtgggtaggacacataatccagactgagaggaggtgaagctcagtaaggcttcctggaggaagaggcatctcagctccattttgtggagagtgtggcagagcattcagaaagaacagcatgtgcgtaaccatcagtgactctacctctagctctcggtaggtgcttggcatgtcgtaggttcaatccatgtttgtgcctgaaggggccaaggggcaaagcagagcatcaacctttccagcaaatcccacttaatggggtttgtagaacaccccaggaaatgttaataattgagtgacattgacagatcaggatttctgttgttgtaaaatggcacataataccagagaaagcaaatgccaaagaaacagaactcttgggaccactggtgagtttatactgacattcgaatgatgacctggagcagtggaccagtgtttgttacgtgcatggactacaaattaaagcgagctggattttgactggcttagtgacctggcctcagggtaaaccactccctagatgggtcagtgtgtggtaatcagtaagagtgtgggctcaacatctgtacacagaatgaggattcatgtcaaggtctctattatattttataatagaaaacccctgatctttctcaggatatttagcttggcatgatagaagtgctgtctctcccacccctccaacagtgcccttgaaatggaccaagaaagccactggctgagctaacaggaagacctgtcttctgcagggcatccctccttataggtcaaagtaaaaatggaaagtgaccttttagagtaccccactttacagatgagtgacctgagcactgagaggctttgtgactgagaatatcatgcatgttgttgtcagaatcaaaaaatcatcggaatcacct

SEQ ID NO: 25659 - DNA, 1207 bp, Homo sapiens
attggctgtcaggcccaaccacagatgattcctcaattggctctggccaatggctcaacaatttaactggaaagacatttacaagatctgctaaagaaaatccagtttacttgccagaatgttgctccctgcgtactccatggtattggtactaacaagtattgaaatggctgatagacatagatggacaggacattagagctggctaatccacaacccaataagcattatttaaacaactaagatttgactggagtacagtaaaacatccacagacaactggtggatgaaaaacagacagaactcttaacattagcaatgctaaatctattcattttctcttagagtggaattcttgaagttcatgcatgttaacaagagagattctgtgctgatacttgtttccaacttaatgctttatgtattccgctaatggttttcatatccctgaacactgaggttgcagacacactagaaacaaccagctcagatgatgacgaggtgaaagtggtaagaaatgcaataatagtttgcaaaaattttctcctattctgtaggttgtctctttactctgttgacagtttcttttgccttgcagaagctctttagtttaattagatcccatttgtcaatttttgcttttgttgcaattcttttggcatctttgtcattatatctttgccccagcctgtgtccttaatgttattgcctaggtcgtctcctaaagtttttatagtttggggttttacatttaagtctttaatccatcttgagttagtttctttgtatggtgaaagaaaggggtccagtttcaatctcctgcatacagctagccagttatcccagcacaattgattgagtaaggaattattttctcactgctgtttttgtcaggtttgtcaaagggcagatggttgtgggtgtgtggtcttatttctgggttctctattctgttttattggtctttatgtctatttttgtaccagtaccatgttgttttggttactgtcaccctgtagtatggtttgaagtcaggcacatagaggggaacaacacatattgggcgggaggaaagagaggatcagaaaaaaatgactaacgggtactaggcttaacctgggttttcaaataatctgtacaacaaacccccatgacacaagtttacctgtgtaacaaacctacacttgtaccacttgaacttaaaagt

SEQ ID NO: 25660 - DNA, 1035 bp, Homo sapiens
tggagggagagaaattcagctgtaatctcctagtttgccaccagccagaacaattggattttcttcaaataggagattagagcttccagaaagtatttctagttccatatgctgctttcttttaaaaggacacttattcctatttattcaaatccctttatgtcccacgaacatcactttccctttctgagtagcaaataaactgcttttcttcaaagtctttctcccagaatggaattacttaattatttgtgagtgtgcatatgtacacacacacatacacacagacatatgtgtgtgtgtaatatatatacacacacgcatctacatatatatttatatatatatatattttaaggagaatagaatgctcaacaggaaggattagtagagaagcatactttaagagcaatatttttcaagttagaaaaaatccaaaggtaataaaagcaactttcataaaatggttgatcttgtcagtaatctttctagaaacatctccacagcatgttaaactgcctccaaatatatccacaaagagccatgcggtagctcccatatttattgtttgccctttcaggcaatttgctacctgagaatagaaatgccaaaataagataaaatgtctatcaaattgggtacacagatcttttaaaaaaatttactctacattttcttaagctcacttggagtgattggacaaaagtgttcagattgaaatggatgcagtcccctgatgttaaaatgttgctgggacaaaagttacatatcgggttgttaaaaaaaacatggcagaagcctctgtggactatgtgtatgtgaaaatggcacatttcaacagcatgatctgtctataggataagatggtggttcctcaagttgagggggcatcagaataacctggaggtttgttaaaatacagattgctgaacttcatcctcagagtttatgacttagtagacctagatggtatgcaagaattgacattctagtaaattctcaggtatttctgaaattggtggtccagggactcta

SEQ ID NO: 25661 - DNA, 1343 bp, Homo sapiens
gtagggcctgagtattgtcacatttatgaaactatacatatgtggttctgatatgcagctagcattcagaagactgatctggaacggtcaggctcggcaaatgtatgtggatacatagtaatgataacatgaaaactttcaagtgcgtagatggtttcacacccacaatcagttgacagtgcttcttgtgttgattacccacctgtgaaaatggatttgcagcaattcctcttccctagtcctcactgtgagcaatggaaaacttagttgagatgagctttgactatggaatgagacaagccaattattccatgttggaactgcctctgaattttattatctataatgcttgtttttatcaacttagaaaactgacctgaaagtcataagctaaaccatcaatgggcacattagctcatgacatgtatacactagcagctgacagtggaatacaattcagaaagagagaaaaggaaggggtggagtcagacaccttcttggatatctactatgtgccaggaattactttaaacactgtgtatctgttctcattcaatccctacaacaatacttcaccttttttctgttcaataaaattaactgatccacggatccactctttgcacagagcactgaaatattctcatcagcaactttcagttaagcaatatttagacattacttttccagggccatggaaattgcagatttaaaccctgaaacctgtcaaaccttgtgcaaaatgacaaagcccacctcccctaacaccgtcctgaacagtggatccctgtggactagctagaagaccaacccaaaaagtcaggtcattatcactggaataattgtcattgatacagcaactacagtttctcttgctggtttgcttctttaacttctcttgtttttttttttttttttttttttttttttagttattagagatgatggaggttaaaaggatgctgcttaacaaagataaaagctcacttagactagtaatctttttttctttttaaagaaacataggattacagaaatatttaatgaattaataaggtacttctcaacacatttttttcattgccaactagtttttccaggttatgtacataattgaaaaagtgttgtgttgcgtgttatgctttgatgcagtcttgttttgtaatccattgctttcaaatttctatcatcatcttctaattatcttaaatttgcactgtgctactagaatagaatgatggtattattactattattactggcagcagaattgaaacctggagtataagtggtttgcagaccattcatagattcatgtaaccgtagagattcatggttgagta

SEQ ID NO: 25662 - DNA, 2003 bp, Homo sapiens
tgtgatgcctaacacggttatatgtgtgtccctgcatttgtgagtgaataaatgcaaactggttagtagttacagtcaccagtgaagatccacaggatagaaaagtcacctcagaagagactgaacaggaggctggctccttgtaaagagagttggccagaaaagcaaatgcaactcctcttgaccatctcctttacctgaagggtccttccaagaaaaggttaggaaggtcaagtatttaaaatatattcactgaatattcacaaagtgccaggaagttggggacataagggtaaacaagatagaggatgtctttttggaaagaaattgacagtttatgcagcacagcaatcaaaatgcagtgcaccaagagctgtgggagctccaatatagagctgtgatattctttcaggacagaggacctgttggtgtggaaggaaaggctgttcactgaggtggaggattaaaaattcataaaatgaaaatggaaaaatggacacaggcaaaaggcaggaagacagaaaactaccaataaaaaagaaaccactgacgtttgaagaagtgaaggaagtatagatagcatctaataaatcatctcatttttacagacaaggaaccagtccatgaggaatctggtgggtcaggtgtggtggcttatgcctgtagtcccagcactgtgggaggccgaggcgggcagatcactggaggtcaggagttccagaccagcctggccaacatggtgaaaccctgtctctactaaaaatagaaaaattagccatgcccggtggtgggcacctgtaatcccagatactcaggaggctgagcaggagaatctgttgaacctaggaggcagaggttgcagtgagctgggatcgcaccactgtactccagcctggatgacagagtgagactccctctcacacacacccacacacaaatctgctgagtgacatactaagatcacacagttagaaaggggcagatctgggcctagaacctggtaagcctagtcctcagtccactctttgcattgtcatcatgaagtaaaaaaaactgtggagaaggaattgagaacacaacacagaggattgccttgttactgtgctatgtatatgcatgtgacgtagatagggggaatgcatatcatatacggtttcaatccaaagtggcaagtttgagaagttaggtccctctgcagatgtctctgagcattgcttttacgtgaaacaaatggggtgagctgacaatggttagattgtaggcttagatcgaaatgcaggaccatgttgcttcctccatggctgacctctcagcactgcacacacagccttgagtaacagagggccttgggttcccacagctctgccacactgatcttatcagtccacctgggaagatattcccctcttctagcttactaatataccgtctgcccttagccttcaccttagatcgtgtgatggcccattttcctaccctcacttgtctgatagtgaaaagctgcagactttgatagctcaataacccatttagaagttttgaaattttctgacgtttatttattatacatccattatacaataaataagtaatcatgtttattatatatttaataatagaactattaaaatggcctggggaatcttctagcatcttggaaaaataactctgcattcatgaagaattacaaagtctaggaatccacaaagctccaagaacagtgatacattctattatttttacactgcctaacaaaaagaaaatgttctatagggagatcatattttgcataatctttggcatatatgtttaaatttttgagaaaatgcggaatttaaaacgcggagcctgtgtccatgtgcatttgaatgtgtgtatattttataaaggtgactgacaacaaatgaatccaatattaactgcatttttccactagtggaaacaatttgggagttcagtgctatagaaagaggatgttgtatgtatagaatacagtgatggaa

SEQ ID NO: 25663 - DNA, 1017 bp, Homo sapiens
tgtctgttttggtaaaatgtgtagaaacctaaaactcttaagtcatttactggttagagatagtgactatcaaaaaagaaaccaaaaaacccccaccaaaaccgtgcctaagttttctatttctttaattattaatacattattagacactaattcttctacttttggtaaatcatttttagtagtaattcaatgtttgttattaaagatatacaacttccatatataattttggagttctcaccccttttcattgtaaggactatgttttaccttcagaaaagacttttgggctcagagtctctatctctaacaacaaatcctctagccaaggggattttctacaaattaaaaaaaaatgttttttaagtttcactcctggcttcaagagatcttccggcctgggccttgggcctgagccaccatgatggccaaataaatatttaagtttttactatttcattgtattcttattctagtctggagtatatacattagaaccaagcttctggctgggagtgggggctcatgcctgtaattccagcactttgggaggctgagacaagcagatcacttgaggtcaggagttcaagaccagcttgaccaacatggtgaaaccctgtctctactgaaaatacaaaaattagccaggcatggtggtgcacgcttgtagtcccagctacctgggaggttgaggcatgagaatcacttgaacccaggaggcagaggctgcaagtgagctgagattatgtcactgcactccagcctgggagacagagcaagactctgcaaaagggaaaagggaaggggaaggggaaggagaaggggaagggaaagggaaaggggaagggaaaggggaatgggaagggaaaggggaaggggagaaaggaagaaagatccattaggccttacagaatcccataatgattacaactatggtaactggcataagcacagatatatatacatatttatggaacagaattcaaagtccagagaaaatctcatacatctttg

SEQ ID NO: 25664 - DNA, 1226 bp, Homo sapiens
ggcgacagagcaaaagccaatctctaaagaatttttaaaaaaaagtactctggagataaatgggcaaagtacatgaatagatagctcataaaaaaaggaaatataatttaactttaaaaagaataaaacatttttttaaaaaagatattcaacatcactaattataataaaaagctaatttcctttttttttttgagacagggtctcactccgtcgcccagactggagtgcagtggctcgatactggctcactgtagtcttgacctcctgggctcaagtgatccacctcaccctcctaagtagtgggacaataggcgctgttgcagtaagcttttgggagagacgaggtcttgctgctgtgttgcccaggctggtcttgaactcctggcctcaagcaatcctcctgctgtagcctcccaaagtgttgggattacagatgtgagccacttgcctggcccagagtacttattgataatgctaaatgtattggtctattgggctgacttcctcaggaatagtctctagtgactcctgagccaaacctcttctgattgcaagctccagaaattcattaaatccagctgatacacaaagggagatttttcagaacctgagcgaagctgggcctcacaaggactgccttcgagtccaaggtacctgtcctttctgtcactctcttgattatgcagctgtttaattctgtctctgcagaccagctttctctgtttctcattggatttggaaggaaattgttgtccagctgctggcaacatgcccttaattccaggagagagagaatgttattgtcccatttgggtgaggtgtcctccactgggccagtcagctgtttggtgccaggctgtgggggcagatgcagggaaggagtgcaggctgccctattcttggatgttaattgacggtgcagaatctttcgctttattctcagagttaggattatgccttctaagcacgttactctgaacccttgccaggttggtttgtttactcagaggaagaccctcctccctctcaccggctcgtctcttctcagtgctgtctggatgagatgctgttaatacagggtccttccctctactcacctcctccaggccatgcagttaggccacggtgctgagtaagtgcggtcctactcttcacaacagtgctctgggttcacatgaccccgggggtatgaagacttcatggggtacccacacaaggatagt

SEQ ID NO: 25665 - DNA, 1030 bp, Homo sapiens
aaccagtaagcctgttccacattgaatatttctttattgtgtgtctggaaaagtttctgaagtctgctctggggttagacattccatgttactagattagctcatttagaagaaaaaaatggcagacagatccctcatgaaagctaatgacaagttcgtaacagattataaatgttttactggttgctaagaagatagacacaccaggtatttctggaagctcagattgggcctttgttggcgtccccctgaccctcacacgccccctgcaatcgtaatggcaaggggttcttgacagggtttgctctgggaaagttggagagactttcttgctctctcgtagttgaatggctgcctccactattccagacagcctcctcagacatactttcaacttgccattttcctttttttctctacagggattaaagcctgtggtttccacagaagcaccacctatcatatttgccacaccaactaaactgacctccgattccacagtgtatgattatgctgggaaaaacaaagttccagagctacaaaagtttttccaggtgagggaagatactctacaacagaaaagcctgtgaaataaataggcttaaaaaatcccttatgaaactaaatcttaatctagtttactacccaccctccttctttttctttaagtagtattctcttgattttagtttgagccataaacgaatagaactttatataggtagatactgataaaagaggggagggtggttaatttcctcattagtatttaagggtgtgagggttttgaaatggcatgaatagctcttgatcatttattgcatggaagaagcaatagcctcaataactgagtagcctgtataactgaatgacccaatatatatatttgacttcgtgacacatgtaatgacttggcagtgggtttttttctcattgttttttgcttgcttgatattaaaattcactgagctattgctgaaagtagaggaggtgcttacgggtttgcacatgagtagagaatccagaatca

SEQ ID NO: 25666 - DNA, 1097 bp, Homo sapiens
aatgtaatgtaggagcaataaaaatgctgacacttgtttaaaactagatatgctgattctaatattcctatggaaaaataaacaagaatggcaagaataaaattgaaaaaagtaaatcaatgaaggggaactggacataccagatcttaaaacacttagccctcaaaaatgaaaacagttgagcattgatgaatgaatagacatatcaataaaacagaacagaaaatcaaaaagattaaaatgcatgagaaaatatctatatatgttaagagaactatctcaaatcagtgaataaaggatagactactcaataaattgtattgaaacagtcagaaagttatctggaaaaagcaattggcacccgcaaagcatacaccagaaaaactcccagtggttaaaggttaaagataaatgtacaacataaagccataaaagtactagaaggaaacataggagaattccttcttaactgtggcataacgaagtagtctttccaaccttgactgtacagttttgcattgcagaaagaaagaaagaagcaaagtcaaaagacaaatgaaaagcttaggaaaaagaaaaacaacttggaactacatcctaaaggaccaggccccctaatttatataaaagcttaaaaaaatgttttttaaaaactaaaagagcttatgatcaataatcaataaaacaagaatcaacaaccaaataggaaaatgagcaaagcatatgaacagttttacatagaaaatataaagtctctagaaaatataaagtcccctacttgcatgaaaatatactcaacatctttcagaataagagaaaagcaatttcaatctagactaaggtgccatttttcacctatcaagttgtcaaaaattcaaaagtttaataatatactccataggtaaagctttggggaaaacagtggatgggattataaattgtttcaacctctctagaattcaatttgacaatttttgtcagaattgcaaatgcgtgtatcccttgatcaagcagtaccacttctgataatgtataccacagatatacccacacatgtatgaactgacatacatataaggttattcattgtgcattgt

SEQ ID NO: 25667 - DNA, 1140 bp, Homo sapiens
tttatggtcctcacaaaagttttctaaggggtagctgggatgatagatggataccttctttttattccctgttctagctgttttctgctttgccctcactgtatttgcgactcacactgtattctgtttaatcccacacaagtgagtgttaagcatgtcttcaccatgccaagaggcaattgagtggccagagaaggaaataagggtagttcctgggtacatgactaccttgaccagtcagtgttattggcagtgtggctctgtagacaagctttagtctatctagcaagagtttttagggaagtttaaaaatggaactaaataaatatggggtggtcctaacaatgccttttttaaaaaagatgagacataattcgtatgccatacaatttgttatcttaaaatgtacagttctgtggtttttaatatatttatagagctgtataaccatcaccactatctaactccagaacattttcatgtaccctgtgcccattagcagtcactacccatttccactccactcatcccctggcaaccactaatctactttctgtctctgtggatttgcctattctggacatttcatataaatggaatcatatgatatgtggctggccttttgtgtctggcttctttcacctagtgtcatgttttcaaagttcatccatgttgtagcatgtatcagtacatcattcctttttacgactgaataatatttccttgtatgggtagattgcattttatttatccatgcatcagttgatggacacttgtttctactttttgactgttatgtataatgctgctatgacattcatgtacaaattatcatgtggacatagggtttctttttctgttggatataaacctaggaatggaattgccaggttagatgctaatgtttaactttttgaggagctgccaaactgttttccaaagcagctgagcaatttgattcccaccagcaatgtgtgaaggttccggtttctccacatcctccccaactcttgtcattttcctttttaaaaataatagccgtcacagtgggtatgaaatggttatctccctgtgattatgacttgcatttccctaatgacaatgctgttggtcatcttttcatctattctttggagaaat

SEQ ID NO: 25668 - DNA, 1047 bp, Homo sapiens
tcaaggaacccttttacctcagcctcccaggttgctgggagtacaggcgcgtgcccccatgcttggctaattttttttttttttctgtattttgcagagatggagtttcgtcacgttgcccaaactggtcttgaactcctgggctcaagcagtctgcctttcttggcctcccaaagtgttgggattacgggcatgagctaccgcacttggccactagtcaattctctttggcttagtctcctcatttgtaggtggggatcataacaaaacctattgcatacagttgtgagaattaagtgaattagtatgtaaatgtatagaaagatgtttggaacttgaataagtgttcaattatgtgttttaatttattattgatctaggttggaagataaagaggtatgaatggtatatattttttctctgtaagataattaaagtgtgtaagaaaaaaatcatgtttttttcctctcaaaaaaaccctacttttttcctatttaaccaattgttgtggagaaaactcttataaggacatgaaagactctaggtaatgaagtggctgttgatgtgcagtttgctggaaatttttattgtgccttgtgttgttacattgtacatgcctgttagaaatgtgattggaaatgctttgtacatttaaatctgaaggcttggagtaagaaggtaacttttccttttgtggcactcctggggttgttaaggctgatttaagctgctgatgacttgattatggtgattgctcttctagttgggcatactgtttactttcttttaaaatgtttttaagttgggcttgaactgaactccttttgtaaatagaaggctctgagctcagagatggtttgcagtaataataatggtcacaaatctttttttgtttgttttttgaggctggtctcactcttgcttaggctggaatatatggtgcgatcatggcccactgcagccctgggctcaggtgctcctcctcagcctcctcagtaactgggactgcaggcatgcaccatcatgcctggctaatttttgtatttt

SEQ ID NO: 25669 - DNA, 1044 bp, Homo sapiens
atcaagattcatccatgtggtattttattccttttatgattggataataatctattgtatggttatgcaacatgttgtttacccattcatcagttgaacatttgtattgtttttactttttgattattatgactgctataaacatttgtgtccaaatttttgtgtgaatatatatatatatatacacacacacacacacacacacacacacacttttttgagacagtctcactctgttgcccaggctggagttcagtggcacgatcatagctcactgcagccttgaagccctaggctcaagtgatcctctaccctcagctttccaagtagctggtgctacaggcatttaccaccacgcctggctaatttaaacattttttgtagagttaggatctcactgtgttgcccaggctggtctcgatcctcaagtgatccttccacttttgcctcccaaagtgctgggattacaggtgtgagagccacgccacctggccccccacttctttttttttgagacaaggtcttgctctgttgtccaggctggagtgcagtgatgtgaccatggctcactgcagcctcagcctcccatgtcagcctcctgagtacctgggactacagacatatgccaccacgtctggctaatttttgtacttttttgtagagacaggttcccactgtgttgcccaggccagtttcaaactcctgggctcaagctatctgcctgcctcagcctcccaaagtgctgggattacagttgtgagccaccgtgcttgatcctgacttttctttttctaaatggttgattatacatcctaggtactgattgtgtattgcaaatatcttgtcttatttatttattttaaaatatttgtagaaacagggtcttactatgttgcacaggctggtcttgaactcctgcattcctcctgtacggacctcgaagtgtctggagtacaggcgtgagctacaatgcctgactgcaaatatctttctgactgtggctggtatttttactttgtttatggtgttttggggcttatagaa

SEQ ID NO: 25670 - DNA, 1016 bp, Homo sapiens
ttaagtgctgggattacaggctgagccactgtgcttggcccgattttattaattttatactgaattttgtaatattcatgttttgatcaattgcatcctattaatacttggagtggtaacttgatgaaaaaatttgacacaatttacagtcacaggaatttttttttttttttttttaaagagacagagtctcagaccgggcgcagcagctcatgcctgtaatcacagaactttgggaggctgaggtgggcagatcagttgaggccaggagttcgagaccagcttggccaacatggcgaaatcccgtgtctacaaaaaaataaaagaattagccaggtgtaatgatgtgcacctcttatcccagctatccgggaggctgaggcacgagaatcacttgaacctgggagaaagaggttgcagtgagccaagatcgcaccactgtactcctccagcctgggcgacagagcgagactctatctcaaaaaaaaaaaaaaaaaaaagagacagaggcttgttctgtcactcaggctggagtacagtggtgtgatcataactcactgaagcaccaaattcctggctcaggctatcctcctgcctcagcctctcaagtagctgggactacactgcacccagtagcacaggaaattttaaacagttaaattgtaagcctattttttgttgttgcagagaaaggtaatgggtgtttacaaaatttcaagtatcaaaatatattacagtaggtccttttaaacctttgttatagaagtttgttcagcaaatatactgaacacctgtgtactgtgtgctaaggacacaatgatgagaagacaggaaataaggtagcttccttgcccttgtgtagcctggtctaattatgattagtttgcagaagtcgtgtacattgggtcagctgccactggagtaaggcaggctggctcctcccaaacctattgctttcaaaggattcatcagaacaaaagaattcccctttatgtgttctctttaatttgtccata

SEQ ID NO: 25671 - DNA, 1044 bp, Homo sapiens
caaaactaagcctttctccattcttccagccattcagttcttttccctagatgtaaccaaagttactagtttttggtttgtcatttcagagacattttatatatttgtaagtacattatatatatttacaaaagccagaaatacagtgtaatacacagtcctgaaacttgctttttaactaacagtgtgtcatgtagatcattccatgtgagtccaagagctccctgattctgcagcttcgtagtattctactgtagagatggcccatagtcactatacatttatgtcgtttcttgtctgtagtaaacgctgcagtgattatcctgttcatatatattttacttcttttatgcaggtatatccataggatacattcctgagagttaaatcattgggtcaaaggagatatgcacttgtaattttcacagataattccaaactactctccaaaaagattgtactgtatcaatttatgcttccaccagcaatataggagagagcgtgtttctgcatactctgcaaagtatttgatctttactatgctgaaaagtgaaaaatggtatccagtagttttgttttattttgagcaagattttgcatctttacatatattgaggagtcattcatcttgcttttaaaaatgagatatttatacctttttctggttttgtcaatgactttcttagtttgaagattaaaaataatattaaggttgcagtgagctgagctcacgccactgcattccagcctgagtgacagagcaagactccatctcaaaaaaaaaaaaaaagaaagaaaaaaaaaagaaattagctctttttatgatattagttgcaaatactttgttttctaatttaggaccccattaaaagacaactacaattgcctaaaacatagtagctgcactttcactatctatttgttgagcaaaaatgcataatgattaaaaaaaattgtgaattcttttttttttttttttttgagacagagtcttgctctgtcacccaggctggagtgcagtggcacgatctcagctcactgcaa

SEQ ID NO: 25672 - DNA, 1062 bp, Homo sapiens
tctctcactgcctctctctctctctctttcacacacacactcacacacacacacacacacacacacacacacacacatttcagaggttgtagacatgagcataggcctttgtgctccctccctgacgcagaaggcgatggctctgctccgagtgaagtctgtggaggctacatggtcccaagcaattttatgatctgaattcactttcagagttggaggttcccccactcactggcagcttcctgagggtctgcagttttcccctcgctaggaattcctgaaccttcagccagtcacacccttggaagccaaaagggagagagttgtttgggagtgagggttgggtggagagagggattcaaacaaggctgactttctttcattccacatttattaaatgcctgttatgtttcaggctttagtgggagagtaggatagagttgctaccttaaagaatgtatagtttgttaaagagatggacaagttaatcaacaattgccacaatcatgtgataaagtatcagatagaaaagctataggaagctatagaaggataaaggaggaacccactctgaaagggaagtcaaggaaggcttcctggaggaggtgacatgcacattgcattttaaagctagtgtaggagtttgtaaaagaaagaaagggaggtggagagagcattctaggtgagggagaagcatgagcatgagctgtttcaggcttgaaacagcctggcactgggagcagccgaagttggccagaggcggggcttgggggtgggggtacaagtgtgactggtggactgtggagcagcaggcagggcccaggtcctggtaggtctgctgggctaggcaaggtgggaggacttgtcctaaagacaacagccctccaccaaagtattgaagcaggggagtgacaggccagagtggtgtttctgtaccacgtgtgggaacaaggctgggagggcaagagtggtgcagggagacctgtgttcacttgtgctttacggcttgccactggcacatcccatgggctttgaatgagtcaatctgtgcagggatgctca

SEQ ID NO: 25673 - DNA, 1059 bp, Homo sapiens
gcttattccaccagttctactgtgacatactcgagtataaagacatgtagcaataacggggagtggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaaaaaaggtattaacatgtaagagctttctttttaaacaggaatgtcttagctttctagcttcccagctaaccatgtctgccattccccaggtcttggcatggtgggggaggacttggagagctggcagagccagagttcagaagagcctgcgtcctctcagcccgtatatattttataagcaagttcttctaatgaaagaaagtaattatttggactgtcaagggcattagttagctagttgttccctttggtaataagatgcatcccagagttagctggctgggagcagagcctggccgggaggcctgaaggggtgtggcctgcctgtgagtcactgagtggatcatgtggctgcggtagcagctgagggtccgattttttgctgggaaacacaactgcttgggtggggaaggggaggaggatctttctgcagccggtggcctgccaggcctgagtgctgagctggaggtggagagtgaggc

SEQ ID NO: 25674 - DNA, 1041 bp, Homo sapiens
tgaaatagttttcaaggttggcacctggaagacatccactttgacatctttctttcattcagtagttgaaagcaacctcaaagtctgtgacttacctgtctacctgcctagaaattaataatcacttcccctagtggggggaatcagaggctgagatttgtagtggaggcaacacactgtgtgaggcctgggtcttcacctccagccctgttggggggcgggggatgggggtggaggcgctcatcgtggaggcagagaagaagcaccagggagtatcagcacataacagggtttctgatagctaggcatctgccttggatggggagccctgatgtggctggggcagtagcaagatgaaggctatactgcagcagccctgaaggctctggtttgcttccctcctctgcagtcccagtgagttatcccttcacaaggatggaaggcaccagattaaccaattctaaatgctgatccatcacatttccaacatgattccaaatgaccacatgttaatcccacttgtgtaggcctaccacagacatgaatgtgtaccagctaaccccacccatttgaagcactccaggaagattctagggcatatttcttcttgccctagcagtgtagccggtgggaggaagagcctcggagatcatttattccccacattgacgtcttcctcccaccaacccccagctcccacagctcttggcatgtgaaccactccactgagcacctgatgtccctgctgttgcctgggtgtttgtcttaccttcccacctagacctcctgcttcttcattcccttttgtggctgattactattccattgtatgaatttataacagcattttatttatccatttattagctgatggacatttgggttatttccacatcttggctcttatgaacaaggctgctatgaacatttatgtacaagtttttgtgtggatgtgtcttttttctctctcttagatacactcctaggagtgcagtttttgggtcataggtttaatcttttgaggagaactgcaagactgtt

SEQ ID NO: 25675 - DNA, 1024 bp, Homo sapiens
aaaagcttttgatgataggagtattgatggcagagattaaccaaagacagagcaaaccactttgggatgtttaggaaacagatcattaaaaattcactgtagagtgtgtcagaggtagtctttgctgacatggctatttcagggcagttggccacctgggaagcataatcaaaaggaaagggcactggcctaaaatcagggcatctggctcccatcccaagtcactagaggccctctggttagtcattgcatcactctgcctcagtctcccaaaggtattatgggggaaataagaagtcagtgggagccttttgaaaggtagacctcttgttgatacaattgattatcatgtaacatctagagacatctccctgagtatttatttctcttttttgtgtgcggatttggcttacacagatactgaaaattctccactgcatggaccctggtgagtggcttccccagacggagcactgtgtccatctgaccccaaaggagttcttgatctggacgatggatattgcttccaatgaaaggtttgcccccaaaacctcctgtgcaaccttggtaagatgtatggtcccatcagtcattatgtaatgaacttgcacacaatcctgccctcaggtctcaggtcctgtatttcattctaaacctcagcctaagagttctaaactcaagcaatagaatgatgtcagtgatttgcattaataaccaaaaggtaattgcttccggaggcatttttgtaaccaggaggtagagattttcagtattcacctctgcatggattacagactatctgcaaaaaccggtgtatgaaatatgtctgattgtaattttgtgttgtttttttgtttgtttatttttctagatctgaaattcagagtgtagctctgagacttgcttccaaagtcatttcccaccacatgcagacatgtgtggaggtaaggctggttctgatcttgttccgggacctaggattttttgttctcatttactcagaagatgtcagtaaaagtgaaca

SEQ ID NO: 25676 - DNA, 1031 bp, Homo sapiens
attgctactgtatagagctacaattgatatttgtatattgatcttttatcctgcaacattactgaacaaacttattagctctaataggttctattgtggactccttttttcttgactaattgctctggctagaacctccaatacagtgttgaatagaagtggcaagagcagacatcttgtctcattcctgatcctaggggatcttaaagcattcactcttttaccattaagtatgatgttagctgtgggttttttatagatgccttttgtcaggttggagaagtttttttccatttctagtttgttgagtgcttttaccacaaaagaatgttgaattttggcaaatgaccttgctgtgcctgttgagatgatattgtaattttatccttcattctgtcaatatggtgtgagttgtgacattttattgctgagtagtattccattgtgtgtatggcttgtttatactaatttactagttgatggtcattagggtcgtttccactttttggagatcgtgaataatgctgctctgaacattcacatagaagtgttcggtcatatgttttcatttctcttgggtaaaaacctaggaaaggggttactggatcatatgataaggattgtttaatgttacaagaaactaccaaaatgtttaccactttgcattcccaccttgcattcatgagaagcatggctgataatgttgagcatcttttcatgtgtcatgtttgactatgtatgtcttttttggtaaagtgcctattcacatcttttatacattgctttttaaattcgagttgtttgtcttactgggttgtaagagttttttctaaatacaagccctttatacaggtaaatgttttgcacagtttttacctggctgtggcttgccttttcattttcttaacattgtcttttgaagagcagacatttttaattttgataaggtcaaatttatccatttttttgtgtgttttagactttttatgccctagtgaagaaatccttgcctattccaaggtcacaaagat

SEQ ID NO: 25677 - DNA, 1024 bp, Homo sapiens
ccatgctcttccactttcccatgaggctggattcttagcactaatctagccttcctgcctccaccatcagatgaggcatccactgggatgaggagtacggcgtgattcagctctccgttccactccagacacagaagtcggcactacgatagctcacaaaacccaagggaatgtgtcctaaaggagtgaatataggaagaagcaccaaacaccaacatcgtttttatttggcaaatgcttgttgaattcctacagtgcatcagacttgttggagggggaggtcaagcatacaaacaaaagtgatgacgatgctgccatgcaggttgtaaatcatgaccaggcagagtcaggaaagctattgatttttcatgtctccatgactagaatgtaagctacaggaaagcaaggaactatctggtctctgctgcagccccttggacagtgcctggtaataagagttgtttaataaatatttgttgacaatgtttgccaatttaggacacataaaatgacactgaacttctgagttctcatgtgtgttggcagttaatcatcctccttggttctggcagctttggtttctctgtgcttggttcagtacaggcctgggtctgactgctttcttagcctcagaattctttgggaccagaactttaggaaagtgaggaagaaagagttgccttgctacttgccatcctttaagagctggtggacaaattgcccttcttgggagctgccggagctcctgagtctgaccttgatcaaatcttagtttcaaagggcctggccttatacctggacctcatgccaaaggatggtctcatttttcttgaacccaacacactaaatgtctatgaggttagttgtgtattcaaatatttttattttcttaaagaaaaatatctcaaaaacactaacctgtttcatacaattgcttataaaactttctttcctttctctttcccctgtcttctcttctccctctccttccctgccccatttttttccatgacttctctgaccc

SEQ ID NO: 25678 - DNA, 1032 bp, Homo sapiens
ctcagagtatcagtcaggggcaagtgaaacttagagatttgccatttgatgtgtcctcaggtgtttgtaactgttcaggatcagagtaggggaattaatagcaaaaagaggaaaaatatatatttttttcagtgagagatagagtgtgtgtgtatgtgatgtatgtgtgtgagtgtgatgtaccagtcactgagttcctacagagcctcttctggaggataggtgttattcccatcctactggtgagaaaactgaaaacaagaggggttgtgcgatttcactaaagttatgcaagattaaatggtaaaaagcaaaactgagattcaagcccaggatcgtttgaagcttttgagcttgtgcagttagccactgtagtatactgcttctctggatgaggaaaaggaatattgtcaggggagaaggattctatctggggccttcgggttgtgggtaaaatgggatttgatgtcatctatttattcattcgacaactgctaattgaacaccagctacgtgccaggcactgttctgggtgcttggactatatcagagaacagaagagacacatccttgccctccaagattactgctctcagtgtacttatattccagcagcagggagacagtaagaaatgttcaagaaataaacattcaataaaacatatcagaacttattatagtaaatataataggtaaattagatagtttgttagaaggtaatcgttgctgcggacaaaggaacaagtagagtaggctaaggggaatcaggaatagataggagaggagggcagttggcatgtcagaatagtcgtcattggaaacgtttgagcaaaattctatcacaagacatgggaaaactttcttattttttgaataaaggtaaagggtagacatattttcttctgaaactgtgctggctgcagacatttgtaagcaggtataccaactgcatgtttgagactatctttacccataggaaagtgccaacagagtgggcagtagtggataaacaaggccaggaaggatgccatt

SEQ ID NO: 25679 - DNA, 1043 bp, Homo sapiens
aatattaggaatataggaaaaggctgtgttgtgtgcatgtgattgggttgtagagctcaattgaagtcattgaatcgatgactgtcaagttttttttttaaattattttatgaacacaaatctgtctttttagcctcacactagccagttaggtaatgattttgaattatctagtttgaacattgtaaacgttggtttcatgccaagaatatttaagccttattgtgttttcgtttgtacattaggtgcgaaattcatccacacttctctttagtgccttgatcacaagaatttttggagttaaaagggcaaaggatgaacattccaaaacaaataggtaagctccatttaaggctaactttactttttttaaaaaatacaatattgtcctggccaaaaacaaattttgaaattgtgcctactgttatagattcatctagagcataaaactataaaaatactgtaatgaattaacctatgctgccaagttataaacccttgggcaaaaatatcaactgtttaataagtggacctttcaaagcaacaaaaatttagcaaggtagcaaggggtgaaatgtagagcttgtttctccatgcaaaagctagtgttttttttgtttttttttttttaattgcatcttctttaagtagtcctgaaatgtcttaactttacttgtatatattatcctagcttgtataatatctttaattttataggtggaagtttaaatgtttatgatcctctcattagaacatctctcacattacctttgcattaaactcttgtactaagaggagcacctatatgtgttaaccacaagaaataaacagtgctttttacttttggtctttagttttatgtttaacctctaatttgtttttgtctttaaaaaacagcttttttgttatgcctgaaaagaaacctgtggaaccattttgattttgggtagtttttagataaaaatgcacaagatctgtttgtttttaaagaagaaaagctttgaatagttgttttttagcacttaagaggatttaatggtaat

SEQ ID NO: 25680 - DNA, 1050 bp, Homo sapiens
taaaggaagatgcaaaactatctctattttctgatgacatgatcttaaatatagaaaaatcctaaggaatccacacacatgcaaattaaagcttgtctattagcaaggtttcaggacaaaaggtcatcatacagaaattgtacactagcagtgaaaaatctaaatgaaattaagaaaacagtttcatttatgatagcatcaaaaagaataaaatacttaggaataaatttagcaaaggaactgcaagagttgttcactgaaaattatcaaacattttttgaagaaattataggcctaaataaatggaaagatctcctgtgttcatcactggaagacttaactattgttaagatgacgtattccccaaattaattaatctatagattcagcacaacctctgttaaatcccttctagcttttttttttttttttttttgcagatcttaaaatacatatggaaatgtgagggacccataatagccaaaacaatcttgaaaaagaacaaagttggaggccccacaggtcccaatttcaaaacttaatgcaaagcaacagtaaattagagcttgtggcattgacataaggttaggcacataaatcagcagattaggattgattgtacagaaataaacccccacatttaataaaggtgccaagacaattcagtagagaaagaatagccttcaacaaatggtacggggacaactggatatccacatgcaaaagaatgaatgtgatccccatctcataccatattcagatgactcaaaatgtcttaaaaacctaaatgtaaaagctaaaactataaaacttgtagaagaggacctgggtaaatttttgtaccttggattagataacatttagttagatatgacacctaaggtacaagcaatacaaaaattgataaattagactgggaatgaaaaaaactgataaattagactcgatcaaaattaaaaatgtctggctgggcatagtgacatgcacctgtagtcccagctactcggaaggctgcagctggaggattgtttgagcccaggaattcaaggc

SEQ ID NO: 25681 - DNA, 1035 bp, Homo sapiens
cgactagattttcagctttaaccattttaggttcaatagctgaagtttttcatgtcccagaaggtaagtgtttaataatgttaggggaagtaatttttgttttctttcaaaacatacttattctacattttgctttatttgaagtttcagttttgttgcctttctttgaggtttcattcttaccttataattcttgcttgtacataatgaaatttgctagtaaaggacagaagaggaagaaactatctcccttttcattgatcattatttgccaaccccaaagtataattttcatggattatgcttattatggaaagagttccagctattacctcactaatttgtttgttgctgttttaagatagtatccaatctgttctttaagttttaaaatttgaaataataatagcttctattatatttaatatttctcagtgagtctctgtggttaaaatgtggtttcctttacatgccgtctgtttcatgtgcctcagtctggtttcggaaagacaatatgaggatgtaatttccaagtattctgatttaataataccctttgtttttccttctgtgtggttctcaagagggtcaaatttcagttccctctttgaatcttttttttttgtttcattttttcctttttgacaagaaatgattcctttttttttattttgagacagagtctagctctgttgcccaggctggagtgtggtggcgtgatctcggctcactgcaacctccgcctgctgggttcaagcgattctcctgcctcagcctcccgagtagctgggacttcaggcgcatgccgctacacctggctaattttttgtatttttagtagagatggggtttcaccatgttaagtcaggatggtctcgatctcctgacctcgtgatctgcccgcctcggcctcccaaagtggtgagattacaggcgtgagccaccgtgtcctgctgaaatgattcttttttccctgtatatgtgtgtatatgtgttagaatgtgggatttcttgcttgtgctgtcttcgttgact

SEQ ID NO: 25682 - DNA, 1057 bp, Homo sapiens
tgggacccctagcatataatattcaaattctttatatttttccttatgttttggatgtaaaacaattttcttaaaattctgtcttcagactatgttccacctattgctatggtttataattaaaaaattttgtagaatgcacaacaaaggcaaagttaactcactgttaaatcattgaaaatttttttttgtatatgttatatagcttttgctgatgtggaagggaaaaatctagcttctttgctgttacattgtgtgcaactcacggatggagtgtcacaaatccattatattaaacaggtaagtctgaattgatattcatggatgcatctttaagagtatcatgctattaaggatttaaaaaaaatcactgacagtttttggtccctaattattgcatatcagtttatcattagcaaataagtatttttttttttctgtttattgtataatatccttgtattcaaagcagcaatagaagccatattcagacttctatcataattgaactgtaaacagataaggtagaagataatgtgcatacctcttttgtggagataaattttaaaatatatgaatcttcaaaactttttagcagacacatttaaaagttaatttaaaatataaagattatacttattagtatttcagtattaggatttaccatttgagcacacatagtttttttttttggaaagcaagtaaatgtattactggttttttaatagtgctacagctgttctttactgtaagccattaacaggtctgtgattctctgtggaggtgggtctggagggtaaagagggaggtggggacatgagtttaaaaagttaataaatagtgaaataggtgtttaaatcagtatccttgacagtggagtatggaaaacatttcacgtaattgacactttgttttatttatttttttgagatagggtctcactctcttacccaggctggagtgcactggtgtgatcttggctcaaccacagcctcaacctcctgggctcaagcaatcctcctgcctcagccccctgagtagctgggactacaggcat

SEQ ID NO: 25683 - DNA, 1016 bp, Homo sapiens
agcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattgaatctcatgcctgttaatatctacactgtaagtagtgacttcaaaaaaattctaagataggtagtcaggagagtttgccattataaaaggtgtcttaataatatggaatattgacctaactggagatgaggtaattaattaccgaaatgttgaaaatgttttgagaactctccccattttggggtattccttgttcatttgaatttggtgactccctactgttccagtttcagtgccaacttgggtcacactgttcacatcaggggagaccttgccttggggacgtaggcgggcctcttgcaacttgtgctgttgaccttctgtcttgtggaactctctctcctgcatctgctacctgcccgcagatggtgtgagggagggttgatggcgggaagccaggaagtagatgtcatcatggtattggccaggcttttacttcaactctttttgtggcgttagatttaaggaagcagggggcatggccaacgttgagtcttggcccagtggacatagtgcggctttcccttgagcactgcccagatgcaggacctgcacatgttacaggtttgccaaaagcatctttttttttttttttttttttgagatagtcttgctctgttgcttaagccagagtgcagtggcgcaatctcagctcactgcaacctccgcctcctgggttcaagtgattcttgtgcctcagcctcccacgtagctgagattacaggcttgcaccaccatgttcagctaatttttgtatggtaaagacggagtttcaccatgttggccaggttggtctcgaactcctggccccaagtgatcctccccctgcgctcgcttcagcctcccaaagt

SEQ ID NO: 25684 - DNA, 1061 bp, Homo sapiens
ggctttcaaattgatatggagccacaaattaattctaatttgtgcagttactttatttacactgtaaaaggggtgggtgggtatgtaatagaaccaagtccttttgaaaaaattttttaaaaaaaaatttctgtgggtacatagtaggtatatcacattctactttgatgtttaactgtaagtataaaattaaatttctcttagatcggattttacctcttgtatacgagaaactacattcttagtttatttgggttctttatgaagtttcaaaccacatgccaactgtgatgcttgttttatttgaaacatttaggctgtgtccagtttgggaggtctacgttttcctgaatttctacacccttcccctagatatacctacacttttaaaaaatttgcttcattgcatctgtgactcatgtatttatttactaccaacaacttttagaaaatatttaattgccccttctttcctttcagagaggctgtgtttttatacgtgtgattaaaaagtataaggaatctgaaaagcacttgtcagtccacctgtgggactgtgccaagtccctgttgccttgtccaggagatgggacgggaaatgcacggcaatatgtctgcttagaacatcccacccaggacagtttaaaatagaagaagccctgggaggatgcaggtccaggtgtggattgactgaataaacatgctatagaaaggagttaggatttttaagatgcctgttaacagtgttccattgcttgacagtagaatagttaagccagattttgctcctcttggtgagatgggaagagggcatagatgtttatatatccatcatgggtttatccagtaacgttggagtagggcgggaaatactcagcagatattcattacggcatagcagttctgtattcactcgctacaggaaataaagccatagccgagtctgcatattcctggaagaaataagtaaaaatttcagtgagattctggaaatgctcttttttgtatgtcaagtgtgtaacacttcagaatgttttaactgaattctttacaatttcatc

SEQ ID NO: 25685 - DNA, 1070 bp, Homo sapiens
acagtattcatttttagttagagaattatgtttaatataataatttcaacacaatattgactgattggatttagtatgccatatggtaacagtaaagtatccattatagattaccttaaccaaaaagatagtcatagagataatttttaccataacttgctaaataagaccatgtaactgatttttttcaatgtaaagtgtgaagatactttttcctgagatttttagtataaactgagtattttccaaatgtataatacctgacaaaaagaaattgaggcgaccataagttagagacatgcatatatgccttttgaaacatcatcagtatctttaagaatcctgagatgttaaatactatttttatgcagtagtgacaagttgtggatcataaagccaaaattgtagcatttatacaagttttcattttatatccaaagagtggcaaaaattaagttaaatatttaagatacagaattttaaaagttatcttcattaattctcctgtatatagttgtttgatcttgtctgtagagcattgttaaaacaagcaactatttgaactgctgtgaagcaaaataaacaaccactgcagcacgaaccagctagtgaatgtttttgctacttaaatgtgattcagggtttcagttgcctagtgtttatttggttaagtgtaaatgtatttcatttttttcctaaagtattagcatgagtggatataaaagtaagttcttagactaaactgcctgtaatattaacataaaagcaaatttttaagtaatttattttgcttttaacagtaataacatagatgccgcaatagaaaacattgaaaatatgcttacttcagagaataaagtcattgaaccccaatacttcggcttggcatacttattcagaaaagtaatagaggagcagttggaaccagcagttgaaaagagtaagttagttgtttgtgctaaagaacacacaagcacattttctctctagtgagactagaccaaatttctttggtaggtgagttataccactgttctaatgaaagatttttcttacctgtcatttttcca

SEQ ID NO: 25686 - DNA, 1025 bp, Homo sapiens
gctgtggcaggaggattgcttgagtccaggagttcaagaccagcctgggcagtgtagcgagaccttgtctctacaaaaaatttttaaatagccaggcatggtaatgtgcacctgtagttctagctactcaggaggcagaggtgggagaattgcttaagcccaggaggttgaggctgccatgagccatgatggtgccactgcactcagcctgggcaagaacaaaacccttctcccggcccccccaaaaaagactttatgtcctattagtattttatgtaataaaatgataaacaattttaaaacaatgaaaagttaaacttgctcgccatataaataagctcattgtcataaatagcttttgtttctgtagacatggagataagaacaaaacacttttctaatttcagggggttcatttttcagctgaacctgacccagatttcttcagctggattggtaccctttatttttatgttaggtgccctgtgtaagctacaggaaaggacatggtataatttctcatctactcttctgagctgttcagctcaattggaggttgcctgagagcaggagcctcgagcgcactgttcctgcactacctcccccacccccaccccacccccctccctgagcacatcaccacaaacctgttgttagagtaaaatgatcatcagtgaggacaggagtagtgtttgcactattcccatcttcttattttgctccatggctgatgagagctcttgatttttaaaaattcccttccgttgttctgcctttcttttaggtttccttttctcaaccccatctaaagcagaaagaaaaaataaagccgattaaattttactgttggtgaatattaatagctgatacgtggcacttgtacagtgtaattagtatcactagtgagtaattgagtaaatgttggaattaggtgacagtgggaaaggacctggggggagggatgtggatgggtaacatttttggtgtccctgaagtcattaactgtacagaaggcaagccttata

SEQ ID NO: 25687 - DNA, 1050 bp, Homo sapiens
ttttttttgtctgttttctctcataggggcatatgatattttcctgaatgcaaaagagcaaaacattgtgtttaatgctgaaacctacagcaatctcattaaattactgatgtcagaagattattttacacaagcaatggaagtgaaagcattgtaagtgttagtccatttattaaacctcttgtttaaaaaagaatattggctgccattagccaataattataatagtaatgtgctgtgtagtaaaattgcttgattggcctcagctacccataaaaatcatatgaaatggttaactaactttatcaggttttttcaccttcaaaaaaaaacacctttactggccatatacagtgcagtacattttgcttactaagttatattccatcacaattcatttaagatatccatgcacagaaaagtaattttattatattctgttccttgttcaacatctaaatccatgtaccttttgtggtgggagcagcctgagaaaacaaagacaccatggactttgaacttagaccaagatttgaatcttacttaaaagttctgtgaccttgggaaaattacctgctatctctgatccttagttcttcttccgtatgatgagtgtatgataatattacttaatattaaagatttcttctatgtgttgaagaaggtagagtgaagtagagaaaacataggtactgaacacatcttatttgtgtttccccctcctttcgtgttgtttttggattaaaaaaaagaaatctgactgggcgcggtggctcatgcccgtaatcccacaagtttgggaggctgaggtgggtggatcacctgaggtcaggagttcaagaccagcctggccaacatggtgaaaccctgtctctactaaaaatacaaacattagctgggcgtggtggcatgtgcctgtaatcccagctactcaaaaggctgaggcaggagtatcacttgaacccaggaggtggaggttgcgttgagctgagattgcgcaactgcactccagcctgggtgacaaagcgagaccctgtctcaaaaaaaaaa

SEQ ID NO: 25688 - DNA, 1106 bp, Homo sapiens
atataaaactgctttcattttctatggactcaatataacatgatctgttacaaaattttgtcctaattcaaacttcatttctatccttcccaatatattgtgacctttcattgtgacagtgttgcaaaattagcttctagaacctataacaaacattaattacatgaatgaaatgacttcctcacttgcttaaggaattttctattatttctatatgacaaacattttcttatgttctgaacacttctttacagatagaaagtagaaattagtttctttgtatagtagtctatccaagagtcaaactgccttacatttgtaattttgcaatacaattctttgaatctatttaaaaagtatgtataacctcagcatttattccgtctcagtaatgattcatatattatttcttcaagtatgtatagccatttacatttcttttcatattgtatggctttttcctcctccattattacacaagtgaaatggacatattctgattactaaagattcaaacaatgtaatactatactagctaactatgaaaatgtcattgtgtccaccaccaccccctaaccgcttatctcagacgtaactttgtgaattggccatcctttccatgtcttctctgtacattgccctctctctacctttatatccatgtattttttatgtatgtacctattattttgattcttttatatcctgttttgattgttttatactttacttgtttcacattctacatttctacattgtggcttctttttgttttacttaacaatatgaaataaattcacaagaaaaatacttgctttttctcccttttaatacgaatcttaactgctggtatccttaaaacctctgaagttgatgaatgacttttttaaaaaatgaatttatgggttcttaacatgtatttgtgttttattttagtccttatttgttttagtgttcacatctcgcccaggctggagtgcagtggcccgatctcagctcactgtaacctccacctcccaagttcaagcgattctcctgcctcagccaccccagtagttgggattataggcatgcaccaccacacctggctaatttttgtattttta

SEQ ID NO: 25689 - DNA, 2044 bp, Homo sapiens
atagaaatgtgtacaagacatttatttattcttattacgtgtgatttggacaggaaaggggtaaggccttgggcaggaccacttctgtcacagagtggtggaaaaaaaatagattgaagtaagattcagtactgaaaagctgtcactcggtctgaaaataattaatattcctttcactcaccagttagatatgtgctcccaaaccacataatctctatgcctcagtgatcattgttgccatttcagagcctctcatcagggtgacatctcacaccaaaatgatttcttataaattaatcttgataacatgacagtctcggtaattttagtggaatgctttctcttgtttttttccacagaagctgttggctattttctttataacttgattgacagcatgagtgactcagaggtacaggccaaggaggagcatttgagacaatacttccatcagctggagaagatggtaccatttcgttttttgctatataatgcctgtcctgcctgacatgtatctattagatttgaaattgctgcttttaagtacaaccagaccacttctcaatgacatgcaagagttggagacttaaattatgtctgagataatttctgttagacaaatttcagtttggttgtctaaaactcaggttttttcccccctcccttcccttctcacagaatgtaaaaattcctgaaaatatctacagaggcattcgtaatctcctggaaagctaccatgttcctgaattgattaaggtgtgtgtgaaatagcaatcaactggataaaatgcttaacttacatataacagcatgttaaaattttatttaaatatgatgcttttggtcagaaaaaaaatttgtttcaatgacagccattaaaacgaagcttttcattgattgttcataaatactatttatatattcataaatatatttataacgttaattacattgattaataaagtatgaagagaatgtctaaaattttggaaagatgaaaagtagtaatatgaggtgagacttacaaatttgcttttgatgtttgctgatgtatttttacgtgtgttttctaattctgggctaatttaaatttcaattttaggatgctcacttgttggttgagagtaagaatttagactttcaaaaagtaagtaggattttgactagattctacatgctataatacccatatttaatgagtattctggattgtgtacttataaaaccagtgattcctcacatttttatcatcttgtatacctctaagaagttggtaaaacctgttccccacctcagaaaaatcaacatatctaagaaatttgcatataatctcagaaggtttgtaaatccctggagtccatccatggattccccaattaatatccctgatagcatttatgacatttaggaaggtagaaaggaaagtcagtttaaagggaagagtgacaaaaggcatactatatttcctttttcaggaaatttttcttttcttttttcttttctgtagactgtgcaacttacatcatctgaattggagtccacacttgaaacactaaaagctgaaaatcaacctataagagatgtcctaaagcaactcatattagtgctttgttcagaagaggtaacatttgttttaatatttaaatattattaaggcaaaaaattcttggtaacaataagaaaaaccaaatataatatttatgatttttacaattgatcgttatatgtcaggcttgtaaagaatgcaattaaatgaaaggttaactaatttcagctacaccttgaatggcatgttttctggttgctgtagtttgtttacgataatctgcaaagtgaatgatagtaacagctgtgataggtttatcatacatgccaaatgtcctttcaagccatggctccggtctcttatatctagattgtcaagcaactgatacacgcagtagtcatttgcaagtcaaatattactaggttgttaatgcagggattgaaattccattttcctgctggaaaaaagctctttctgagataaagggtcccttgcctt

SEQ ID NO: 25690 - DNA, 1026 bp, Homo sapiens
taggctccttgttcaaggaatatagcagctgatctaaaacaattctccttatgtgtgtgggttaatttgttatttttggggagatgaacacttaaaatgggccatgacttttcccatgggatttttctttaatgaaaccaggtaccttaaccttcacttaaactgtatttattgtcttcagaatttgcttctactatgaattcctctctaatcccatcctttttgtattattcagtagccacattacatttatagtgaaaagattaactctattacttataacatggtcccattttagtacaattacagggaaaaacaaattcagggaatgcctactgtgatctcatcccttgctagtttggcaagggttatgtgaagagtcagtgtaaggtgtgattcttacacaatggcaaatcaggcttataatgtcagcattgaaacatacaaggttgtagactgttaaatgtcaaaatgagtagtagagcaaacaaatactcagaaaagtgaaagatcaatataagtcaattacataacggacgtatgacctattttattattactttaggtggttactcttgtgtgagtgcaggtcattgatcatagtggaaaatgaaatgagaaagtatgaatggttcaacagaacccaacacctctccgagaaaagaatttttcctctcatgtgctgtctttaaagaacaaaagtcttgtagggtattacagtctctctcttcatggtgccaccatgtccaacaacatacagcctcagtgtgtgtaccaggctgactctgattctgctggtatgttagtaattgccatttataggaaaggatatttataaattaattagttgtatatattcatgaaaattaaaaatacgttaaaagggtagcttatattgcagatatatattactgcattgtctaattttgtatgaaaacatttttattttttaaatacaatttccaaaatgaaaactaaaaggtattggtataaatatgttttcaatttgataatacagggttttta

SEQ ID NO: 25691 - DNA, 1023 bp, Homo sapiens
aagtggggagctttattatcatcattcctatattggcaacaaggagccactgaaaatcatcctttttggtggcagaacaaggacttaatcccagttctttctgattgcaggaaaaacatgtaggctttagcattttttgtagtgtaacaagcacctgccaggaattaagagacttggtttctttttttttttttttgagatggagtctcgctctgtcgcccaggctggagtgcagtggtgatgtcggctcactgcaagctctgcctcctgggttcacgccattctcctgcctcagcctcccaagtagctgggactacaggcgcccgccaccacgcccggctaatcttttgtatttttagtagagacggggtttcaccgtgttagccagaatggtctcgatctcctgaccttgtgatccacccgcctcggcctcccaaagtgctgggattacaggcgtgagcctctgcgcccggactgagacttggtttcttactcaagttatgcttgtgatcttggagaaattactttatacttttgttagaagattcattgactttctttaccccacttttaaaaattgacacaaactatatatattcaaggtgtacaatataatgattttatatacaggtacattgtgtcctgattaccatagtcaagttaattaacaaccataaaccttcaacacccatagttaaccatttgtgtgtatgcctgtgtgcatgagtgtggtgaggacacttagaatctgttcttttaccaatttcaagtcaacaatacagtattactaatagtagccaccatgctgtacattagaaccctagaacttactcatcttattaacagaaagttcgtgccctttgaccaatatctccctcaccctagtccctggcaactgctgtcctactttctgcttctgtgagttttcgactgttttttattctaatgtaagtgagacagtattgtctttctgtgtctagcttatttcacttgattagttgacttctaaaggcatttcagctt

SEQ ID NO: 25692 - DNA, 1026 bp, Homo sapiens
aaactcctgacctcacgtgatcacccgccacagcctcccaaaatgctgggattataggcgtgagccaccactcttggcggaacttacttttcaaagaggaagcagttgcctcctaataaagtgagtgccgtggctagagtgtaaaatcctgtggaatgaaacagtcatagttggtgaaagttgttcaggcaaatcatatatcattcctgatagttggtgagctgttataattctcattaaactttttaaatggagactttcctctagattgatcaactttctcatggctatattgaaatatttttattagattatttagtcttagtttagactttctgtgttcacagaggtttggaatctatttatatctaagttaatgtaagattattttaatctttttcttgtgaaaagaaatgtgaattgtattttttattagaatttgttcagatagatcagtctttccttcttattggtaagtgcttctatccccccatctgactatagttactgaacagaatatctttctttgtctgctctctcaggctgcctgagcgagtgattgagcagaaggtgggatcccaggttttcttgagcctgctttagtttcagttagaaagataatgtaagttaaaaatgccagcaaaatagataatgtaaatgagcagaacatactcctccttctgataaatgttactggaaaaatgaagaactaagagaatgaaacatatttgaggcttagaagatggggtgaagggtttcctgtaagaataagaatcttgtagctgcagtcaatttggtggccagttttcaaacactgaaaaatctatcatctgagaaacttttcaggattatgtattattacagtattttgatacagctgaaaaaaattaagttattattgctcctattaacatttatttaggctgggtgtggtggcttacacctgtaatcccaacactttgggaggctgaagtaggggcattagttgagcccaggattttgagactagccttgggaagttggcaa

SEQ ID NO: 25693 - DNA, 1057 bp, Homo sapiens
tatgaatacggtattctgtccacttttactttgtagacaatgtaattggcagtgaaataagattctttaaagtataggaacatttataagattagaccagttgtaaacatcataacaatgttcttgtgttgcaagatttttgggtagaaagaggatgcggggtttaaaatgctcatctcagaagtggtagaatatttgcagcaggtcaaacggtggggtgtttgccaatccagctaatgtggtgacttttttcccacagcctgtggagaagctaacagactactgtaagaagttaaaggaagtccagatgcactcctttcctctgcagttcaccctccattgtgctttactcgccaataaaactggtactacattcttaaagttaaagccaagtaaggaagttttgctgaggtagctttgtgatcttttatgatatctctttcagatttggcaaaagccttaatgaaggctgtgaaggaggaaggttttcctatcagacctcactatttctggccattgctagttggacgtcggaaggaaaaaaatgttcaaggttagattttgccttttaccgatttgtaatggttcccagagccagtatgacagtttgcacgcacatctaattggattctttggaaaagcatacttattcctgagtattatgagataatggaattgttttaagtcatcatgaagtattatgtgtaagcattttaaaaaacaaaacatgatggatttctttcatctgaatttcattaatttcatttcttatttcatctctgatcttgatattcaaacttaatgaacgtagtttttttaagttcttaaaaaaactctttagttcttgattttatatatagtgtttgaaatcagattgtctacctttaataaagataaagttgtatatacaattaggttcatgaaaacaaaaagtatggtcattttctttgtgggccaatctatttctttttaactgagcttagttagaataataggaaaggcaggaaaacttttattgtgaaatgagtactcatgacctgacagcctgctgattgaa

SEQ ID NO: 25694 - DNA, 1034 bp, Homo sapiens
ataatttcatttttatctaaaagaatcttatgaaactatgcttttaaaagggtaattagtagtgtaagacaaatcagataatcagatttttaaaaatctagtatttgtatcgatagtacttcaagactgttgatacattagagagtggggttttgtgggaaggggatcaaagggattagttctttctttgtggtttctaaaacaaatgtatattactattatattttaaaaacaaaagtaactcaaggcctaattctgtacatgttgtaaagagtgttcttataaatactttcaatgagtatcttcgtttttcctttgcagcaagattcttggatttatgaaaactaaggatctcccagttacagaggcagtattcagtgcccttgtgacagggcatgccagagctgggtaatgttcaacctaaggttttggttcttaagtgatagatggctgagatgctaaagtggtcattttactccttttttgtttgttaagtggggtttaaattagagaaaattattgtagacagttcttaaaatacatttgtctatcccttcaaaaaaaaatctgtagtatatgaggtagagcatactaatatttttataatgagcttttacatttgttccacaaatctttcttttatttgaatttttagaaattgggcttgaagccgggcgtggtggctcatgcctgtaatcccagcactttgggaggctgaggtgggcagatcacctgaggtcaggagttcaagaccagcttggccaacatggtgaaacccggtctctacaaaaatataaaaatttagccgggcatgatggcaggtgcctgtaatcccagctacttgggagtctgaggcaggagcgttgcttgaacccgggaggcagaggttgcagtgagccgagattacaccattgcactccagcctgggagacagagcaagactccatctcaaaaaaaaaaaagaaaaaagaaactgggcttgatctgatctgaagtaactgctctggaaaatatttttatttttgaagagtaat

SEQ ID NO: 25695 - DNA, 1032 bp, Homo sapiens
tacacacagtgaactctaatgtaaattatggactttggttgatggataatgtatcagcattggttcatcatttgtaacaaagatactacactacagcaaaatgttactaggggaaatgggagggagaagaaagtgggaactgttctttcagtacaatttttctataaacctaaaaacactaaaaaattgtgggtttttttctagtcagtctctgcttatcaaaaaattgtgtttattttttaaaaaaatggtacatgcttaaaagtagtggggagggtcccatggaagcctgcttagtaggataatctgatcccttatatcttttttttttttaatggacattcaactataagatcgttttctattgaagagttaaaaaaaaacccaccttaatttttttaaaaaaactgagagataataactttaaatggtagattttacaagaaaacatttatgggtaatttgagtattagtggtaggagctggagtctggaaggaacctgagacatttaactaggaaatgtaaaggagccagtatgatacttggatgagatgatacaataatttccccttatgtggttatatcaattttggtccttagcatttggaggcagtgagctccagcttgtgcaagcctggtgggtgtgatcttcttgtggggccccaccgtcacccctggacttgttctgttctttcttttctgtgacgacatacccattactccaggctgtgaaactcttgtttccagaatgtattagagtgaatttaaaaataagttctggaccatataactgaagagtgaagacttctttggttaaatatgtaatccttcctctatcccaatttattttataatagattcatgtttctacttaattaaatccaagcacacttatgagaaggagactcggctgcagtaaagacatgtatatgagaaaaatttgcctagaatattcagaacaatgtgctagtttataaacatgttttctgcctgaaatttgagttggtcttctcttacatttaaaaaatatc

SEQ ID NO: 25696 - DNA, 1041 bp, Homo sapiens
cctgacctcaggtgatccaccacctcagcctcccaaagtgctgggattaaaggcatgagccaccgcacctggcctgatgtttattattttcaaagtgtgtttgtaaacataacatcatacaaacatttcaacttccgtgggttattacaaattaggaaacagggttagaagtataatttattcaagacctcaagttgagattcaactccagataccgtgattcccgtttctgaaatgttttacatatgttgcaacatatgttacaagtgttttacatatgttacacatttgatcttgtcattttcctgtttacagttaactgccatggtagttatcattgggtgcagaatgaggtccagactgttgtgttttagatggtgaagggattacttatggacaaaaacattttttaaaaggcaatatatgatataaacttgggatttaaagactttcacaggtaagtaaacatagaagatctcagaatgtatctggaagggatcttcatagattctgaagagtgtccatgtcacattatcggtcccaatctggttaactgactttgcattacttcctccataggtgagacacaggagacatcccatttgactggaggatcctgggagatggaagggaaatctcgataggtggaaaggagtggattggtatttcaggccagaaggttgttataaagtgtagaagggtggctagtagcttttttagtctaaaattctgtgatttaccataaagcataaaactggggcagctaaatttgtcaaaagtttttggagaattcagttcttagagggagaaagttcattgtgacttagttttataaaagattttttaggccaggcccagtaatctccgcactttgagagtctgaggcaggaagatcacttgaagccaggagttcaagaccagcctgggcaacatagtgagactcctgtctctagaaaaaaagaaattagccagctgtggtggcatgcacctgtagtcctagctacttgggagctgaggctgaggtgggaggattgcttgagg

SEQ ID NO: 25697 - DNA, 1033 bp, Homo sapiens
cacacccataatcccagcactttgggaggccgaggcgggcagatcacttgaggtcaggagtttgagaccagcctggccaacatggtgaaattctgtctcttactaaaaatacaaaaacaaaattagcaatggtggcgggcgcctgtagtcccagctactcgggaggctgaggtgggagaatggcatgaacctgggaggcggagcttgtagtgagcagagatcaggccactgcactccagcctcagtgacagagtgagaccccatctcaaaaaaaaaaaaaaataaaagtatctatacataagttagccaggcgtggtggcccatgcctgtaatcccagctacttgggaggctgaggcaggagaattgcttgaacccgggaggtggaggttgcagtgagccgagatcacgccattgcactccagcctgggctacgaagcgagactccatctcaattaaaaaaaaaaaaaaaaagaacctgatgggtcctttggggttctgaaatctgtaacattcggcctctgctctgtgagtgtagatttatcaatcacagggctagacaggcacatgtacaactattagacgtgctgtccataagagaagaatataatattgtggtatttcagagagaggagcagtgccatttgttttatggcagggggacattgagttttagaggacacatggtagtggatattcagaatgttccaaaaatagagaagagcgtgaagagacttggaggccgtttatcccgtgtagctgtgtgggatgtggtggaagttgatttcttgaggctaccaagattgcttagaaggtaggttagttgatgattggaagccgttggaggattttaagtacagattttgacaaagtttatgtagattataggaacgtggggatggaacaacactggtattgcaaattagcagtaataggccttcaacgaggtagtaaagaactgacgaaaagatccgtttcttgagagaaagagaacagaagattggtgagagtgttagcagaattaagaaaagtaga

SEQ ID NO: 25698 - DNA, 1045 bp, Homo sapiens
ttagctgtatgaaaatgatctttataattacgtttttatagaccattgtgaagtatttttctatgtttatggccagaaaattaggtcaatttttgcctccatccttttattcttttcactgtcatgagatcttctgacaagaaaccctttgatttctcaagacttctggacatagagcacaacaaacactgggaaaggaagaatgtgatttccagaattgtcatactacttaaaatgtccggtttttaacaacaacaacaaatatacaaaacagtcaaagaaaacaggaaaatatggctcatataatggtggggggagtcaatagcaaatattgcttaggaagaccaaacattggacttactagacaaagattttaaaccagctaatattttgatattcaaagaaaaaacctgtgcctgaagaatttaaagtatatgaacagttatcaaatagataagagaaattatgaaaaaataaaactgttagagttaaaaagtacaatagctaaagtgagacgtttactagagggacttgacaaatttgaactagcaaaggaatcagaaaacttgaagactcaattgagagtatctggcctgagaaccagaaagaaaaagaagaatgaggccaggcactgtggctcccacctgtaatcccagtgctttgggatgccaaggcaggaagatgcttgagctcaggagttctaaaccagcctgggcaacatggtgagaccccatgtctacaaaaaaattaaaaatttagccaggcatggtggcatgcacctgtagtctcagctactcaagaagctgagatgggaaaattgagcacaggacatcaaggttgcagtgagccatgtttacaccactgcactccagcctgggcaacagagcaaaaccctgtctcaaaaaaaaaaaccagactctcagagacctgtgggatactatcatgcataccaacatatgcataatgggagtctcaaaaggagagaaggaagagaaatggtcagaaacaatatttaaaaaaaaaatagccaacaacttcccaaatt

SEQ ID NO: 25699 - DNA, 1052 bp, Homo sapiens
ttttaaatagagacagagtcttgctatgttgcccaggctggtctgaagctcttgggctcaagcaatcctcctgtctcagcttcccaaagtgctgggattacaggcatgagctgccactcatggccagtgagcatcttttcttacacttattgatcctatagtttttcttcttgaatgcctattcttgtcttttgaccttcttttaattgtctgtccttttcttactgattcataagatttctttacgtgtcctttgtcttttatatgtgctgtagatatcttctccatatttgttctattattatttttttcactttgtgatatcttttgttaaatatgtttttttcattttatgttttatgctgtctgaattttattcaactcagcaaatatttgttgaacacctgctatgcaccattctaggcactggagatataacactgaacaaaataaacaaaaatccctgcctttgtgaagcttaccatcctacttgagaaaggaaaagagaaagaataaagaattacatgaacaaggctaggtgcaatgggtcatgcctgtaatatactttgggaggctgaggtgggctcattgcttgagcccagaagttcaagaacagcctgggcaacatggcaaaaccctgtctctacaaacaatgcaaaaattagctgggcatggtggcgcctgtagtctcagctacttgagagctgagatcaaggatcaattgcttgagcccaggaggcagaggttgcaatgagccgagatcatgccactgcactccagctgaggtggacacaagcaagtcctcatctctcaaaaaaataaaaagaattacatgaatgaaatacaaagtgggtcaaaagcgatagttatggcgaagaagaaaagaaaaaaaagacggggaagatgtgaataggcagtgtggggatagggaggggtgttattttagtaaaatggttaggaaaggcctaacttagaagatgacatttgagcaatagctttaaggaggtatttgggcatagggcccaagttctaagaaactgatatgggagcaa

SEQ ID NO: 25700 - DNA, 1832 bp, Homo sapiens
ggaagtaggaagccttgtcagtaactcagatgagtgaagatgagagtctttacagggtgattgcttttttttgagacagtgtctcactctgtcacccagtctgtagtgcagtggcacagtctctgctcactgcaacctccacctcccaggctcaagtgattctcgtgccttagcctcctgagtaactggaattacaggcatgtgccaccacacccagctaatttttttatattttaagtagagacagggtttcgccatgttggctaggctggtctggaagcccagcctcaagcaatccacctgccttgccctctcaaagtgctgggattacaggcatgagccaccgcagctggccctgattacattttatttgagacatcttaatggaagactagagagcttgagtgataattcctcatctctttggattctaaaatccaaaagcctgttagaaaacaaatgattttttttaactgattggaggctgttgagaatgggcaaaacctgacctaaactgacacaaagctattatgatctttatcccaattagtagatgtttagctctaaaatgttactgcatttgattagagtgttgttcccctgtaaactgagataaggtacccagttaacattccaaaatctcaaaattctaaaacgtacctggtttatctttatgtttcagatggacttatttcacagtcatgtatgtaatcttactgatattcagatcttaagggtgaagaaggccgggcgtggcgcctcacgcctataatcctagcactttgggaggctgaggcgggtggattgcctgaggtcagaagttcaagaccagcctgaccaacatggcagaaccccattgctactgaaaatccaaaaattttagccgggcctggtggcgcatgcctgtaatcccagctactcgggacgctgaggaaggagaatcacttgaacccgggaggtggagattgcagtgatctgagatcgtgccactgcactccagcctggtgtgatgggagcgaggctccatctcaaaaaaaaaaaagagaggaggaaaggataaatataactcactagtaaagtggagatttcagtagcagttggatatatgagtctggaatttggggagagttgttacatgtagatagtagttgaagccataggagtcaaatcactatatttacctctctgctattactacatcattttaaacttttcctgtctccccattatattgggaggtccttaaagacaagaattttataatacacatcttgccagcacatagcataacgactgccacattgtagataagcaacgtgtttatagaatgaattaatagttaaattaatgcattttttcttttcatataaccataaattttattgctagaaaacataccccagaaatcatcccatctgagctctttctttaggtctttgatactttttttgttgttgttgttgttgagagagggcctcactctgttgctcaggctggagtgcagaggcacaaacatggcttactgcagcctcaacctcctgggctcgtgctgtcttcctgccttaccttgcaagtagctgggcccacaactatgcccagctaattttttgattttttgtgtgtgtggagacagggtctcactttgttgtgcgggcttgtctcaaactcctaagctcaagtaatcctcctgcctcagcctcccagagtgctggcattacatgtgtgacccaccatgcccagccctatgacccattttgagttcattttgtttatagtgcaagggattggggtacaactttattattttgcttgtggatatccattgtctgagc

SEQ ID NO: 25701 - DNA, 1032 bp, Homo sapiens
gtataacaaagttttccacttgatccattttaaagtatgcaattcagtggctttcaaagttcatctgtgttgtatgcatgtatcataacttcatttctttttatagttgaataatattcctttgtatgtataaaccacattttgtttatccattcctgtaattgatggacacttgggcagattcttctcattttagaaactatcttttcaatctaatttttctcagtttttctagtttttgttcaatttttgccgctatcttagctgatacctatttaggtgttgtgtgtgtctcttttgcttttaacattttatatgttagccccctagtcttcctagacttttactgtttatgttttagtctttgaaattcttttcctttttgtagtgtcttgccttagtttagtactttctttactcatttagaaattctttataacttctttttatttcatttttgtgttttttgtacatctttcctacttcagaaagataaaatttttaatttcacctattgaactaaattttggacctttaggttattttattttgcattgtgtttagaacattttgtcatgtcgtactttgtcttaacacttagtttataaatagtagacaggaattaccatcagagtaacagctgtgatattagctcacattctaaacagaaggttgactatttcttccctccatttgttcctgaagcaacttttccgttctcttttatagattcccactacctggaaactttaacctgactcaataactccaagtattaatagttcatttagtaattcctttacctgataaagtaatcctgctgtcacatgtcatgtatcaaccattccctctatgagaaatgatgtaatgtaaaagccatggtctttatcactgagacctggggaagctttataaagatgccccggcagctgtgaaaacacctgtagagaagaatgcacatttccttctttcagcaagcatccactgatttccaactctgtccacttttatagggtgtaataaagtagaaaa

SEQ ID NO: 25702 - DNA, 1034 bp, Homo sapiens
tataaaggaagtgactcttattccatttttatttagtggagatggtaaggattagcatgaccattcaggatcaaaataaagcccacagtggactggtatcctgttcattctgactactgctgctgctgttgatttgcctgatgaagatatttgtatgactgaatgagtgtctggttttctccatgcgtgataagtaggggatagttactaaagacgaccagtcttgttcatttgcctaggaaacacccattgtcctggcataatttttaatattgcctctttttattctcagagtgccccattttggatgataaatcatatggtcaactagtagtagtcactaagtagtgactgtgactatgtttcgtgatagttctacctggtggtttgctgttttcaaaatacatatccaactggtgtatgtagatctttttaatgcagtaggttccttaaaagttgcatatatcaacttttttgatatatacaactatttgcctagcaatttcatttctgaaatgcttttcctctgtttcttagtggtctttaactgatagtggatatatcttaatgttataactttaagttgatcttcctactcactcctcccaatattcttccaggttcataatctatagatcagtaatgaatgatgtgtacctgaagactcttactctgaagctcgagatacaagttcacacgaattctgtgggggaagaggccttctccctggtcacttcggatataggaacaagaaaagttgacagtgtaaagctgctctgttgacctggcagctaagctttcatggacacaataaggacttgacattgcactagattgcatagtttgtcccatccagcccaaacatggtggaggctggtataaggcctaagctataaaatgaggagccacatctcatttataactgcaaagtgtgcatggtgatgcattatattctattcctagtccctattctactagtaatccacagtgtgcctttgagctggtatctttacttctgcagacctccttttccc

SEQ ID NO: 25703 - DNA, 1060 bp, Homo sapiens
gacatttcttatattactttaaactatttaattgcagttagtatcaaggcaagatttgtttctttatcttaaaatattagctataccatgaagttgagatttgaaataaaaagattacttctagcttaattggagcaggtaggaagtggtggcatataaaaggtgaatattttcatatgcacagctgtgcatgtattcttagggctctgttggccaaaatctgttgtcctagtagtgctcaggtgcataattcagtcagttgaatcacagatgatccattttcaaagcactttagtagttgggtgtcaagggaaaaaagttgtaattttaagaacttcatccgcaaatcatgtaatggtatttttaattttagcttcccaaatctgtgtggacaaaaattattcagttataaataaaagatgtgtaaatccttattccagtggccttctttggggtgacagggaggagtattaggcgatgttacaggatattgttacagttttatattttgtttctctgtgttagacttttctatttgataatactttttcaaaaatgatgctataaaaacccattattatagagccattaaaaatacaggtctattatccagtgattaatatccatgacctttatttttggatcggcttcataaatatatacattttctatgtcagccattgtctggaatttcatttttgttctgctttccattacataccatgaattaaatgaaattaatttaatcgctactacaaacagaaattaaacgtgccctaatccagagttacgttgtttgcttttacaactgtaagtcataagtaattaattttccttggaaaattaattcacttagcattcccagtagcatcatatgttgacacagggttatagatagtttaatatttttcttcagcatgctggcctcaactttagaagaccttaaatgaaaacaaattaaaatttactcaactgtatgtaatttggggctatttaaaataagtgttgttgttattgatagcatccaggtgatgactcgaaaattatactcaaactttac

SEQ ID NO: 25704 - DNA, 1048 bp, Homo sapiens
catgaccagtcattcctggtgactttgtatctactttgaaactgcttccatagtggtgattagtaatgatcatggacagtcccagattgaggtagaaatttcattttaaaattggattgtaggcataacttcgttttaatggcattggttgggcctctcaaactttcagatgtcttcactagtagaattaaactatgtcctggacatttcaagagagttatctttgatactatgtaagccagcatttaaatttttaaaagagaatttgtgttcataatggttttgctactttttataaagttgagatttaagaagttattcttgggagttggttttgaaaagtctgttactcttcctttctctcttctaaatgcccaccacaaaccaatgcagaacataagttatttttaaaacatagataatagagaagccataatttcaagtgtatccttgctcttccctgccttcctcagcatttccttctgtgcctgcttgctatgtgcctgtttcctcgactcccttccaaccttctgtgagctgccttttgaagaggtggtttgttccctagttcctcattcagaacccccctcatatggtgtgaaatacaaccagccttttaaaaaagtgatccaaacctcttttacgatttgaaacctagtcggatatgtgttgacaaatttaagcaactttttttagtttttcaaaatacaaatttacgggcatgctaccagaattagcattaactgaacactgacccagtgatggcagcagaatgcagaagacatccagcccagtcagctagatgatcagggcatgattgtgaataaaatggaacatggaagttggcagtgagccaggacgtgttttcttgtggataaatttacaaacttaatgtttatcattaagtttgtaaaaggaaatttggactctagattagaatacttggttagtcataccttgggcacataactatgctcattgacctatgcccatccttgccgttgggttattcagggtgtgtttagtgaaaatttccctgagagataaa

SEQ ID NO: 25705 - DNA, 1043 bp, Homo sapiens
gaccttcgaatgtcaggaagctcaaggagcctcatcctgagaagataaattcctgccatgtacatgacacctggcatgatgtcccacatttcccacattatcaccggaggtggggaatagtaaacagaaacagcatacacagacagacagttagggactctgaaacgatctcactaccaagaatgattaaacatttgaggaaaacctatggtagacaaatgaggcaccaaacttaataaacaaaaagtaatagcgagtgagacaatgaataagtaacagagactttgaaataagtaaaagtaagattcatagagagaaaagagattattgcatttataaagaaatatgtattaaaatgaattcaaaccaatcaaatatcttagaatttaagaatgtaattatcaggattaaaatgcataattggactaaatagagtggacacggttaaaagcaaattaatgaattggaaggttgaattccttcagaatgcagttttgaactgaaaaaggtggaaagcatgaacaaaaagtcacatgatacagaggacgttctaaaccttcagcgttcatctgatgtaaaattgaaatagtatggagttataatcacagaagtaataggaaattttcctgaactgaagacagacaagtcttctgaaaacaccttatgaatgcagaagtaaagaataacaaaaggccaacactaaattcctgcttatgaaatttcagaatacgtgataaagaggaactgactaaaagtattcagagagcaaacagtttatctgcaaaggaaagaatgagattgacaacagtcctattattgataaaaaataaatgatagaagatagaatgcagtagttgtggagttgtgggaaaaaacattttgaactcataattctaaatcaggcaaaccatcaatttagtgtgagtggaaaataaaaacaattttgaaccttctctgattgtttcacaccttctttgaaagaattgatggaagtactcccttccaaaaagcaggggagtgtccaaagaagggaaagacataac

SEQ ID NO: 25706 - DNA, 1053 bp, Homo sapiens
attttaaaggcttctcatcatttttaaggatggccgaatagtatcttattgcatgtgcatattttatggtactttttcagaatgtggatttttgtgggggcaggggtaccattaagcacacagatcccacctttcaaaacagctccagctgctgcttatccctaatatttattttcgaaaagtaatagtgtactgtcatatatttttgtttacatgtttggaatgtctattttgtcccctttttaagagcaaaagattctcattttagcccttggtacaattcatatatttagtgttatatataaaattttgttttttaattaaacacagttcctggcactttgaaatgtgctaattagatctatccttttctttcctctgtgtttaaagtcaaggctgaatacttgactaggagtgttttgagagtggaagaaaaacataggtaacacagagggcaaggcaggggctgctgaagtagttatatctagggattccctttagagtgtgtctgtgggacttgtcatggagtgaatcagccaccatgcccagtgattatgaaaaggtgaatttatgacctgcctactgatgatagaaattgttgacagtggtctttctgtatagagataacttagaaatattacaacattgtacttaaatcatctttcaggtctttcttggctgctgattttctttcttcatgtaatctatttttgttttcataccttctctattaagacaacaatcaggtgagaaagaggaggagaaacagcatagtgatcagttaggggttgtcatggtggtagagtcactgcctccttaggaggtaatatagtgccaagtcaaggagcgtagactccagagttatacagtcttggatttgaacctcagctctgcttcttgctagctggctgactttgggcaagtttttgaatctttctgagcttcagttttctaaaatacccacatctcaggaatatgtgaattaaataagatatctacgctgtactgaatatagtatatagctcacaatatgggttaagaatatgggttctt

SEQ ID NO: 25707 - DNA, 1057 bp, Homo sapiens
gttaaagaggaggacactcccacttggtttgttttttagaccattttattttgcagtcacttaatttggttgactgtatactatgcatagcctacgtctgcatatcttattcccgtgactgtcatgatcattcatccatgtgtcatttttcacatctatctctgtcatcagttctacattgtcagttacaaagtgctatctattttgccatcttttattataacttgaatttttcctcccctttatctccgtggtgactgtcttaattcaggacatcatcattttttgtctggattactgaactagcgtcatagatgatcttggtcttctgtcttgtcttttccaatgcatattacaaatcgccctttcaaaattctcatctcacaatttcatgcttgtatacttctttcagctgatcttgtttgtctccaggatagaatccaagctcttgagaagaacatgcatgaccctttgtgatctgtttttttcttgcctctacttctgtctcgctgtttctttttactttagcatacgaaattacttgctgtttctatgatgagccatgagcctttacatatgctgtttccattgtccgggatattttctccctgcccactgtgcctacttttgtttgcatcccatgtgacattcaaatgtgcgtacactctctgtctttctcacatatacacatatttataaatatgggttttatatacagtagagagcagatagagaggtaatgtaggtatgataaacttacaagacttgcttcagaattgcttgtggtatcatattactgtgattagtgaaaatagactcaatataatttttgtatatttttctcttaagttatattgttataataaattatcctttgagaaataattgtacaaaatgaattctgctccttttctggaaagaaaatttgggtgaatgaaaaactttttcttttcttctatttctaaagagccaaactaacatcagatgcagagaaggaatcagtaatgatgtttggacggaaccttcgtcagctccttttaacaagccctgttccagg

SEQ ID NO: 25708 - DNA, 1027 bp, Homo sapiens
ctcacatggttgagaaagagagagaaagagcaagccctctgttatctcttcttatcagggcactgattccatcctgagagccccacccttatgacttcatctaaacctgattatcccccaaaagccccatcttcaaggtatggatatggggagggacacaattcagtctgtagcagtggtgtaataattttttggtgactttcttgtatcttaagattttggccattattaataatgctttggagaccctttactgaagaggaaattttttccttgttttatatctgaccatagatagttactaggatttttaaaataaaaactccagatgtcatagtaataattttcagataccacagcctttcctcacagattatgttactttggcttcaataaaggttttccccgcttctgtattccatctcccttctttttgggagcctttttatggccttatttattgttgcatcagttttagtgtgggcttttctgttttgcaggtggagaccacgtagctttgcaaggccagagttaatgaagatcttatataattcactgaatgattcctttaaacgccttatttatcctcttctctgtagagaattcaggtatatatcttgtcttgtttaattttgtgtactgattattgttatatgatactagtaccattacagtgtgtagctaatgtttgttgattgattaaccaatcgaaagaatttagtcagcatcacaaagtgttaaagttaaggcttgatttcaatctgtagatgcattcacatgcatagatcataaaaatagttcttaattatgatatgtttttcaaatcttgaccacttaatgtgtaccccttgaaatcctgcaatactagtcttgcagctggaggcagtttttagaggtaagagagccaaagaaagcataaggaaatcagtagggtacatgatgaatcaattactttgtttttaactccaaatgggagttatttggatgaaaaattatcagcaatgataaatattaggagattattaaa

SEQ ID NO: 25709 - DNA, 1090 bp, Homo sapiens
aaatattcataatactcagtatcagagtcagtcctcagtagttaaagaaaaaatatgcttttaacctatttattatctttagactaagtaaatgtcaaggaatttttttacagtgatttatttttccatggcttatttatattttatttagttctccaattgaaaaatttgtaatattatttagcctacaatgtaacatgttacatcattatggcatagtaatataattttcagtcaggtttggaagtttttctttttcttttttttcttttcttttttgagacagggtctcactctgtctgtcactcatgctggagtgcagtggcatgatcttggctcactgcagccttgacttcccagtttcaagctgtcctctcacctgagcctcctgagtagctgggactacaggtgcgcaccaccacacccagctaaatttttctttcttgtagagacaggggttttgccatatttcccaggctgttctcaaactcctgaactcaagtgatccaccaacttccgcctcccaaagtactgggatgaaccaccccaggcatgaaccaccatgcccggcctgaaactttttcttcatttagataattccaagagctgaaacacttttctaggacctaaaaaattattctcaaaagaacttttttttttcctttaagcacatgtgaatgactagaaatgcttacttgatgaatcttctagttcctttttttactctctttttccctatttcttcaccctcttctgtatgtacttatccattcaagttatgtgctagattttggagattcccctgtaaattagacagatatactgcttatccatgatgacagcgtagtttaatgagaacaacactgggaaaatcattacgagtatgttgagattatgaaggaaaagtgtagtaagaagaagaaaagtgcttgtaacagagccctgagtagtgtggacttgacagctaggtaggttggagatagaaggagaaggaagagaagtgacatggaatgaagattgagatgttgacacaggttagatcatacatagctttcaggtatgctaaagatttttttcttttaaggatggt

SEQ ID NO: 25710 - DNA, 1224 bp, Homo sapiens
taatattttaattaagagcatggacagattgatctgaagtttaaattctttttttgctacttgctagctttgtgatttgcaacaagttagtttcagaaaaattattatataaagtgaagataatacacacattactggtgactctaaggattacttgagataatatatttaaagtgcttagataggctctacaattagtaatgctcaatggatggtaacaatttgtagctactaaatattgcacctaggattttacatgtttgtatttatcttagcacaggttatcttttcaaattataaaaagtatacccttccaactccagataatcaaaaattttcaattagtagaatctgaaatgagatttttagatcatcaaagtctcttcttgtaaatgtgttagataggctttgtatctgcattttattttctaagagcatgttagggttttccttatgtgggaggtatgttacttgaaaaaagtgtaagtaaatgattattttaaaatgtattcttgtttaataaacgagtaaaaaattcatatagctgtcagctacatagtcgcctgatttgtttcatatattttgtggattattagtctttgccttatgtttgcactcagattctggcaattaaccgtggagaaaatttgaaggtactgacggttaaggtcaatatttctgatggagtgaaggatgaattctgtaggtggtgcatccaaaacaggtctgtttacagatatttacagaattttctttgtttcttttctaaaatatgataccgatatctatatgtactgatatgtaaagatgtctattacgtgaacatttttaaaaagccagtgacaggccgggcgcggtggctcacgcctgtaatcccagcactttcggaggctgaggggggtggatcgcgaggtcaggagttcaatatgagcctggccaagatggtgaaaccctgtctctactgaaaatacaaaaacaaaaaattagctgggcatggtggtgcacacctgtaatccccgctacttaggaggctgaggcagagaattgcttgaacccaagaggctgaggttgcagtgagccgagatcacaccactgcactccagcctgggcgacagagcaagactccatctcaagaaaacaaacaaacaaacaaaaaacccaccaataacagacaaggtatgtagtgtcctttttgaattaaaaaaaataataaaataagtatgt

SEQ ID NO: 25711 - DNA, 1053 bp, Homo sapiens
ataaggagtaatgcattctgtcactttctaactccttaagtgatgtgggtagaaaaaactttttttattcattcatgcaacaagtatttgttgaactcatgctgtgttccaggttctgtctagtgttgctaataaagtatcgaaaggagagagaaagtaaccaactaaatatgtaacataatacttacactagaatataagctccatgagagcatagagttttatatattgctttagagcaggatttttcaacctctgcactactgacattgtgtgcaagacaattctttgttgtgggggctatcttttttcttgtaggatttttagcagcatccttggcctctacccactggatgccaatagcttcctgctaagttataacaattaaaaatgtctctagacattgctagatatccccagttgagaatctctgctttagagtcatattaggtgctctgaagatatttgttaagtaaatgactggtaatatttatagtaataagtactataaagaaaaataaaacagggcaggggatagagagcatagtgagtggttgcagtcggggggcattttggatagagtagtcagaaagttattgcggaagatgtggcaagagatctagatgagatttgggggtgcagcttgcaaagatcttggggatgggtgttccaaatagagaaagcagcaagtgcaaagaccctgaggcaggaataagtttggtgtgttcagggaacagcaagaagaccagtgtggccagtctagagacatgaggcagagagtagtaagaaatgagattgtaatgagtaggatctggatctaataggcttagatccttctccttagtccctttaacttctcttctcaccaccctctaaatgttggaatccctcaaggcttaattctaagccctccccttcctccaccccccttcccctctcccctccctgttagtagctgatcttgtcttatggctcaatataaaaatctcaattttatacagtatctccaacttgatcttccctggtattagaattttatttgaagtgggttgg

SEQ ID NO: 25712 - DNA, 1048 bp, Homo sapiens
gtgattaatcattttatttaagtttaatgaacttttattataagggaatgattatcttgttttaagaataacctggctgcttactcagtcaatcagcatcatttatttcattgccaactttgtagagagacctctactttattcattaagaatatatagaataggctgggcacagtgactcatgcctgtaatcccagcactttgggaggccgaggtgggcggatcacctgaggtcgggagttcaagaccagcctgaccaacatggagaaatgctgtctctactaaaaaatacaaaattagccgggtgtgttggcgcatgcctgtaatcccagctactagggaggctgaggcaggagaatcgcttgaacccaggaggcggaggttgtggtgagccaatatcgtgccattgcactccagcttggacagcaagagcgaaactctgtctcaaaaaaaaaaaaaaaaaaagaataggaaaaaaatgtttctgtctttgagatatagtttaataaaggactttgtaaggggctgcctgatattattaccataaaataacacagaatacttaagcacacaattcttaaaaaatgaagcacacagttttcctacaggtgtcaccctgtaggagtttatattttttaaaagatggcccatactcttaagagttttaaaccattggaaggctgttagctactctttttttttcttttttttttttttttgagaccgagtctcactctgttgcccaggctggagtgcaattatgcaatctcagctctctgcaacctccacctcctgggttcaagtgattcttctgcctcagcctccccagtagctgggatttcaggtgcccacgaccacacctggctaatttttctatttttagtagagactgagtttcaccatgttggccaggctggtctcgaactcctgacttcaggtgatccgccctccttggcctcccaaagtgctgggattacaggcatgagccatggtgcccagccagctactcttttaattggcagctacatagcagaggaaactgatgttt

SEQ ID NO: 25713 - DNA, 1007 bp, Homo sapiens
tttaattcagttttctttactttgaactcaaaccattgtataacattcctgaggccaagcataagattatagtgatgtggattctgtaatgagctgtttcaagcatatttttatgtttaaaataatttcttcattaaatgactggaaaggcccactgaaaatatgtgatctcaatgtaaaagttttttaacttaatataaatcttaagtgattttaaataatggcaagtgatgaaagattaggcatctttatagttggaggaagcctttcttttgtagaaggcagcaaggggatatggttaaagagaatatggtagggtagctacccattatactgttggtcatctttgttgttgttttaatactttaaagtcatcttcttgcctctaccttatttgccttaaaatctcagcaagaaaacaaatatttgaatttcccataatccagataggctttttcaacttctagagaaagcttatagttgctgacaaaataaatatttggactacagaaaacctttgtattttataatttgattctttatctgctgtaactaaatagctaatcaataagtatttgttgttattactgtatgcatagcatatgttctgtgtaagtaagtacaacagatacttaaatacacccaggactggaatttaattatttaataatttagatttgaactgtgatttagatttaatatgctgtaactatttcatagaatatgtagctatgaggtttttcatctggaaaatgtcttgtcaaaacatggctagtatttcatgttataaaaaattagtggaaggttaagaaatattgttggttattctgagcacaggaaattgaccatgaggtttttaaactcacgttttattaatgggtaggcaggtaacatgatgattaggagttctggcatcagattactgggttgaaatcctggctttgtcacttgctagtgaggatgaaataataaaatccctctaaaatacctagctcagcacctgacac

SEQ ID NO: 25714 - DNA, 1029 bp, Homo sapiens
actgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagaca

SEQ ID NO: 25715 - DNA, 1024 bp, Homo sapiens
cctgcactccagcctgggtggcagagtgagaccctgtctcaaaaaaaaaaaaaagttttaaaggacatatttttaaattgatggcctgaaaatgttataacaaaattctaataataaagaggaaagaataccctaatcctgccagcataacagatggtctatttgacttttcctgctcctctcaaggccttgtctatctctgtgtaatccttgagtgtggtctgccactgctggtgtttgtttttctgagctggaggaagtttaagatcttgaacttttcagagtccttaagatttcagcatgatcccagtatctgtcaattggcctgaacctgactgttgatttttaggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggtaggtctggcagtggcttgggggactgtatcacagaaaggcttccctttgttaatttggtccccagtcttgttgacttgtgttgtccttatgtgccaagagtgctgcttctccactgggcatgatggctcgcatctgtaatcccagcactttgggaggccaaagtggaaggatcacttgagccaggagttcaagaccagccttggcaatatagtgagaccctgtctctacaaaacaaacaaaacaaaaattaaaaaattagccaggcctggtagtgcatgcccgtagttctacgtactcaggaggctaaggtgggaggattgcttgagtccaggatgtcgaggctatagtgagccataatcatgccaccgcacttcagcctgggcaacagagtgaggccttgtctcaaaaagagaaaaaaagaaaagaaaaaaaaaggtgctgctgcttctttctcttctgtgttctgcctctttctgtccaacgatccttcccgcaaaggataacttgctgag

SEQ ID NO: 25716 - DNA, 1030 bp, Homo sapiens
ggcttttctccatatttcttcactctggggctcaagctagcaaagcagccactgtctaaaacattgacaattatcatggcagaaggagaagagatgatatggtgaaccatatgttgattcttaaaacttctgtctaggtgtgacacataacacttctgtacatattccactgaccagaggaagaaatatgactcagcctaataccaatgcccagagatgggcagtgaatctttgtgaataataatatagcatcccatatcttatttttctggctttttgcaattcaatctcagctcattaattttcaatctttcttatttttaagatacatgcatttaaggatatatatttctgtgttagctgtacccccgtgttagctataagcactgatacacagaaattttgttaacattcagttcaaaaatttttttacatttcctttatgatatcttatttgacctacatgttatttagaagagctatttatttctttatttatttatgtattttgagacagggtcgtgctctgttgcccaggctggagtgtagttgcgctatcatagctcactgcagccccaaacttctgggctcaagcaatcctgcctcagcctcccaagtagctagaactacaggtgtgtaccaccacagccaggtagtttttaaatttttcctatagacatggggtctggctatgttgaccaggctggtctcagaactgtgggcctcaagcagtcttcctaccttagcttcccaaagtgctaggattacatgcatgagccactgtacccagcctagaagtgtttttttgttttgttttgttttctttttttgggacagagtcccactctattgccccaggctggggtgcagtggtgcaatcttggctcactccaacctccaccttccaggttcaagcgattctcccacctcaacctaccaaacagctgagattacaggcacccaccaccacacccagctaatttttgtatttttagtagagacagagttttgccatgttggccaggctggt

SEQ ID NO: 25717 - DNA, 1457 bp, Homo sapiens
ggtaattctgaggaaagagaggaatggaaagagtactcagtaattgagtaaatgtgattttttttttttttttttttttttggtcttttgctattgactcattttttgtgtacttcttctttttcagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttacccaatggttgctctgcatctgagtcatttaactgttgaagtctaataattttgaaaataaaatatggcattggtttctgcttggtatagtctagataattttttctcgtgtggggaagcatatggagatgggtggcagaaatagtgaaggtgggaaaggaaggagaaaaggattggaaaagtgagaaaagagggagagaagcacagaaaataagaggaacaaaataaggggtgtaactaaggagagattgaagaggaaggccgaaaagatggggatctatgggggctggcttagtgtagtcaccttttgggggccaccatcatgcgtgcccacaacattcctccaccaccatgtgtgtcgtactgtgctactgtgttagatccaggatacctgtgagttgcctctgcccacagaacaagatggtggcagtcatgggaaaagaggggcaagttttttgttttgtttctttatccagattgtatttgacaacttcaaaaggccccaatgaaagactcaaaaacttaagtgtacctagtatgggaattggcataaagtaggtatttactgtttcctacctttatagttttcaactttggcatttgtccatgttgacttaagctgtgcagtgatgttttaaatgtttgcatgttcaaaaaaaaaccaaatctagttggggtgagcatccttatagtt

SEQ ID NO: 25718 - DNA, 1026 bp, Homo sapiens
gtagtcttatttttgttttgtgagtgtaggttaggtctgtaattttgaattatgttccacagagcagcttcagtgacagaggagccagtcatttggggatttggttcttttcctctgtaaacctaggataattttacttaggtcagcatgaaagtacagtggtatgattggtcaaagatatatttgaaatattatcataaggtatcataaagattggttaatctttaggagtcaaagtcacatttcaattgctacctccattggtatttttccgttaaaagtttttgggtttttctgagacgtggggtcttacagtttggccaggctgaagtgcagtggctgttcactggcacgatcccaccactgagtaggctttaagagttaatacgtttcatttaggttacattttattattaatctgtgtatttggattgtggtctttctttcaaacagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaagtcttcaattttgtggggctgggaggggttgaagaagtgatacttagatgtttccactaaacctttgctgtttgcttatatgtttccactaaagctttgatgtttccactaaaccatttcaggtaatggcacaattgacttccctgaatttctgacaatgatggcaagaaaaatgaaagacacagacagtgaagaagaaattagagaagcattccgtgtgtttgataaggtacgtcaaggactggatatgttaaattttgaggatgaaatgaagataccaggactcattatgaagacttgtgtttttttggttgtttttttttttttttttttttttttttttgatgatttaccaacatattttaattaccaagcaaaagctttttaagaattcagtatagactttctaatatatgtattgcgtt

SEQ ID NO: 25719 - DNA, 1028 bp, Homo sapiens
gacatcactaacaatttcattttgttgataactctgccatgatgtcattagttgttgctgtttgacttttggaagactgataggaaaaatgtacagtattttttccttaagaagtctgtacctaaactttcattaaattttcaaggtccaaatttgtttgagaaaaatattaatattactcaatgtatagcaacaactgcatgaagcgccaaaagagttccagtacatgatctttaagggattattaagttcagaattttgtgaagaaatagaagttaataaacagtcatttgatttgttttgtaattgtcttgtgataacctattttaataaaatttttaaaacatgttattttaataaaattatatgtttaggtaataaactaattagggaagggccttggggttgctaatgaacaaataaaacttgagtaatagatttttctgaaagtttcagtttggtcagctaaaatggattttggtaggttccttatatctatcaattatgtagaagatagctgttctgtggcattcaggacctgttctctttattgtgtgtttaggttttgactcttggatttaatttcaggtcattcctgggagttacagtttagaattatatgcttctatacataaagattacgctagttctgaagtacaggaaaactgtaaaggcaggtgaattaaaattttactttggggtttattattttgagtttttacaggtattttttactctttagtataaaaatacaagtaaaaatttggaataaaccttgacctttaaaagaaatgttatttgttcctttcttgaatgaataacaaatggtattagcatagatacggttttattttctgcattttacttattctagcaaacattttaagtgttattagatttttaaatttctcgaaagttatacatagtcttacactatgcatcttccagtatttagctttttgttaaatcatgtaatagaaaggtgattactgctaattaaacattgggaatttatgcacctaatggtg

SEQ ID NO: 25720 - DNA, 2046 bp, Homo sapiens
tcatgcatacttttgaatggcatgtaggaaatgtttgataggtacataatgtattcacttcaggtcactaatgtaatacggggtcgtgctccttagtgttgacagatcacctatggttctccaaaatgaacattctagtacaggaggtctagggaggaacctgagagtatactaatgcctaggaactttctctggagtggcaagagcagtgggaagaattatgtcaatagctacagaaataagggagtaagaacaagtcatctctctagtgaattcttcttcactttactgagataaacatacatgttaatgagcttgagttttcccaaaagtataattcttctggttcttctaagaaaatggcactccctggaaacaaggaagaaccaaatttattcgcctttgtagcagttgggaaagttagtgctaggaagtcttcttgatttatagtaggctttaatctggatattgctggtaaaagtttattctaaaacctgaactctggataagtaatacaaaaagcttctcaaccttccaagcaaaattgagagctttcaggttatgtgagtaatttggtctcttgggtgcttaattcattccttgaagctcatttttgtgatctcttccaagattgcatttgcttggaggtagggagttagacaagatggtatgaggtccctaaattttgactttccaagcaaaattggacagtggttcctaaattgctaacatcctcgtttcttcctaaggcttctcatgtttcatatatagtagccttcccaaagtcccatttcccaccccccccccccccccaacccatgtagagagaacgaacctgtctcccttcctgtacagagtacgggatccttcaactttcacacaggctgcagtgtctgccacacatttagctcaacttttttttagccttaaagtgatgtccgctgcatctgtcgctgggttgcaccttgtggatttagtttgcataaattttctcagcttaaacaaagttaacattgaatagagtaagcttaccataaagggcttaataaatgccatgcatgtctacattcggtgtggaaattgagctagtcaggttgatatttaacattgtaggttctttgttaatttatatgaaataatggttatcatttaactctttaggttagctttgtacatagcatctcactttgcacaacaaccctgcaaggtaagtattgttattcttgtgctacaaatgaagttgactgagaggaggagtaccacgtccaaggtcacacagctattaaatggcagggctgggatactggcctgtgactcagaacttgatgctttccccccacgccacgcatgccaggttgcccttcctttcagaaatggtggaagtcctgcaaaatgcaataaactgaagtaatgtagcttctattaatacaaagtaaataactcagatttactggattttaaaccttattccttgggtaaacaatctgtgactgacttcacaccaaatatttgttggcggaggatttggactttagggataaaagtggatacattttttattttacaaactctgtatttgaacttaattattggctcttcaattttacgttaccagcttttttttttttttttttttttaatgaatttgatttacatcatggtcaaacaaaaattgttgagcagggaaaataaactgctttctggattccttcttgaattttctcatgtgccctagagaaaatgtgttccacattaaggtgttactttttccaggggtgtgttcatttaaaaagaatgaagccaggcaatgtttatttttcttttacctataaataaatgaatggattaatcattgtatacttgactcccatgttggtagggattttagataggaggctatttcttgtctgtgcttctcaataccccataagcagttgcttcatggatgtatatactaataagcagtgaaagaaagtgcatgttcaaagaatacaacaaggagtctggatattttgcaatcatctttatatattacggtgctctgaa

SEQ ID NO: 25721 - DNA, 1030 bp, Homo sapiens
ccgagcagcaacggcagaagccgcaccgcgtcccggcggcggctgcgagtcccagtgacgcattgcaggtacaaaccagccaatcagaggcaggctcaacgaccaacgggggacgcatcgccgccacgatgctcctccgcgccgcaaagtagcgcccctcaggggccgctccaccggccttttaacggctcgctggaaatgaaacccacttacgtcatccgttcgcccactttccttgatctcttgcctcatcgaccaaataactgtgaagaaaggggtcccgagaagagtttgaggggagggggttggccgggactcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggtgagtgcatcgctgagctgccggcgctgggcctgtggggggaagagactggagcgaactgactaaacaaaggaaactcgcctcccttacaccttcaaggagtggtttctgccagagggatggcgcgaaagaggccagggatgccggcgacggttgtgtcgcaggtgctcccccacccccattctcttcaggggggcttcctctagtgagttgagggccggacgcacagttcccgaggtggtgaagctcctcgggggcttggctggaggaggatgggtccgggatgagggacagcccagtgcacgggaaggagagaaagtgaaggaagggagagagggagcgtagagagccttctgtcgggcgtctggaaaggtcaagcagggggcgaattcaatccacccgaccgacggttagtgcgggcgccaggaagcgcctttgtccgcttgcggccgccatgcgcccagggggcgggaggagcgcgcggggccctggggcgagcgtcggcgtcgcagttagcccgcgtcctccgcgtgccgggatccagggggcgcgcg

SEQ ID NO: 25722 - DNA, 1054 bp, Homo sapiens
atcttcccaccttggtctcctaaagtgctgggataacaggcatgagccaccacatctggctgaggccccacattttcattttgtgctgagacttgtaaattaggtagctggtcctggctgtagcagatggtatagattctttttctggctctgtttttgtgacatctcaacttactgggctcttattaaaggtgatttaggtgacttatcaacttttcatgagtacagatgaagaactcttctagggcaggggtccccaacccttgggccacagaccagtactggcctattaggagccaggccgcacagcaggaggtgagtggcaggcaagcaaatcaagcttcatctgtatttacagccactccccatcactagcattattgcctgagcttggcctcctgtcagatcagtggcgaccttgattgtcataggagcgtgaaccctctagtgaactgcgcatggcagagatctaggttgcactctccttgtgagaatctaatgcttgatgatctgtcactgtctcccatcactccgagatgggatcgcctagttgcaagaaaacaagttcaaggctctcactgattttgccttatggtgagttgtataattatttcattatatattacaaagtaataataatagaaataaagtgcacaataaatgtaatgtacttgaatcatccctaaactatcccctgccgccctagtctgtggaaaaatggtctttcatgaaactggtccctgttgcctaaaaggttgggactgctgctctagaaggtatgggattgggaggtgggggtcacacagatagccactgacaacctgagaatagtgacatgggcctgtaaaaacagatcaataggtatctgtggaaggtattgatgaatacatgaatgaatgaatgaaacaacaaactaagaaaaatggcatggcatgcatgaatgtgtgatgggctcaaaatatgatcctcatagggatatttgccttagaaaaaggaggcaaaggctaagctggaaaaatctgtggcaattgagagcccttgggggctctgggta

SEQ ID NO: 25723 - DNA, 1049 bp, Homo sapiens
ttgtttaatgcccaatctttatccccctattgtatatatattcacattcttaaaataatcttgacttaaattgtcagaatgtagctttccttggtctaggtgaggacagaagccactggcacatgtgccataagagctcacttccaccgttctgctttccactatgagagtcacatcagctgccaatatgatccttcatacttggagagtggaagtctgtgttaaaatacttgtgcattatgcctggcatatcattggcactcaataaaatgaagcttctgttttatgctatttctgtaaaattaatagtttttgatacccctctaatattttaagtttttggaattctagcagtactaatgatcatatactggcttacctctgtttattacactttacagttcattgtgcttcacagatactgtgttttttcacaaattgaagttttgtggcaatactgtgttgagcagatctctctgccatttttttccagcagcatgtgctcacttcctgtctctgtgtctcattttttcattatcattatgtctgttatggtgatctctgatcagtgatcctttttgtttgtttgagacggagtttcactcttgttgcccaggctggagtgcaatggcacgatctcggctcaccgcaacctcagcctcccaagtagctgggattacaggcttgtgccaccatgcctggctgactttgtatttttagtagagatggggtttctccatattggtcaggctggtctcaaactcctgacttcaggtgatccacccgcctcagcctcccaaagtgctgggatcacaggcgtgagccaccacacccaccctgatcagtgatctttgatgttactattgtaattgttttgggacaccattaactgcgcccaagataacaaacttcatctgtaaacgttgtgtgtgttctgactgttccaccaagcagccattcccatctctgtccctctcctcaggcttccctattgcctgagacacaacagtatcgaaattaggccaattagtaatcctcaaatggcctct

SEQ ID NO: 25724 - DNA, 1055 bp, Homo sapiens
aaagcgaaccattgactttggcacaagttctctaaatccttaattttttttcattttttatttttgtattttaatattttgaactctggatgatcttcagattagttgggtacattttattgtagtgtttctgcttatacatcgcatcctagaatcaagaaaggaaatacgtatctctgaagagtggctttaaattacctgtattgctcattagttctgttagtgccattaagagttgaagtaaatgttgatatgaattcctttaattttatagctattaatactttttcttttcttttcttttctttttttttttttttttggagacagagttttgctcagtcgcccaggctggagtgcagagtggcgcgatctctgctcactgcgacctccgcctcccggattcaagccattctcctgcctcagcctcctgagtagctgggattacaggcgcgggctaccacgcccagctaatttttgtatttttagtagagacggggtttcaccatgttgacctggtcttgaactcctgacctcgtgatccaaccgtcttggcctcccaaggtgctggcattacaggcataagccactgcgcccgaccctttttctagataagtcagttcaggtttttgcatttgtattatgtttttcatttttcttttctttttttttttttttttttgaggcagagtctcactctgttgcccaggctggagagcaatgacatgatttcagctcactgcaacctctgcctcccaggttcaggggattctcctgcctcagcctcctgaatagctggaattacaggcatgtgctaccatgcccagctaatttttgtatttttagtagagacggggatacaccatgatggccaggttggtcttgagctcgtgacttcaggtgatctgcccaccttggcctcccaaagtgctgggattacaggcgtgagtcaccacgcctggcctgtattatgtttttcattaagtactcatgctttagaacattgttattgacatcagtctgtagatttactacatgaaaacttggataagtgg

SEQ ID NO: 25725 - DNA, 1050 bp, Homo sapiens
ccagtcagggcaatacagcaagacaccatctctccaaaaaaaatttttttaattagctgggcatggtggtatgcacctgtgggctcagctacttgggaggctgaggtggaaggatcacttgagcccaggagatcgaggctgcagtgagccatgattgtgccactgcacttctgcctgagcaacagagcaagatcttgtctcaaaaaaaaaaaaaaaaaaggtcagactattcatatgggatagaatgaatattatgaagtcaattacaatatctactccataggaagtgtggatgtatatgtttttacaagatacataagtgtacacagtgtacaactaagtttgaggacggctacacttcccagtttaagacttaaaaataggggaaggccaggcgtggtggttcatgcctgtaattccagcactttgggaggccgtggcgggtggatcacctgaggttgggagttcgaaaccagcctaaccaacatggagaaaccccatctctactaaaaatacaaacttagctggacgtagtgactttactaaaaatgcaaacccagctactccagaggctgaggcaggagaatcacttgaacccgggaggtggaggttgcagtgagccgagattgcgccattgcactccagcctgggcaacgagagtgaaactccgtctcaaaaaaaaaaaaaaaaaaaataggggaaaacaactgattttttttttttcctattttccagtggaacacagttattctatgtgactggtttgactttctttctctctctctcctgcagggaaaagttttgattagccttagttaataacccagggtaggctgggcgtggtggctcacgcatgtaattctagcactttgggaggccgaggcaggtggattttctgagttcaggagttcgagaccagcctgggcaacacagtgaaaccctgtctctactaaaatacaattagctgggcgtggtggcatgcacctgtagtcccagctacttgggatgctaaggcaggagaattgcttgaacctgggaggcggaggtttc

SEQ ID NO: 25726 - DNA, 1008 bp, Homo sapiens
atgaatgcatttagttgtctttcatgacagattacccccaaatttaacatctttatcaaagtctcattaggttgcactcaaactgtcggccagggctatagtcatttgaagtcttgactggggctggagtatgtgctttcaggatgtctcattcacgtagctgttggcaagaggcttcagtgtcttgctaattgtttgcagaaggtctcaattttctgttgcctggtcctatccacagggctgcttgagtggattcataaagcgtcttctggtgatagggcacgtggctttgtccagagcaagtaatcgaagagagcaagcaggtagctactgtgtcttttatcacctactctcccaaattgcatactatcaccacttcctgttcattagaagtcactaagctcaaccaatacttaaggggaggagtatcaatactcaaggaagaggagtatcaaagcatttgtggactttctaaaacccctgcggaggataatgccaagtgttagtgagcgtagactttgcagccattctggagctcaagtagtagtatgtgcatgtcctatgatccagtaatttcatttttagacatctcagagtatttgtaagagtttcataaagggatatgtacatgggtattcattgccatattatttgtagtggcaggaagttggtgacagcctgtgtgttccacatatcagtctgaatgtagataagtaaaatttgtgagtgctcatactagcttttctagtgctaccatatcaaactgccacacactgggagcttgaaacaacagaaatttattctcttacacttctgtttaaaatcaaagtagcagcagcaccatgattctttgagaatctgggtagaatctttccttgcctatttgtagattatggtagtagctgttaatccttggtattccttggtttgcagctgcatcacttcagtctctgcctcttgtcacatagcattctccctctgtgtttgtcttcacattggcactttcct

SEQ ID NO: 25727 - DNA, 1065 bp, Homo sapiens
tggttgcttgacttcagtattcgatcacttccttttatgtgtcttatgtcttcttgatggcttttccatatctcagcctcaggtgtttgctgtcatttacagttgttgttaggcccatttatgcttaatgaagaattaccagttaatatttatttgataatgttttacatagtaagttcatcttattcactgtcctgaatgctttctttataatactgtttggtaatgaagttgctatattcttaccagaatgtatttcctcattaatagatgtctgatatcagtatatggacttatgatgcgcaatagaaatgatgtataattaatatattatgcataacaagaacctgttttacagtaaacttctgtttactgaatttaattcacaagagttagtaattggcaaccttaggattagaatccgtgtttttctgattaaacagccagaatgaagttttaattactaaattataatgcatcaataatcatctcccatgtaaaagcttttaaaaaatacttcaaaaatacctgaagttacactgtaaggaacagccatcaggatggtgctgtgagtttcagcattgagattctctgtctcttcaaagacagcaatgataaacatacacacaattaataatcatactttccgaatgaatgtagatgcataaatctgcatcttctctagaaatcataaagaggaaaaatgcatcaacctctgttttcagtgaactgaaagacatatgtaaactccagattatgttatttgagggctatcaaaaacatccgaaagggacagaagctattagtttaaatatacttactgacagtaaggggttcatgttgaagttcaaaaggtaaatctcttgtttgtaatgacgggagttggtggcgaagtacctgattatattcagaaaagagaaagtagagctgtacacatgtgcacacagagccacatgtacaggaaccagcttttctctgtatttttaaataatttttatttatttatttcttgagacggagtcttgctctgtcacccaggctggagtgcaatggcacaatctcggc

SEQ ID NO: 25728 - DNA, 1106 bp, Homo sapiens
gtggtatggactcatgtctgtttaataattttatgtggggaatattttcttttcgtaaaacttgagtttacctgtgaagaaattagtcactgtcaatttattaggtgttgaaacagattgctaagggaaataatttcatcattattggttaaaaaaaaaaaaaccctctcactttctaagaggatttctaagaagaatgtgtttgggaataagtaataaccatttttttaaaaatgtaggactttgaaacatgaatttagttcttagatttttaattgactcatctcacactcacttgataagttgtcggaccatcttacaggcttcttataaacctaaaccaagagaaaacaagtgttttcctgagaaagcacactagaaaaccttcattaaagagatcaactaaattttgttgctttttgttttttaattggaagctactgatgtggttaaggaaaaatcagtaagtatagattctagggaatagtctacatggttctatgaagagccaatcacagatttatttaatgtatttctctgaaacagtggcttttagtagctgaagaaggaagaaaagcaacataaccggatttaaacaaagcttttgttttttcatgaagcagtcatattggtgttatgtcagttgggggagattttagaaagttatgttatggaaactgtaacttataaaaaaatactgctaacttataaaaaaaagtactgctagccatttgcacatagacacttagtgaatgaatgtttctgttttccttcatcttctctagtccaaggtgtgttcatataattacctaatttacattattgagcatattaaatatgttcatagatgattaaaaactgggtgcgattaagtactcaaccaagaacaaatcaaattactttgaataacctgtttttaaaaaagcagatgtgttttaatctgtgtggacagaaaaaaaatgagcagactctttgaactgtctagctagaaccaaatatagcagataggggctacagttgaggttctgaagtgtgtgtggtttgggtgcttgggtgtgtataaacacatgatactgtatcatagcaataagatttgtaaaacattg

SEQ ID NO: 25729 - DNA, 1961 bp, Homo sapiens
gcttggagctgctttggagatttctgttgtctatccctcagccaaccagactgaatagtcctgccgtacagcatcctgtgtatttgaaacttgtcacccttaataaatactgatttctgaagtatctgagactatagtttgtttacttcaggtagttcctcagaagggcaaccctcagtgagagattatacaaacgccgagtcagaattttttggggggcaagaagaagactctttctattaacctccagcctttgcaaaaattgttagtgtcctaacacaagtaattgtagtagcgagaggactcttggcctaataattcaagtcaaatgagaaaataaaatggaagtcttcaggaaaatagaggacttgttattttatagaatttcaataaaatatctagaagtcttcactttcgtgtttcaattcttaccccgtgtgatgtctgtccctaaggcactaattgtcttcttagaaacactccttgtgtttttctaccaaagctattaactctgattcgatatgacttgcccagtactttcagccttcatgctcctttctggtttctaatttatttatttctgtaaccaaaacatagaaactgtctgatacctactgctgtggtttgaatgtgtctcaaatttcaggtgttggaaacagtcctcaaattcatttgttgatgatatttggaggtgagatatttgggaggtaattaggattagataagatcatcaagatggtgccccagtgatgggactggtgggtggctttataagaagagagactggagctgatatgcttttgttctctcaccgagtgatgacctctgccatgttatgacacagcaagaaggccctcatcagatgggccccttgactttggacttcccagtctccagaactgtaagaaataaatgtactttctttataaattacccagtctcaggtattgagttatagcaacagagaatggactaagacagaaatttggtactgagaagtggggctgttgctcataacgattacctaagaatatagaagtagctttcgaactaggtaatgggtagaggctggtaaagtttggaagaacagtctagaaaaagcctatatttccgtaaatggagtgttaagggtgattctggtgagtgctcataagatgagaagactaggaaagtctcaaccttcttagagattatttaagtggttgtgaccaaaatgttgatagaagtatggatagcaaaggccattatgacaaggtctcagatgacaattagcaataccctgttggaaagtggagtaaaggccatccttgttattaattagtgaagaactgggatgaactgtgtctatgcctaaggactttatggaaggctgaatttaagagtgatgaactaggctatctggtgggagaaataactaagtagcaaagcattcaggctgctgcatggctacttgtggccacttatagagagatgtgagggcaaaggaatgacttaggacataatataattagaagggaagaagagtagaaaattttggaaaattctcagcctggctgtgtggaaaagaatgaaagagaattttcaggagaggaacccaacgttgtgactagcaaccctttgctgagcagatttgtacaaatagaagatatcatcaagacaattagaaaaaaaccttgaaggcattccagagatctttgaggctgtccctcccatcacaggcccagggctctaggaggtcagattggttttcaggagggtttgtggggtggtactaattctgtaggcatgtagaatgcaagagctgtgggggcatggattcctccacctagattccagaggttgttgaaaacagtctgggggctcaggcaagagacctgtcccaggagaagagccactgcagagagcctttctagagcaatgcccagtagaaatatagggttagagctgccacaaagtttcta

SEQ ID NO: 25730 - DNA, 1961 bp, Homo sapiens; identical to SEQ ID NO: 25729

SEQ ID NO: 25731 - DNA, 1961 bp, Homo sapiens; identical to SEQ ID NO: 25729

SEQ ID NO: 25732 - DNA, 1961 bp, Homo sapiens; identical to SEQ ID NO: 25729

SEQ ID NO: 25733 - DNA, 1961 bp, Homo sapiens; identical to SEQ ID NO: 25729

SEQ ID NO: 25734 - DNA, 1059 bp, Homo sapiens
attatatgttagtcttcctcaatgccttgtggagggataaggatggagcatgattcttgggcttggatgagtcacagatgtataatggctgtgtgactttgggtatttcacttcattctgctaaatctcattccattatctttaaaatagggatagtaataacacctaagcttgctttagaaaattattttgaggatcaaatgagctaacagttgtgaaaatgctttgtaatttgtaattattgtcttaaaaaaaccctagttttttgggtgagagagtctttggtctcaatgtcaatatatgtacagatcaccttgcccggatgtgtgccttgtacttgcattctaggatattgcctgtttggaacatctactcatattttcatactgtccctctctgggcaactagcttttgtaatttacaaatatttacaaatgtttaacaaatttaaaggttaaaaacaaatttaaagaaattatccacacagaagtacaaaagagaaaaaagatggaagaaaaaaacaagagcgtcagggaacgaagggacagtatcaacaggtctaacattcatgtcattaaaatccagaaggagaggagattgggcacagaaaaaatatgtaaattaataattgccaaaaacttcctattattggataaagatataaatttacagatttaagaggcctgttaaacccaaacaggataaactcacagaaaggcatggtcagaaaaatcaaaatgctataaaacaaatgtaagggagacctagtctctccccggatcaaagaagaaaaagaaaagtaaaggtgaagcagtatggtgtacagtagtccttggtcacagacatgagttaacaaacttagttttgttttttttgtgtgttttgtttttgcatctcttagaaattttgctctttgaagtggccatgtgagcataattacaatttgtttttgtgctatcgaaagggcatatgagcgattttctttcatgtgagacttgtaattgaaccaatatattcttaggtagattttcagtaagtagtcattggaaaatgctatat

SEQ ID NO: 25735 - DNA, 1059 bp, Homo sapiens; identical to SEQ ID NO: 25734

SEQ ID NO: 25736 - DNA, 1059 bp, Homo sapiens; identical to SEQ ID NO: 25734

SEQ ID NO: 25737 - DNA, 1059 bp, Homo sapiens; identical to SEQ ID NO: 25734

SEQ ID NO: 25738 - DNA, 1059 bp, Homo sapiens; identical to SEQ ID NO: 25734

SEQ ID NO: 25739 - DNA, 1032 bp, Homo sapiens
gagagcttggagaagcggataccctaattgtgcatatgaatttgcatattcctgacttaccccaagctttaaatgcacaagatagacccaaattgttttttattttgttttgtttttgagacaggatctcattctgttgcccacacagagtgcagtgatatgatcatgactcactgcagcctcgacttccctgggctcaggcaattatcctgcctcagcctcttgagtagctgggactacggttgtgcgccaccatgcctggaattttttttttttgtattttttgtagagacagggtttgccgtgttgcctaggctggtcttgaactccgagctcaggtgatctccctgccttggcctctcaaagtgctgggattacaggcgtgagccacagcacccagccaacccaaaatgttgaaagtaagatttgaactatcatcagagtctcaggctagaccctgagtggcacattcatgggtccaagcttaaagcaggaaagtcaaggcttttgagaactgagctgacgttggaaccactgtataaggtaaaacagaaattgcagtttgaacctaactaggttatatgcttgctgaaataaacaaaccaaaaagctagtgttcttcaaaggattataacaagacccaggactcagaatttatacagcataacattcacaatgtccaggagacaacctaaaattatttgacatatgaagaactgataaaacattactaaatctcatgggaaaaagcaattaatagatgccagtcctgagatggtccagatattagaaatatcagataattgaaagcagctcttataatggtgcttcatgaggctaacacactggaaaaaatgaaaaggtagaaattctcagctgagtagtagaaactataaaaaagacggaaaaatacaataatctgcaatgaaaaatttactacatggactccatagccaaatgaaagatataggaaagagtaaattaacttgaaagtaaaccattagaaattattaacaaaggggaagacatgct

SEQ ID NO: 25740 - DNA, 1032 bp, Homo sapiens; identical to SEQ ID NO: 25739

SEQ ID NO: 25741 - DNA, 1032 bp, Homo sapiens; identical to SEQ ID NO: 25739

SEQ ID NO: 25742 - DNA, 1032 bp, Homo sapiens; identical to SEQ ID NO: 25739

SEQ ID NO: 25743 - DNA, 1032 bp, Homo sapiens; identical to SEQ ID NO: 25739

SEQ ID NO: 25744 - DNA, 1081 bp, Homo sapiens
tgtttaagttccttatagattctagatattggacaaagttaagataaagacctttgtgtaatatccagaatctataaagatacctagttagcaaatattttctcctattctgtgggttgtctgtggattcttctgttttacagaagctaaagagcttaattaatctaaagagattaattaggtcccacttaccaatttttgtttttgttgcaattgcttttgagaacttagtcataaattctttctcagggccgatgtccagaacagtgttttctcatttttttttctaactaggatttttatagtttgaggtcttacatttaaacttttaatccatcttgagttgatttttgtatatagtgaaagatagggttccagtttcattcttctacatgtagctagccagctatactagcaccgtttattgaataaggagtctctaactcattgcttatttttgtcaactttgtcaaagatcagatggctgtaggtgcatggctgtatttctggattctctattctattccattggtctttgtgtctgtttttgtaccaggaccatgctgttttggttactgtagccttaaagtagagtttgaaattgggtaatgtgatacctccagctttattctttttgcttggtattgctttggctatttgtgcccttttttggttccatatgaatttaagaaattttttttctaattctgtaaaaaatggtgtcggtagtttgataggaatagcattgaagcataaaaatgacacttcagggactcagggaaaggatgggaagggggtgagggataaaagatcacaaattgggtgcagtgtatactgcttgggtgatgagtgcaccagaatctcacaaatcaccactaaagaactttctcatgtaaccaaacactacctgttccccaataacttatgaaaatcaaaaacaaaaaactctgacatttaacaggggaaaaaataaaaaaaggaatagtgttgaatctatagattgctttgggcagtatgggtattttttaaaatgatattgatttttgcaatccgtgagcagcgttttccgtttgtttgtgtc

SEQ ID NO: 25745 - DNA, 1081 bp, Homo sapiens; identical to SEQ ID NO: 25744

SEQ ID NO: 25746 - DNA, 1081 bp, Homo sapiens; identical to SEQ ID NO: 25744

SEQ ID NO: 25747 - DNA, 1081 bp, Homo sapiens; identical to SEQ ID NO: 25744

SEQ ID NO: 25748 - DNA, 1081 bp, Homo sapiens; identical to SEQ ID NO: 25744

SEQ ID NO: 25749 - DNA, 1029 bp, Homo sapiens
tatttcagtgttggtgctgttttcacagagacaattgcttccttaacttcttttttaaaatttacagttgtagatttagctacaattttcctttggtttgtggtaatatttttcagatgagaggtttttgctttcttttgttgttggtctattgtttttctataacttttcttcctttattcttgtatctttgtatggatttgtgctggtacctttgtgataattcatcttgggaatatgtgagtttttgctcaattagctgctttcaggaggtttataataggaaggaggtagaggcacattccatattatggagttttcctttagactcaggatttttggacatgaattcatttagctagtatctttcactagccattgggggttggcagctgtgggatttttgcaatacagtttcccatttgtggtagcagagatagaccactttgtgtgattctttttttggatccagtccctctgattttcggatttcaactggtccagagaagttcctgctgctagcctgtgcattttttcctggtacttagttttgttcctcagagggagcccctgacctttgagaagtgttctttgctagctttttcttagatgtgcagctgacacatctgtcctctttctcccacaagtacccaggattgatcgtcattcttttggagccccttttacaaattttgatctggagttcaaaaatctaaaactagaattatagttttactaaaaatggagagtgtgtttttattttatttttcttgctgatgttggattaattgcttttggatgatttctaagaaaagtaaagggaaatgcctatattgtgctacaatattaaaattggaagtccatattcatttttaaagtaaaacagaaattctcgatttcagtatttttgtaataatttgaattctagtatatggtagcagtgaatagacctagataaaatctccctcaaccccagtccatacaatacaatctctgttctagttaggtaccgtagagcagtgccactca

SEQ ID NO: 25750 - DNA, 1029 bp, Homo sapiens; identical to SEQ ID NO: 25749

SEQ ID NO: 25751 - DNA, 1029 bp, Homo sapiens; identical to SEQ ID NO: 25749

SEQ ID NO: 25752 - DNA, 1029 bp, Homo sapiens; identical to SEQ ID NO: 25749

SEQ ID NO: 25753 - DNA, 1029 bp, Homo sapiens; identical to SEQ ID NO: 25749

SEQ ID NO: 25754 - DNA, 1050 bp, Homo sapiens
ccttatgcagtggggaggagcctggcctcttcagctcatgtgtggtggtctggtattcaatctgtggggtgggaacctgttggcaggacccccttttttagctgggagctttcctttaataaattctgctctcctcacctttcaatgtgtccacatgcctaatttgtcctggtggtgacacaagaacccggattttagctgaactaaggagcaaaaaatcctgcatcactaccctagacttatcaacttgagttactttatcaagtataaaacaagcaaatagctctactggcatttttattagaagtgtattaagtttattaattattttgggaagaatcagcatctttataatattgaaattttccatttaggagccaatctactgatgtctattatctatatatgtctttgtgttcctaggttttcatgtcatttgtattcacaaaactgtcaggttaatacatgaaataagggtcatgtctgactaatctccgactaatctcaataaactactttgaataagagtcaacttctgactaatctctgaaaccctatttctgtgatatgtccttttaaaatatgactactctatcttgccctttagttgtgcatctgtgaagtttgagactgttttctttgaatatatgtacttagaagctgttactgggatatcatggcttaatctacttgtttcatcagtgagttacaatgacaagaattacttaaaatagataactagttaggagcatttgtttcaattctgacacttcaagaaaatgtttaagtttttttttttattttctgtttagtttattccagctctcagaaatgtcttcacccttcactttagagcccatctttctataatgggcatagaattttattgtgtaaatatcatttgtataatttgagtgttaccagaaccttgacgttttcatgacaaatacatttcggaaactttaactcataaattccttattatatgtcactggttgtgttagagtgcattttattcttttagaactgcagttttcattaacaattaaa

SEQ ID NO: 25755 - DNA, 1050 bp, Homo sapiens; identical to SEQ ID NO: 25754

SEQ ID NO: 25756 - DNA, 1050 bp, Homo sapiens; identical to SEQ ID NO: 25754

SEQ ID NO: 25757 - DNA, 1050 bp, Homo sapiens; identical to SEQ ID NO: 25754

SEQ ID NO: 25758 - DNA, 1050 bp, Homo sapiens; identical to SEQ ID NO: 25754

SEQ ID NO: 25759 - DNA, 1097 bp, Homo sapiens
ctctcccgttaatttatatatttagtcatttatatctgcatgaactcattgttacttattttatacctgtactttaggttacaatccaatacaatgtaatttattttgttgctcatattgttttggtcataggatgccctttcagagtggctcctattgtctcttttgcatgcccccattgtttgttttttgagcacgttttactttttggacctacagtgtgctccgactctttgtatgtttcccacctcagccttagaatcagccattttcataagagtgctggtttcttttacgggagaatgatagtgaaaaccaagatgtaaggccaggcatggtggctcacgcctgtaatctcagcactttgggaggccaagtcgggcagatcacctgaggccaggagtttgagaccagcctggccaacatggcaaaaacatgtctctactaaaaaaaaaatacaaaaaattacccaggtgtggtggtgcgcctataatcccagctactcgggaggctgaagcaggagaatcgcttgaacctgggaggtggaggttgcagtgagctgagatcacgccactgcactccatcctgggcaacactgtctcaaaaaaaaaaaacagaaagaaagagagaaaaccaagatctgaggactgggtgtgcttgttgctactggactgtcattgattttaagccctttcagcagacagatctagaacatatatttatatattataacccatgtatatatacatctatagttgtttccgtgtctagccatctgtatctatattaagctaaacatgaattcatactgatgtctggactctactccagaacacatggttcattctagccttccctctttccttatatgtaaccttcctctccaacagtaagaaacctggcccccagatctgccatctgtttatttatttgtttgttcttagtattcatgtagagtggtttcagaattgttaatctctactcctagaaacaactttaccaactagactatagtgtttatgtgcagttctttttgtctttagtcttacagttttcagtcatagcatcatttatcaaagttatgtagaccagtgtct

SEQ ID NO: 25760 - DNA, 1097 bp, Homo sapiens; identical to SEQ ID NO: 25759

SEQ ID NO: 25761 - DNA, 1097 bp, Homo sapiens; identical to SEQ ID NO: 25759

SEQ ID NO: 25762 - DNA, 1097 bp, Homo sapiens; identical to SEQ ID NO: 25759

SEQ ID NO: 25763 - DNA, 1097 bp, Homo sapiens; identical to SEQ ID NO: 25759

SEQ ID NO: 25764 - DNA, 1050 bp, Homo sapiens
aaggtatggaggctttgcctacaagctggattaataaaacataaaaaagtataatacataacttattaacagtagtatttgtttccctttctatagtcataaaataactgcctgaatttatttattaaggatagtaagattgcctgccttggattcaattagtatgatactctagttggacatcttatacggaagtgcctctgtctggcctctttttattgactgagctaggtgatatgggagaagtagtctgctgtttgaatttaagcatttggtagttactggtcatgtttattctttcttcctttaccaaacagaaagagcaattgtactgaaattgaggatgtgttttgattgaattagtctttttctttttaaacactttttaatacttttgggaatttttacaactacttagcatgaaacaagatgcctgccttcctgatgctttttcttgtcagaggaaacagatgacaaatatctaaataattaaacaagataatttaaaaaggtaaaagtgttatgaagaaaataaaacaaagtagagataataaaacagatgggatagacaaaaatggtgtgctactgcacatctctttacatctctgcattcagtgacttcatgcttgggatcggccatggtaggagtatttacaccacagaaacaagccagtgctacaaaccagtgctataaactgggctttcttccctctggacagctagttattaaatgttaaccagcacactactgagtgaaggtcattgactaaaggcgagattctgacatttagtatagagggggtaggaagaaaacaaatggtgactgagcattgctttgtgatagtcattgtgccacatgctcaatttatcttctttatctaatatttataaaaatggtgttagaggcagtattatcctcattttattggtgaaaagaccaaggctcagagaagttgacttgtaaaaggttacataataaactagggtatttgatttgaacccatttctctgactctaaagcccttttttttcctctcataccaagcttct

SEQ ID NO: 25765 - DNA, 1050 bp, Homo sapiens; identical to SEQ ID NO: 25764

SEQ ID NO: 25766 - DNA, 1050 bp, Homo sapiens; identical to SEQ ID NO: 25764

SEQ ID NO: 25767 - DNA, 1050 bp, Homo sapiens; identical to SEQ ID NO: 25764

SEQ ID NO: 25768 - DNA, 1021 bp, Homo sapiens
gatccacccgcctaggcctcctaaagtgctgggattataggcgggaaccaccacgcctggccagcccctttctccttttaaagaatcacggactgttgtgttgactaggcaatttctaatcatcagtctattctgacagcatacatatctcaatgtgttttgtaacacactgtacattttcgtcaagactagtaaagtatgttgttatagccacatacataaatatttaatacttggtcattataattggagcctgggctaaaggttttcttttcggaatggcaattttaaatattcatatcaaaactgacaactctcaaactcctggcctcaagcagtcctcctggctcaaacttccgaagtgttgggatcagaggcgtgagctaccgggcccagccaaaactgacaactcagaagccatttaatttagcttagttctttaatgtcttgaatattgttctagaacattcttggagatactttggccatgacatttctgttgatctgtaaatgtgcatttatcctaagccattgccccttttcaggtcactgtgtccaacatcccaataggccagtatagtctacttaaaagccaagttcttaactgaccaactctagttgagatagaatggtttctaattcaggttcttttcgtgattttaatcccatgtctctcttatgagcaggtgcaaactactttagcgccttgatcttttccactttccattgaccaatttccaaattattagttacctcaatcttagttttctttatggattagttgttttgtagccagtacaaagctgatttgcataagcagtgagctgctgctaattctctatacatatattgagattaatgtctttgtaggactgactgaaaagtgaatcaatgaacttacatttcatattataattatgagaaccatcaagaaagtaacattaaaataatgctggatatagtaatgagtttggtactatgttattcatataaccagaacttcatttaacttcactagtac

SEQ ID NO: 25769 - DNA, 1021 bp, Homo sapiens; identical to SEQ ID NO: 25768

SEQ ID NO: 25770 - DNA, 1021 bp, Homo sapiens; identical to SEQ ID NO: 25768

SEQ ID NO: 25771 - DNA, 1025 bp, Homo sapiens
taagaggttttaagtgagagagaatgagtgatttacacttctgagttatgaagtgttcttacctttctgtatatggtaatggtgcttcaaggtaggcatttcttttacattcataaatgaactttactttgccctatttaaaggtcagtattagaactggcctattcgtgtagttcttatatgggacaatcagaccacttgtgttctaggcaattttattttcccattttggttttaacacaggtcagttaacaatattatggaaagcttcactttttactattcaacttgaggttgaaatgatatattatgaagccaaaacaagttttatttgttctcccatttcaaagactgataaaacagtctttgcttataaatggaaagccttagagaaagtccagacttggaatgttccataatttaaggcacaaaggtgacacctatcagtgcctgcaagctttttttttttttttttttttttttaaataaacttcgtccacggagtaccaaaggctgtatgtgtactgataccttaacatcattcatgggaatgctgagtcataagccacaattttacctacttgtatgcccaatgtctggcacatagcgagcctaaatcatccaggcatttgtgtcatctttgttgctatttccttttagtcttcatctgttcgtatagataatttgtaatcatggaacacatgggattttggattatgatttctcatttaattttcctgttagtcttctcatacattttaatagttgcataatattgtgtcattgatgaactataaacgttcctgtgttcttggacatttagatttctgacttgttttctttttaagatgatgctacaatgaggatatatatatattggtgagggtcaagtagataatgccatattattttcaatttcaaagtgaattagaagttatttatgcatagctactgtgtgctgtggagaagatgaaatcttgattcttggttccagtagcttatattgtcattctagaatgcaaact

SEQ ID NO: 25772 - DNA, 1025 bp, Homo sapiens; identical to SEQ ID NO: 25771

SEQ ID NO: 25773 - DNA, 1025 bp, Homo sapiens; identical to SEQ ID NO: 25771

SEQ ID NO: 25774 - DNA, 1074 bp, Homo sapiens
agtacaagcagacaaacaacatatgtgcttacttatatatttaatctaaaaccgttgaactaaaagaagcagagagtagaacagtggttaccagggttggagggaaggcatgggggaatggggagatgatagtcaaaggggaggaatttttttctttgagatatgttgcacagtatggtgaatatagtgactaataatgtactttatacttgctaagagtaacttttaaaagttttcactacaaaaaaaatttgaggtcatggatatgttaactagatttaattattccacattgtattcataaatcatcactttgtacctcataaatatataactatagtcagtttataattaaaaaataaaaagcaaagattaagttttgtttcactgtttacattgggcttcagtttgcttacataggaacccagagtcctaggaccatcttagccaaatggcctccaattaaagattgcttacactctttttttttttttttttttttttgagacaagaatcctgctctgttgcgcaggctggagtgcagtggcgccatcttggctcactgcaacctctgcctcctgggttcaagcaattctcctggcttagcctcccaagtagctgggactacaggtgcccgccaccacacctggctaatttttttgtatttttggtagagacggggtttcaccatattggtcaggcaggtctcgaactcctgacttcaggcgatccacccgccttggtctcccaaagtgctgggattacaggcgttagctaccacacctggccaagattgcttacactttttaaaaaatgttatattgtttttagtaaaacaaagggtaaaatttaataaaaaggcacaaacacattttgtgtatattgtgaaaataccatctatttcctccaaaagcttataaattgatatgagtatcataaacctgtttatttttctcctggactaagtattgttcaacgtttaatgtgtattatgtacagggaggtaatgtgggaccagattttctggttgggaaaggagatgagtactggttttagtacaataagtttccatgc

SEQ ID NO: 25775 - DNA, 1050 bp, Homo sapiens
attgttataaattgcatgaaatacatagtgggctcgattcatagcccccgtccgtatctatatctctatatctatagagacataacttctttcttcgtaagttatatatgtctacttctacctgtgttatcataataaaggtgtcatgatgatacaggtggaggtagaaatatataacttatctcttcataagggctaaaatgagaactaaaagtaatgagaattcagttgaatatgattaattatcaggatatgttaattagttctcttgatgcttactgtgatgcaaagtatgtgacgtattttaaacattttataataattgttcgtatgttaaccattaggcaagatttgtatttctaatgcttttaatgttcttttaaaataatgtttggaaaataaaaatactgaaaatcctaacatttctgaacaccagtttgcaatataatgaatttcctgtctgatcattttaaaactatcagagcatggcaatgatcatttttgcccaatggataacaatgtgttgaaccacagacagagagctctttgccttaagagatgaaataacttgtttgactatatataaatttttttttttttttgtagagacggggtctccctatgttgcccaggttggtctccaactcatgggctcaagcgatcctcccgcctcagccttccaaagtgctgggaatagaggcgttacattttgtatcatatatgctcagactaatcaaggatagttaatgccaaagactatttacaaaactaagtttcttactcagtgaaaagaggctaaatgaacatttgagcaactcatttaaatgaaatttagctggaaaaagaaaaattttgaatttttggtttatcgatcagggtctggatttaagaatcaaaaaacattaacataagcaggaaagcatttaatataggaaactagatgtctacagaatggttagatagggctctatgatgagtctccaggaaagattgcaccataaacatgaccagccggaccagccataaatgctactacttctgctccaacca

SEQ ID NO: 25776 - DNA, 1026 bp, Homo sapiens
gtttagactttacaatgtggtgctttgcaccttgtaaatttctaatataattccaacatccttggttacttccagttttccgtctcacatgtagtcctacacaaggtttttttccaaaggagaatatgtagttaattggccaagaaattgcaagctgggggaaaaattataaatactgggaaataaaggattcttcatagggaacgaaacagggtttgttaatgatttatgggaattatgtgaagggccacattatgcatcaacaataccctccagcctatatttcaagcacatgcagttttttgccgcagtgcttctgctgcaaagacctacccccacttctcttagcctgtctgtccccactccatacccccgacctttcatccagctggcctgtgcttgctaaagctccctttatcctttcccagctccctttccatgttggagtaggttccccccttccatgctctcatagcaccctgcaaccttattaggctgtaattattacatagttagattgatctccaactagattgtcatctctttggtggagagattacgttcttgtgtatcttcagtgcctgacacagaagtgtttctaaaagtaacatctgcacacccctcaaacagaatcacaaggggcgaggccaagaaatctgctctccaagtgataacttaaactttttaacatgctcttcaggtgacacttaaacttgtttgaaaacctctgtgtcataaaactaaatattagctggatgaatgtatttgtatctttttctgtgttggcctttgtgaggagaaatgctgtctatgcaccaaatcagagctgaaaaattctagtgttttgttaaaaaaaaaaaagagagagagagagctgggtttggtggtgcatgcctgtagtcccagctacttgggaagctaagccaggaggactgcttgagcacaggagttcaagtccagcctgggcaacatggtaagaccccattgctaataaatgaataaatttttctctcaaggtgagagata

SEQ ID NO: 25777 - DNA, 1022 bp, Homo sapiens
ccgatcttcttgtgtcaccatgctattatgcatagaaaggtaagtcagcaaagttctgaatttacattggtttggtgactgagaactagatatttattgttttttttctttttgctgacattcttagatgtcagtgtttagataaagttggatggcggggattgtttgtttttaaacatggcttttgctacggccattggaaatgagaattttgctgtgcctccttgctttaggtttaaagcagagaaaatgtgtgactgcttttggacctttgtagatgagtggtgtcagcctgggaatagttagataaaggaaaatacatcttattcttggttgcctcctgggtggggctgggacattttgtgtggccctgaggactctgggttctaaaagttgtgagaacttgatctggattcttacacccattctgttaaagagggagtacccagaagcctttctactggaataggaagaataaaaatttcatttattaggcttttagagttggatgtcttgttacctaattgaaattttttcctccctgatacagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggt

SEQ ID NO: 25778 - DNA, 1019 bp, Homo sapiens
ccaggcgtggcagcgggttgtagctgtagtcccagctacttgggaggctgaggcaagagaatggcatcaacccaggatgtggagcttgcagtgagccaagatcgtgccactgcactccatcctggtgacagagcgagactccatctcaaaaaaaaaaagtatacagataaagacattacttgctataagcagtgaaaagtcacacctcccaatgaccaggaaaatgcaaacttgaaacagtgaggcatttttagctactcctaatttagtgttttcctcccttcacaaaacaaaaatgtgtagtgatgaaaagcagtgtaaggtataactggtagttcacatttaagttttgtgtcattatatgttagcactagcttttttgaaaagcaactaatagccataaaattagctgtaaaattgtttatatctttaaacttactaatcccaatttttgtaatctattctaagaaaatatactgcaggccgggcacagaggcttacgcctgtaatcccagcactttgggaggccaaggcaggaggattgcttgagcccacgagttggagatcagcctgggcaacaaaaaaaaaagtgagacctgtgtctacaaaaaataaaaaaataaaaatggagtatattgaaaatatatactgtaatatgaaaagttacacaaattaagaatatagcatagtactgagaatatgaaagcaatctagtcagtatttatgaaaataaactttggtggctgggtgcggtagctcatgcctgtaatcgcagcactttaggaggctgacgtgggcggatcacgaggtcagaagatcaagaccatcctggctaacacggtgaaaccccatctctactaaaaatacaaaaaaaaaaaaattagccatggtgtcaggtgcctgtagtcccagctacttgggaggatgaggcaggagaatggcatgaacccaagaggcaaagcttgcagtgagccgagactgcgccactgcactccagcctgggtgacagagcgagactc

SEQ ID NO: 25779 - DNA, 1170 bp, Homo sapiens
ttcttatattctgagagtggatattttctagtcccggtggtactcacagactggttataacaactgtttttttttttctttttttttgagacggagtctcgctgttacccaggctggagtgcagtggcacgctctcagctcactgcaagctccgcctcctgggttcacgccattctcctgcctcagccatcccaagtagctgggaccacaggcgcccgccaccatgcctggctaattttttgtatttttagtagagacggggtttcaccatgttagccaggatggtctcgatctcctgacctcgtgatctgcctgtctcagcttcccaaagtgctgggattacagtcgtgagccaccacgcctggcctggttataacaactcttaacagacttcaattaaaatatttacagctgtgattttttttttttaatttcttattattctttaaaaactaacctaaaggagtggaaacaatgaccttgtcattgtttcctaactttaattattataccgcttgcatttaggagcttcttttagaacatttttatggtttctctttttttttttttttttttttttttttgagaccaagtcttgctttgttgtccaggctgtagtgcagtggcacaattatggctcactgcagcctctgcctcctgagctcaagtgatcctcccacctcagcctcctgagtagctgggactatgggtatttgccaccacacggaattactttttttgtgattttgtagaggcaaggttttgccatactgcccaggctggtctcaaactcctgggcccaagcaatctacccgccttggccttataaattatttttatattttcttccatatagaggtttaaacatagctgttatataaacataaccatgatcattaaaactatcatatttttaaagcaacatgtaaaaccaaaaagcagtaataattcgctaaattctgttcgttgatagtatggggaaaaacaatgttatctaaatgagaactgtttaaagaaaccttactgtatttaaaggaaacttcttagaaatagaggaaaatagtatgtttttagctgagaaggctaaatatattctttcctcactttttaaagttagttaattatagacatgtaccctggagtaaaatatctcagaagtagaccctgtca

SEQ ID NO: 25780 - DNA, 1096 bp, Homo sapiens
gttttttgcaccactttttttattgtggtaaaatagacataatgaaaaatttactgttttaaccatttttaagtgtacagttcagtggcattaagtacattcacatccttgcgcaaccatcatcaccatttatctctagaatcctcttcatcatacgaaactgaaactttgtaccctttaacaacagctcctcattttccctcccctcatcctttataaccactgtctactttccatctctgaatttgcccattctaggtaggtcacataagttgaatcataagtcttttttgtgtctggcttatttcatgttacatagtattttcaagttgaatgaatgaatttctgaatcatgttgtgtccttaatctgttacccattcatctgtttgctggatatttgggtttccacctttggctattgtgactaatgctgctctgaacattgatgtttgtataagtacctgtttgagttcctgctttcagttctttagggtatgtacctagaagtggaattgttagaccatgtagtatttctgtgcttaagtttttgaagagctgccagactcttctctgcagcagctgcaccattttacattccagtcagcaaatgcacaagggttccgtgttctcgccacctgttttgtttgtttgcttgcttttttaaagtatagccatcttagtgggtatgaagaggtatcttgtgattttggtttgcatttccctaatgattactgatatttcaagaatctttattagccattcgtatttcttgtttggagaaatatctactcatgtcattcattacccagccctctgctgcctttcactctgtcgtccaggctgcttactgcagcctcaatctccggggctcaagagatcctcccacctcagcctcctgagtagctgggactacaggtgtgcaacaccacacccagctaatttttaaatattttctagagacaggggtctccatatgttgcccagactggtcttgaactcctgagctcaagggatcctcccgccttggcctccaaaagtgctagaattacaggcatgagccactttacccagcccatttctgaattagattgtttt

SEQ ID NO: 25781 - DNA, 1062 bp, Homo sapiens
cagcattctttgctgtcaaatattttatcagaattgtcttttgtacttttgtgtcttcatcacatcttatttttcactttttcctgttaaaaagatacaaagaaagagtaatcatttcaaggaaaaactgccttgtttggggcatatggtgctgtagaaagttagacaatagtaatatggataatttcattaaaaagaagaagcacttaattaatgagaaaacttgaattgtgatgtttaaatattagtcagtgagtattcttaagtcagtatttctttcagttttctagtagtgtggatgaaatgcaaatacagagaaaatgatataggaaaaataaaatcttcataaagaggctattttgagttgtggatattgtagtatttattaagtgaaaaaacgaaaaagctttaagtgaaatacagatattgtctgtccatactgtcaatatgtaaaggcagaaagggcctccaatataacactacgatgctttaattttagtcgactttatgtactacaaggtggccttgcccagcaagaatggagagtgcctgaactattgcacagactactgaagtacttggaacccaaactcacccaggtttacaaaaatgtcagagaaagaataggaaggtaggtactgttttctctgtggtgtacctctcgagttctttgtttgtttttttttaaattgtaataggtaataatacatgctggttatgttgtcagtgggtttcatggtgtctttctcaaattgtttgctattgtgtcgtgggaaacaagatgaaacactctgaatgtaaactaggacagcagtgtgctcagaagccagagatgagcagtcacaacacctaagtgttaataccccttaattataaggcttcttttacacacaggcataatctaagacccactccaggaattgtcttgggacagtttactttgattgggtcataacttttgaacctcatttttatttataatgtggcacctcttcctattattaagtattttattttgcagtgtgctgacctacatattcatgatagatgtatctttgccaa

SEQ ID NO: 25782 - DNA, 1093 bp, Homo sapiens
tttctcactgttaacttgaactgcgatagtcacatttgagtttgagtcacctatcagttttagtttgattttcttctcctgtacagtcagccctccatatccatgagttccacatctgtggtttcagccaacctgaggagatggagaatatttcagaagggggtggggggatggttgtgtctatagtgaacctgttcagattttttttttcttgtcattattccctaaacaatacagtataacagctatttacatagcatttacattgtattaggtattacaaatactctagagaagatttaaagtgtacaggaggatgtgcataggttatatgtaaatactacaccattttcataacagacttgaacatctgtggattttggtatcctaagggagttctggaaccaatccaccacagataccaagggacgactatacttatatatgttttcagtatttctaaaataattgaatatggctgggtgcactagctctcaactttaatcgcagaactttgggaggccgaggcaggaagatagcttggggccaggagttggagaccagcctgggcaacgtagggagactctgtctctacaaaaaataaaaaattagccaggcatagtggcgcatgcctgtggtcccagctacttgagagaccgaggcgggtggattacttgagcctgggaggcaatcataccacttcactccagcctgggcaacagagttagacctagcctcaaaaataaaattaaattaaataactgagtatgatttgtttacagaattgtaggttctctgttgaactgttacatcatattttaaacacaggaaagcagagatccccggaaacttcactggctttttgaactgctgttggaatcaccattgagtggtgaaggaggatcctttgtagatgcatggtaaatttttttaaaaaacctatgaggttaacacgaaaggttttgtgttaacttatgtataaatggaaatgaatggtctatacttgtaaagtctagatgaagtaattactttcttctggaaggtgatgtgatctggttccatataacatgtgatacttaataagagttattta

SEQ ID NO: 25783 - DNA, 1026 bp, Homo sapiens
ttatgggatctccgtaaatgcatgttggtagatttcagttaaaactccttaaacttcatttaatttacttcactttgaaagttgacttggctgggagccatggcacatgcctgtaatcccaacactttggaagtctgaggcaggtagatcacttgagcccaggagtttgagaccatcctgagcaacatggcaaaaccttgtctctacaaaaaatacaaaaatcagctgggcgtagtggtgcacacctgtagtcccagctacttgggaggctaaggtgggaaaattacccgacccgaggaaggcaagactgcaatgagccatgatcgcaccactgcactccagcctggatgacagagtgagaccctgtcccaaaaaaagaaaagaaaaaaaagaaagttgagaaagggtttttaagtttatgtacttggtccttgagttaatggtattgtaactttttctgattctgaacagtttgccttttaacttctggtgttaggtaaatatggaagtgatttgttggggcttgacttatagttttggggattttaacaaattgcacaccaggtgttacagtggctttcagtcttcatttcccaagcagaacatttgttgatttttaattcacagtgtgagaaataggattcaaacttgagaatctgaaggaaaacttcctgttttagcatttttagagggaggtacttggttttagaaatcactgtagtctatgagaactaagaattcatggaaacaaaaatacagcctgcttttgactatcaaaatcttgtaattttaactttttcagaatcatgtatttaagtggattttaaacgctgaatattgttctttttttaactttataggcagaacagattatatttgatcatttttctgatcctaaatttgttgagcagttaattacttttctatcattagaagacagaaaaggaaaagataagtttaatccacgacgtttttgcctctttaaggtaactatattgtttacatatcctctttgtaatgcttagt

SEQ ID NO: 25784 - DNA, 1026 bp, Homo sapiens
gaataatacgtatttttagggttctttttagttacatgtatctgtgggggataatgattgtataaagtaaaattaagaataaatgaacaggtctttgcctttgaattgccaaaagagggagttttccgtcttcctttgacttttgcaagttcttaatagaattgtatttaatttataactagcattaccttcagctgaaactttattttggcaaagtatagctttttacatttatttcctatgtgtaacatttttacttttttttaacagatggttaatttcataaagtaccataaaataaaatagcctttaaaatttctaaaatgcttattttaatataggttagtaattgttcaaatcttctaaatctaaattgatttgaaaaaactaatacagtaattccaataaatggtcccattgttctgtgatacgaattcatactgcctggtgtgaagaatgaatatctgtagcatgatttatggtgattatcagcagatcaatttgaaactagtagagaaagagaattaacttagcacattagttgctccataggaaatgggaaaatatactaggtcagggagaaaatgaaacacataattgtcatgaatattttagtgtaatgtctaagatgtctgaggaaaatatctattgttaataacagtttggctgtggtattaggagacaggagacattatgcattttctgaaataccagaccagtttttagacgcacatagcaattcataagattttttttttttttttttttgagacagagtctcgccctattgcccaggctgtagtggtgggatctcagctcactgcgacctccacctcctgggttcaagcaattgtccttcctcagcctcctgagtagctgggattacaggcatccgcccccacacgcagctaatttttgtattttaattttttttgaggtggagttttgcttttgtcacccaggctagagtacaatggcactatcttggctcactgcaacctctgccttccgggttcaagcgattat

SEQ ID NO: 25785 - DNA, 1030 bp, Homo sapiens
atattgatgtggtaactgttgacaacatggctcatttttgcaaaaaaatggtaacaaaaatgccttagaagcatagaaccatcttttcagttttatcctgtcatctgtttttgttgtttttaagttgtccagttaaaatggctttcatgtaatggaaaattatgtgctagaaatttttttagactggaatttgaaactcattttcattaattattaggaataattaattggtaacttttaattctatctagttatgctgtgcagttctttgtaataagataataagaactgttatttttaaaatcttttctcaagaagctagagagcaaccatgaatgtctatgcggcaaagtagaacctacttagaactttttgcttctgtgtccccagaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaaggtaagtggttagtgggagtctcagccacagctaggtttttcttttggtctgttcagctcgattctcttttctcctctgtggcttctgttttgcttcttcgatgcttattcctgttcctagaggagaagcaggacattttaatgtaatgattggtaacttgataaaggtttattggagagaaaaaaattgaaatgaaatgggtaacatacatcttttggattcttcacacattttagttaccaaaattatatgcttatgaattaagatctggccttcctttttagatcgaaatgttgagtgtcactaaggattgagaatatggcagtgaaagtggtttttggatttcttttatttcttagaatcagtggtagaga

SEQ ID NO: 25786 - DNA, 1100 bp, Homo sapiens
gaactactgcacccaactggggcatttattttagtattgtgaaaatgtgtgttagtttggacatttgtagactgtgttacatgctatgacatatattctcctcctcccccagccttttggtcagttatatatattgctgttgtagagcttttagccaataatcagatacatgaaaaccttctttttttattagatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaagtaagtatgttcatatcttgacaaattctaaaaatacggtaggaaatacagataaagaaactagtaaaacaataacaactagaaaaatcattttgcaagttcagccattattgtacttcaagtttattatacttgaagtgtgttaaggctaaaacggttgtaagattgaaagtaaagagatgacacccaaataagatgagggctttaagaaattaagagaaagaaaaaattgtcagaaggggtaataacaggaaaacagataaaaggagaagggcagggaaaaggaggtagaaaattgaaaacaattgttaaataagaatggacagtacttagtaatgaagcagaagtttaatctgtgagatcatatttcttaaataaattaggaaaggaatattcagacaagaaatacccctttgttttattaagtttataacttcagtattgttttttctagttaacgtagttatcagtaagaataatagattataaaaaagacaaagcatagctggcattgaaccactttaaaatcacttgctattcataacaacatttttcttctttagactttggtttgatgaattaattggcctttgggtttcagtgcaaaatctcccacaatgggagggggtaagtatccctttttccctttcttcccccctatagttttttttttcttttttcccccccatacttttttaatttggagataaatattaatagatcatttggtaagtaacttgaagttccttaggattgg

SEQ ID NO: 25787 - DNA, 1056 bp, Homo sapiens
atagtgtagtggcactatcgtggctcactgcaacctccacctccacctccctggttcaaacgattctcctgcctcagcctcctgagtagctgggattacagttgtgcgctgccacgcctggctaatttttgtatttttagtagagacggggtttcaccattttggcaaggctggtctcgaacccaggtgatctgtgtgcctcggcctcccaaagtgcgggattacaggctgagccaccgccccagccttctttttgacttttttcttcatttttagtagttcagtccatttagaaacttgcaggtctgtttaacatctctgaagaaaggttatttctatatttttaaatacttggccatgtgatagaggctttcctgtacagacaatttaaagtactagaactgtctggtcaagagaggttgtgtgatgtaacacatcacaagggaaatttttaataagggaagaaacaaatcagagaagttgaaacaaattagagaaagtaggaacaaattaatggtctttggacaatggcagacagctcatggacactgtgagtgaaatattggtagataacttgtatggcccatgtagagaatgaagggagttgaagaaaggtattcttaaaacttgattttgttatgcctgtaatcccagcactttgggaggccgaggcagacggatcacgaggtcaggagttcgagaccagcctgaccaacatggtgaaaccccatctctactaaaattaagaaaattagcctggcatggtggtgcacgcctttaatcccagctactcaggaggctgaggcaggagaatcgcttgaatctgggaggtggaggttgcagtgagccaagcgccactccagcctcggcaaaagagcgagactccatcttaaaaacaacaacaaagaaaaaaaccccaaaaaacttgattttgccctcttgcctttctggacctttcatgaggggctgcgggtgctcgttagaacacctcaggttatctgtacgtgaggtgtatctggccttgcctccaacattattatctttttttttttttgg

SEQ ID NO: 25788 - DNA, 1633 bp, Homo sapiens
attatagcttagaattaggcagctttaaggatttcatttattgtattagctgaataacatacaagtagttcttggaagatggtattttaagcagcagcaaacaaaactgatatttacattgactttttcattttcagaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaatatgctttggtattttcatttcatgaaattgcagcagattaaaaatgcacacagtgggtaaactgcttcaaccagcgaatggtagcttgtgcttttagaagggtttttttcagctgatggtgcagctgtttgtttgtttactgtggaaacaaaagtcaacaaatgtgtttacataatcaaattttatttgacacataaaatgtttaagtgatgtgttttatactttgaaaataaattcatgcaccaatgttttaactcacatatatcatacagtgcaggatttatgaacatacataaaatcaaaatcataccatataaacgtttacaaataagtttttcatgacacacggacactattgctctttaaatatggttgtacatgtcatcattaatcgattcattgttcttccacatggttatttcaatgcaagatccgatcagcatgaagagtctagtacaagataggcagacatggttatcactctg

SEQ ID NO: 25789 - DNA, 1094 bp, Homo sapiens
tttgccatggaatcgtgtagaatttgttaagtccaaaatgagagcagcctgtttgcttctttaaagtgtttattgaccttattcctgccatgttacaaatccatcatttgtggtggattcccattaataatggttactctctaggttagttcttgctgccacccctttctctcctggtggtgtgttccctgaatacacttaaccactatttctgttttgggccgccgaagtattcagttttctcaacatagctgcaacatttaaaaattatatgatagcacacaaaagtgtacatttctggcaacactggcctggaatatttgcatggccacagcgtatggagcagggttgtaagtgcccctttgagaggaagaatgcatatcactgtgtgcctcagttctctcccagcctctcacatacatgtatgtcacctgcctggccctaaggacatttgagacctccctgtgttcttctctttgtcttgggatagcctggcttttaggaagtgttctcaaagaggcaagtgacatttgagcccctacagtggctcaggtgtgaagtcttgggcttttcccctgtggacttggagtgaagccttgtcagtgactgtaatgaccaaatgaggagttattttagcttgtgtttgttactatcttctgtcatgttaagggcatcttcgttgctagagtaatttcttctaaaatatggaaggtcaacacttttccctttagacttgtggatagtgatggataaaaataactctcttactctatagtaaacttgctcaagtgcaaaagttatatttagcttcagcaataggagtctataaaactgtgagagaaaagccttactaactgaagtcatccttcaaacctttctaccaggggttccaatagcaattgctaagaatacggcagcttaaaaaaattttttttcaattgacagatattaagaatgcctgatatttactgacttgaacattagttaaattcagttagggtgaccagagtgttgctatttgtagaactgttgcttggtagagtcatccaaagtgtcttcctaagctgtaataaatatgcttactaatgtttgac

SEQ ID NO: 25790 - DNA, 1090 bp, Homo sapiens
gagcccaggaggtggaggatgcagtgagccataatcataccactgcattccagccacggcaacagagtgagaccctgtctgtttaaaaaaaaaaaaaaaattattaaaatcttaatcttaagttccttaatagtggactgtattactttttgccttttagccacaaaaactggtagggaaagttatattctgtcaccctaaagcaagcaaaaaatgtttttccaattcccattctttttttactttttcaacataaggaaaaatgtatttaccttgtttaaacggatttattttaatgccttacagtcagattttaaatttatgggaagtttgctaatagctccagtctctccagttgagatgaatgttttttcttatttaaataacaatgagttttttaaaatttataggaagtagctttttattggaattacattgattttatatgattcatagctaggaaaatggaaaccatcttaatttcaggaaaatgtagtagaaattactctcatttctaaatttttgtcatttagaaaagacatttttatcaagctctgtgtttacaaaataatagtttttaaacaacaatttgaaagaagtatctctataactcattgtcttcataaatgcaaaatctgttgtgtgccctcaaatttatatctacatttttagattctgggtcacaattatcactagctcttttttttttttttttttttttggagatagagtctcgctgtgtcacccaggctggagggcggtggtgcgatcttaggctcactgcaacctttgccttccaggttcaagtgattctcctgcttcagcctcccaagtagctgggactacaggtgtccgccaccacgcccagctaatttttgtatttttagaagagatggggttttgccaagttggccagactggtctcgaactcctgacctcaggtgatctgcctgccttggcctcccagagtgctgggattacaggtgtgagccaccatgcccagcctacaattatgactatttccatgtgaaaccatcttcctcagaaattgaaattttagagccgctcttgctagcatgtgaaacctttt

SEQ ID NO: 25791 - DNA, 1019 bp, Homo sapiens
ctgaggtcacgccattgcattccagcctgggcaacaagagtgaaactctgtctcaaaaaaaaattatatatatatatagtaatactttcggaaatcataaagattaaaaggaaaggaaattaatcggaattttgactataagcataaagatcgtctaatgcattatcagatttattcattctgactttgctttacagtctagcacttatgtacatgaaagctatttcatatcttggactctttcttattctagataagatttaatattctgaaacacttcaactaatcttcaactggtaatcattggaagtttttctttagtttttggatctcgctacataagcagctgttaagagtctcaccttgcaaataaactctcccaaagttctgactgacgaaacaggcactaaaccacagttgtgtaatttaagcctgaagcactggacctgtagtgcttttctttttcatagaacttgtcatttgtgttgtatatgctctttcctgtgactctgcagaaaacaggcagacttgtttccaatctaagcctgggcagaaatgtagtggtggtaattctcataatttttcatttttcatttccaagagaaatgttctagtttatatttatcacacatgccaaggatatagtagtaataaggtgactgggcctttagactcagaaaaacaatttctgaactggtcagaataggtttaagtgcttaaagtgctttttaaaaaaaaaaaacaaaaacattttagcctttataacctagtagttgatacgttattttcagctgtttgcgtctctgggcttacaggtatgagccactgcgcccagccgcatctcttatttttatttatgacttggaacttaagttacttcctaataacatcaagggtaaataatgtagtttccttttattacttacctctttcgtatagagtggttgcatttagtgactaaatctgtagtggtgttttaaaatgatctgatgttagtctgtaaataaaaagattacggt

SEQ ID NO: 25792 - DNA, 1098 bp, Homo sapiens
attttgttcctagtatgttaaatgttttatcttgaaagggtgttggagtttgtgagatgctttttctgcatctgttgggatgatcatgtggtttttgtccttatcctattaatatgatttattgtgttgattgattttcgtatgtttaatcaatcttgtatttctgagataaaggccacttggccatggtgtataatcttttttatatgttgctcgatccagtttgcttgtattttgttggggattattgcatctatattcataagggatatttatctgtagttttcctttcttgtgatgtctttgtctgattttggtatcaggattgaacaaacttctaagttaactaataaatctaaattaactaataattctcttgttgaccattagaagcaacagtatttttctcagaaaaacactatatttctcagaagggattttaataaagttctatacattcctcctattgagaatcatttatcctgtataaacaatctttcaaaatttttttattaaaaccaatttgaggaatctgtaagggactagaaattttgttggcaaatgtcaattaagtcagccacactgtttggtatcaactaatatttttttcattcttgcagcttcactaacaatcttttcagcttctttacggaaaaagatggaaattcttctgtactttgcacagtggggttggtggcagtgtagattgcctctcaggtgttcctattctaggatatattcatattatcttatgtgtgactatcagtgcctagttgtctcatttctcttggctgttcttccctttttgttttcctccagggctctaaagggtctgatggctccaccagagcattcctagtacttgtttcagtatgtctgtcatgatacctgctttgagctactctcatgtagctgcttacatatttttattcagtatgtgtgggcttacgtatgtaattttcagagcttttccatttattgaaaagaccgtgttcctaggaaccatatgacaagaggaaaggaagtggtaggttagggcttactatcattgagtactgctgggccttatacatgactattctggtatcattaactttg

SEQ ID NO: 25793 - DNA, 1047 bp, Homo sapiens
gattctcgtgcctcagcctcccgagtagctgggattacaggtgtgggccaccgtgcctggctaatttttgtatttttagtagagacagggtttcaccatgttggctaagctggtccagaactcctgaccttaagtgatctgcccaccttggcctcccaaagtgctgggattaaaggcatgaaccagcgcacctggccgcatatgtgtatttttaagaatgtaatagtgttttatgaaattggaatcatactctatatattgtttataagcttttaaaaactttagtaatgtcttatataatgcaaacatttccatgtctttaaatattttgctgctgattttttgtacttagtgttccttagtatgggtatagtttaaccagtcactttgctattgttggacccttagattgttcctttgttattgataaataatgctattaacctctttatatttaaatatgtcttacatatccctgaattattttccataaatcaatttgaaataaaaacctaggttagtgggtatgagcatttataagggtttgtataaaaattggccaccagaaaagttgtactaatttttacccttttatcagaagaagaaaacacccatttctctactttcaccaacaattcatattgcttattttttgatagataatatttttacattatacaaaatgcagaaagtacagtgacagtcacacttcttcctctctctctgttgtccagctgcctagtgctgtttcctagagttatctactatgactcgttccttaaatattcttctggacattctgtactaggtattttttaaaagccctttaccagtttgataggtgcaagtagtacttgcttttttgatctttgattattagtgaatgtgaacatgttggcagtttgtatttcttctgtgatttttgcttgttcatactctttgcccatttttaaatgtaggtgttcatttttttccctgattttatgagagttctttacatataaaggatgtaaactcttgtgttatagttttccctcagttttctaa

SEQ ID NO: 25794 - DNA, 1086 bp, Homo sapiens
aagcaattgatcaatgcaatatttctgctaattacaaggtatttactgggtgacgatttaccttgtttcaggagaactaacttgaggggctgatacagtaagaaggattgcaccagttgcacttgtacataaatacatccttcagaagatgaagcacatctcgtgctttgaggaagcctagccaaaaaataataataattataaagcacaaagacttgggaattagatgttttgaccctctggcctcctagttctgtgacttagggcaagttgtttcttcttttttctttccctctccctccttcacaacatttttaggtgggtactcttattatccttattttacaagtttcattaggcacagaaaggctaagagttacagttgtaagtgatggatttgtgatttggacttaggcaattcaatttcatgatctgtgattgctttattaggagtctgaactgtattcttgaagtcccagaagatagttaactattctggatttttttaaagagcttttagaaatgtagtacttgttttatgggtaactggatcgaatcccattttacaaaatgaagatttttctttttttcttaaacataatgaatctttgaaataccaatttgaaaacttttttacttagaaaaattccaggaatatagtttttattataaaagattattgcactaggtaggaataagagtacagtacattaaaaaaatactttaaaattatggcacaaatttagatgtagtttgttttcccactaactttaacagtaatatatgtttctagttcactttccagatagactagcctctgaattagtggcttttaactatattgtctagataaaaaagacaaccattttgttaagaattggttaactgttatttagatggagcagctgcgtaattatttggttctgctctttgaccctcaaatttcagttttatacaagctaataattcattattttagctgaagggaactttccttcattttacaaatgagaaactgtaatttaagatcacatagcaagtaatcttttaaatatgtgtacacatatatatgcactttatttaaaa

SEQ ID NO: 25795 - DNA, 1035 bp, Homo sapiens
gattttctcagactaatgccatcatcatcctttttaaccccaaaggaggagttgataatttcatatttaagctattgatatttatgtttcttggaatgatgatcattgatttttaagttgctttcatcacgtgtttccataatattctgttcttacctcttcatagtatatatcattctatataaggtaatggtatggttactgatttctttcctccaccagacagtgtactccttgaggaaaggtgctgtgacctttttctttgaggaaaaggactgtatgcattgtgtctgcattgcagtgccttagatgtgataggcactcagtttgttgaatgagaaagatgctgatcttcatattctgtatagttctagaattactataatatcttctctcaataaaaatcccaaatcttacgaaagcatttatttatttatgtatacaaggtaacaattccaaacagtactacaagaatacacagaaaagtaactctttctacctgttacccagatttccacaaattgtcttctgtagatccaccctctgttagtagtttcttgagtatctgtttagagataatctgtggataaatatttatttatacatgtatatccttttcactttattttccacaaaaatagatgcagaggactctggggatgtaccatattttatttaatcagtcccttattgatggttatttaggttgatacttagttttttctcttacaaatactatttctgtgaacactcttgtatacacttctttgggaatacatgccattatatatgttgtaggataaatctgtgcaagtagaattactgcttcaaaggatatttgcatttaaaatgttggtagctaatgccaaagtgtcattcaaagaatggttccaacctttattcccaccaacctgttaaggtaccttttcccttatatctttaccaacacagtatattagtgaactaatacattgtttagcaaattgttcttttaaatttgagtcatttttcataggcttaggtgtcaaatttttt

SEQ ID NO: 25796 - DNA, 1047 bp, Homo sapiens
atgctttttagtaatattttgatgttgacggactcctcacccccatactactcaaaacactaattgccatattaaaggtcttagaagatgaggagtaactcaatcttttcctttttctttatgaaaaagacatacttgagggaaactgaggtaagagaaaaatatgaaatatatttttaaacaggaattttttttttttttttttgagatagtctcccccttgtcaccaggctggagtgcaatgacgcaatcttggctcactgcaacctccgcctcccaggttcaagtgattctcctgcctcagcctcccgagtagctgggattacaggcgcctgccaccacgcctggctaatttttgtatttttagtagagacgggattttaccatgttggccaggctggtggtcttgaactcctgacctccagtgatccacccaccttggcctcccaaagtgttgggattacaggcatgagccactgcgcctggccacaggaagtttaatgattgacaaaagcatactaatcttgtattggtatgggaacaaagaaaatagttctgtctttgaacattagggattcagggggtgacagcactctcttggaatcttgtgtgttggaatgctgaggttggaaggcaatggggaaagaatattgcctgttctacagagttccctaattccatattgatgatacctattgggaaactttagtttttttagtaagtgtaagaacattgtgattatggttgtggatagttaaccattttcaatgtgtctggatttcttaatgcattcaagagtttgttcattaattcaacccattattgattacctaccaagagacaggatctattctaagctttgagggtatagcaataagcaagacacatgctcccccttgggagagtacagataataagcacataaataaagaacccagaatagtggtgttatgaggaaaataaacaggataatggcatagagaatgatggggatttatgggggcttttttaggttaggtgacactaagacaggcttagaaggtgaga

SEQ ID NO: 25797 - DNA, 1056 bp, Homo sapiens
gtatgtctctaatgatcaatgatgtggagcacattttcatatgcctggttgccatttgtatgtcttcttttgagaaatgtctattcaaatcttttgccttttctttttttgacagagtttccctcttgttgcccaggctggaatgcaatggcgtgatctcggctcaccacaacctccgcctcccaggtccaagtgattctcctaccttaaactccctagtagctgggattacaagcatgcaccaccatgcccagctaattttgtatttttagaagagatggggtttcatcatgttggtcaggctggtctctaactcctgaccttaggtgatccacctgccttggcctcccaaagtgttgggattacaggtgtgaaccacctcacctggccatcttttgcccatttttaatcagattattagatttttttcctatggagttgtttgagctccttatgtattctggttatgaactccttgttaggtgggtagtttgcaaatattttctcccattctgtgggttgtctcttcacttcgttgattgtatcctttctgtgcagaagctttttaccttgatgtgatcccatttgtccatttttttcttcaattgcctgtgcttatggggtattatgcaagaaatttttgccgagaccaatgtcctggagaatttccccaatgttttcttgtatggtttcatagtttgaggtcttagatttaaatatttaatccattttgatttggttttttctatgacaagagataggggcctagtttcatttttctgcatatggatatccagttttcccagcaccatttactgaagagactgtcttttccccagtatatgttcttgtcacctttgtcaaaagtgagttcactttaggtatgtgcatttgtttctgggttctctattctgttccattggactgtgcatctgtttttattccattaccgtgctgttttggttactatagctctgtagtagaatttgaagttagataatgtgattcctccagttttgttctttttgcttaggatggtttttggctattctgggt

SEQ ID NO: 25798 - DNA, 1080 bp, Homo sapiens
tgtattcttcaatccctctgaaatcctcatgtgcagaatttagaaaccatacattatttataacttttctatttttattttttgacttatttaaaaatgtttatttttgcatgggtaatgcatatataagattaacaaaaaataaatgaataaataaaccagtaaaggagattgtacaatggaaagtctggaccttctcatctcagattctacttctcctgtccttctctgcaggcacccaccgtttctgttttcttctgttatccttccagagattttctatgcctaaacaccatttgaagccatgaatgtatagtgatgaggggttttttacagttgcacatgactgggaatagaaatgcaattagatattgagaatattgatgagccaataggagctgatgggttagaaaaataaggaggtgaagagaatccaggattttaaggtttaagtgaagttagagactagatttggagcgagtaagagaagatacagaattctatttaaaagattcagaactgggaaaattagaactagcattagttttaactgaaatcatataatgcatgtgttcataccaagtagaacaaaaatggcctttttttctctcatatttaaactccacattatctactgtaatgttccacaaagagcacatgtttagtaaatattgcctttagtgtccaattatgtttgagcttgctgtagagtttagatttctaattgctaatcatgtttcatttttaaaataatctataatgttatttgcaagaatttcaatccatagcctcctagaaaaaaaatcaataccataggcagaaaaataatatttcaggtaatagagcatatcactgcatacaaatccattcttacttcaatcaaaaaagaatatgatgcctttattgagacaataaagaaagaccgaagaactacattttgtcttcatggaaaacttaaaggtttggcagcagagcctacagctttggtatattacaggaaaagaacaatccaacttgaagcaaagtaagtattttagtaactagcccaaaagatggtagttgttgcttgattataataac

SEQ ID NO: 25799 - DNA, 1050 bp, Homo sapiens
aaaaaaatgggatgcacaactgaatatagagtttaatttcaagttttgtaatgtttggaaggaaatattccaaaatattaaatagatatttatttcattaattttgtctggtttatattttccgaattttataccaggagtatgcttctgtaattagggaaaaagttacgatgttgccttgccagccattattaagcaagccaagagttctgtttgaagttaatgtgactaaatcttaggcaccaacttctgtatccaacttcagttggacaattttttttttttcagtaaaaactctttctctttttttttttttgaaatggagtctcgctcagttgcccaggctggagtgcagtggtgcgatcttggctcactgcaacctccgcctcccgggttcacgccactctcctgcctcagcctcctgagtagctgggactacaggcgcccgccaccacacccggctaatttttttgtacttttagtagagacggggttttaccatgttagccagatggtctcgatctcctgacctcgtgaaccgcccgcctcggcctcccaaaatgctgggactacaggcgtgagctaccgctcccggcctttcagtaaaaattctttattcattccttcatcacgtgacagttggccttgagtacttacaaagacagcagttcctgcctctcagaaatctaagcagacattccagagctcacagatcagtgccccaccaactgctacctggaagcttcagggagatggggagcctggaggaggggatgctgcaggaaccccctggcacgcagtggggctgggcttcgaaggcatccaggactgaattcgaggtggcagggggcaagcaggcaggcagcgtgacggtcatgaggtgcggggtgagggcaggaagcccacagcattcctgacttggggtcaggggagacagattggaggggcccgagatgaagccagagcttacagagaggctgtaagccagcactcagcttcccgggagaccccaaccactgccgggtccagagtgccctgggagaatgtcag

SEQ ID NO: 25800 - DNA, 1031 bp, Homo sapiens
taagtagctgggattataggtgtgagcccctgcgcccagctaatttttatattctttaatagagactgggttttgccatgttggccagactgatctcaaactcctaacctcaagtgatccacctgcctcggctttccaaagtgctgggattacaggcatgagccgctgtgcctggactattttttttcttgtgtgttgtctgtttctacatgaatgtaacctttgtgagattagggactttgttttgttcaatactgtgtctccattgtctagaataatggcagacaaacaataggtgtcccccaaatattgaataaataaatgtagcacaacttaagcattgccctagattttgttttactagatgttttccctaatgtttccttgcccccttccgtaggctgatgagatgcccctctggccttctgtagcctattgtgcttacctctgtcacactgccttttctgctttgtagcagtggctcatttactagacctggaacacttgactgggaacccttgtgacttgtcaacacatccctaaatgtctaatatgaatgaatgaatgaatgaatggtaatcttggttggtttatgtaactcaatggcattttgtagatgttaaggaacaatccctttagctgtgttctggtttgagagcaccacaagtccaatgtcttatgaatagactagattattgttcagtgattattgattattcagcaaacatatgtttgagtactgctctgctagaaactgcattatgcacttgaatgcatatggtagaggagggatgatggggaaagagaacattttgtttcctgatcttgtcacgcttacagcctaacagatgagacagaatataaacaggaagtctctaaggcagtgtggtggaaggataataccatgatggaggaagtgcacagtattatgggagaacatagcagtggcatctgaccaattttaagggaatccaggacagctttcctgaagctgaagaaagagtaaaagccaggtgaatcaaagtgatagt

SEQ ID NO: 25801 - DNA, 1032 bp, Homo sapiens
agacctgttgactatataaccatctgaaatctgttcatctttcatgcccataatctcagctcaggccatttcttattgctattgaaacccctaaattgtctgtagttgatgggttccctttgcctgagatgtatgttggttttacccattcaagtcctgagtaccatcctgtcctcagcaaaaagtttatgtctacctttgaaataggagatttaggttattttgttacaaatcaagtcttattcacagcaaacttcatttttgagggggttcccctggtatttagtcccatcatttaacttgacaagaccataaaatttttaagaatttcagtgtaatttcctggttaacaccacataatgtagtatttagtaggtacttatcatttattgaatatactaaccttaaattatcttttttaaggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaacgtgttgtttgtttgaaggtagaaatgcactactactggccaaaaagtatctaagttgttttaccatgtgttcatatgcatttgcacaaactgtcaaagtgctcagaaataggaaaccttatttaaggatgcctccaactagaaatccttgaatggaaagactggcaatatggtaaaagtgaattgttatttatacatcaccgatttctttcaagtgtatgctttagttaagaggcttatcaagtgaaccagctttccctgaattgagctccgaaggaagataggctaccccagtcctgcttgaaactaaactgtcttttactgttaacagtacaaataagtaatcattcctttatagggatccatcctgaacaaacattaaattcccaagcgttgtacaacagacag

SEQ ID NO: 25802 - DNA, 1047 bp, Homo sapiens
ttttgtatttttagtagagacggggttttgccatgttggccaggctggtgtcgaacccttgacctcaagtgatctgcccatcttgacctcccaaagtgctaggattacaggtgtgagccaccgcgcctggctgaaaattgtgttaacttttaattctagctcattcttagtttgatttaatgagtctacaatttttttattaattatgtttatataacttcctttgctaggttgtgataatattgctgataataattaaataatagtcccatttacgagcacctagcatgtttccagtactgtgctgagcaccttatatgttttgtcttttttatcttgacaacaacatcataaggtaggtattaatagttgcacttacaaataaggaagccgatacttcttcgagttaagcagctttcccacagtatatagccagtaagtagcatagccaggatttaaacccaaggtcaatggactcaaatcgtgagctactgcctactaaattgcctctctgtggctcagggagttgtgcaactctgatttgctaatgtgagggtggctgcctgtacaacaattggtctgttctgtctctaaaatagatatatcagttgatacatttatgaaagtagttatgttctagaattatggagactttagtttgaaatttttacatggaaaaaaacccataagaatctcactggcattttatcacttttcattgtgaaatgatgatctgtgttctgattaagattaatggaaggaataaaattattttaaagaattattgatggtttctgataatgtcgcatatattctttggtattaaggaagtacatgtttgaatccttgatgttcttgaatttctgtttccacagtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgc

SEQ ID NO: 25803 - DNA, 1051 bp, Homo sapiens
tttactagtgaattatgttctaggaattacttttttagtttgaagccttttgtggtaggaatacaacttccccacagttttcttgaaaattaatgactaaatgcctattctatgatgagccactcaaaaattatctctgattgtctgtcattctcattcttatagaaatacctggtgcatgctgttcttatagtggctgctctgtattttgtgtctctcttatctttaagcttttcttatattttctttcttctttctaccttccaactaaatacagagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgcttta

SEQ ID NO: 25804 - DNA, 1197 bp, Homo sapiens
tttaatgacctcacagtaagtgtacacagtggtcttcagtaaatgacctcacagtaagtgtacacagtggtcttcagtaaatacttgtcagaattaaaagtaagacatgttctagcaccctttttttgttccccttttcttggtagtttttggaagagataaaccatagttagtttttcctcaattacagcttttaattattttcttttcaaattagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatc

SEQ ID NO: 25805 - DNA, 1033 bp, Homo sapiens
ccaagaaaagaggaaggatccaattttgaaaaatgttatcattctgcatttcaaaaatgttagtgacctaatttttttcttttaatgtttatgggtgctatagtaaaggacagggacaaggattttagaaaaaagacgtaaagctcaaggagtttgaattttagagaagacaagagtaaacagtacgagtttgaggtgataattaccgtaatgtaatatacattggtgcattgaagaagtattttcttaagtttactggtagtattaggaaagccctctgacaaggtaatatttgaaatgagagcaaagatgttgagaaaacaccctattcaaggaacatgaagtgtggttgggccaggggtggtggtgggtggatcatttgaggtgaggcgttcaagaccagtctggctacatggtaaaacgttgtctctgccaaaagaaaaatacaaaaaaatagctgggcatagtggcttgcgcttgtagtcccagctacgcaggaggctgagacaggagaacggtttgaacctgggagatggaggttgcagtgagctgagatggctccactgcactctagcctgggcgacagagcaagacttcatctcaaaaaaaaaaaaaaaaaaaagtgtggttgaaacgtaggattcatggggatgagtggcaaggtattagactggagagtttacatgaattgagttatgaaggactggatttgccactttaagatagagttcagatttcaggccagacatggtggctcacacctgtaatctcagcacttgggaggccggaacagtggatcacctgaggtcaggagttccagaccagcctggctgacatagtgaaaccctgtctctactaaaaatacaaaaattagccgggtgtggtagtgggcatctgtaatcccagctactcgggaagttgaggcaggagaattgctggaacccaggaggcggaggttgcagtgagccaagattgtgccactgcactccagcctgggtgacagagcaagactccatctcaaaaaaaagaaaaa

SEQ ID NO: 25806 - DNA, 1042 bp, Homo sapiens
atcagaacaatatttggaattattatttatgattcaaccctattagatagttatagagagctgtacttggaacacttggtaattgtgataaacttgttatggcttttcctttagaattttgggtttgaagggacttcagaagtcatctgcccttttttgtttgtttgtttgcttgttttttttttttgtttttgtttttgttttttgagacggtcttgttctgttgcccgggctggagtgcaggggcatgatcaccgctcactgcagccttcacctcccgggctcaagctatcctcccaccttagcctcccaagtacctaggaccacaggcacgcgctaccatgcttgactaatttttgtattttttgtagagatggagtttcactgtgttgcccaggctggtctcaagcgatccacccacctcagcctcccaaagttctgggattataggcacaaaccagcctgactctttgcttgactctattgactaggctgtgagtttcctgaagccagggactctatcttttgtctctgtattcttaggacagtgtttgacacacagtacattcttgatatatttctgttgaatgattgaataatacagccatgtgtagtaaagtggaatgaatttgagccttatgtcagatagacatagacttgggttcagttctagctgtgctacttattggtatgtgagcctaatatctccaaattacagttcctacatttataagatgggagataatgtttcccttcctgatggggaaggattatctactaaggcagggacagataagtctattttctgttttgttgacccactatatccccagtgctggttgctgtcattattattatcctgtgctatgctatatctacctacttatggctcctcaagtaaatcatgatagttcacagcttagtttttttgtttgtttgtttgtttttgagacaggatctcactctgtcacccaggctggactgcagtggcacaatcgcaacccactgcaacctcaaactcctaggctgaagcaatcctccc

SEQ ID NO: 25807 - DNA, 1027 bp, Homo sapiens
aagctagtctcttacaccttgtaagtataagaatggttgttagtgttctgagtgcctacatagcaaagcttattgtggggtaggcgtgtctgctcagtatacaaaatttaaatttattctttcattttcagcctggccttacccatgccctttactttgcctaaagtcatgaagtatatggtcctttgctctgtaaagttcattacattctctatagaatttattctttatagagtcattttctatgtagaattctctgtagttggtgatggtggaggaacagaaatctcctggctgtcagaggtgtagaatcaatgacccagttgtctgttttactataattaaactgttttccctgctttccccaatattttggtgcctttactgcctagcttctttctggggttttcttaagacaaatcagtttctcgtttctgtatccctctgcaaatacttagttcttggcttcttcctgttgtatgacttgccttgcctctgatttctcttttccaaaaatgccttggcaactctaaactgctgttctctcttctcctgttttctttgctggtattcactttttaaatttcttacctaaataccctgcaaaaacaacccaaatgtccaaccagaaattcaggaattaaagtatatgatgaagccgagcatggtggctcggctttgggagtctgaggtgggcagatcacttgaggccaggagttcaaggccagcctggccaacatggtgaaaccccatctctactaaaaatacaaaagttagccaggcatggtggtgcatgcatgtagcccaagctacttgggtggctgaggcacaggaatcgcttgcaccctggagacagaggttgcagtgaactgagatcacacaactgtactctagctcaggcgacagagcaagactcttaaaaaatatatatatattcataccatggaatgcaagggtttaaaacaatgaaatggaactttatgtactgacatcgaaagcttttttttatatgaacatgattgtaaaa

SEQ ID NO: 25808 - DNA, 1028 bp, Homo sapiens
tgtatttttagtagagatggggtttcaccatgttggccaggctggtctcaaactcctgacctcatgatccaccctcctcagcctcccaaagggctgagattacaggtgtgaaccgctgcacccagccacaatttccaatatttaaatgtttatattgtttcaagatttctattattataagcagtgctgttgtaactgtagttttgtgtacatgtcagttcatttaccagcagtgtagaattgtgcctctttgctcacaaacttgccagtgcttcagtcttttgcatcttaagtaaaccatttcttatcctgccacaaaaagagggaagattgtaagtctaacacgtctccccatacttgtttggtgttacagttaacatttataccttatgtggcctatttctgttttattctcagataatgtttagaacctcttgtgacaggcacaagttctttgtttaatgagtttcatctatgaacagagggttggaatgagaaaatgacttataaaatcagaagccttgtgttttgaagatttgactagtggtatctgtagaataaactacttaggggaaaggatacaagttaaaggatcaacatataaaaataaaggattgaaattatagtccttcctgttccataagatttttagcagtaatattgctaaatttagtaagctttatttagctagtcacgagttaaaaaggagatttcttttcagtgtcctaaaatgtgaagtcaagttgtacttcttattcattactctgttttacttttaacaaatacattctgatctgccacagtgcatatttagccaggtaaaatagcttgtaagcaattggtacataagagaatgatgtaattataatacggagataggattggttcacaaattgtttgttttttgagacatagtctcactctgtcacccatgctggggtgtagtggcacgatctcagctcactgcaacctccacctccagggttcaagtgattctcctgccgcagcctcccgagtagctgggacta

SEQ ID NO: 25809 - DNA, 1061 bp, Homo sapiens
tgatattcaaacagccaaaaatatccttttcttaaaatgtcttttctaaaagcgtataatttttcttgagaaatttgcactgagccactttaggcaaaaagttttaagtattttttaacaatgggcccttttatagatttattaatattaataatatagcatttattacagaaacattaccaagaactcctcagtgccatcaaggtattattatcatgttcatatatttttattgcctttctttctgtatttcatattttatgcaaatataagtcttagttatctagtaggtaaaactgataatatgcttctggagagtctgcctaatgaaaaagtaaaaatctacagccttttaaatggatatgaaaatggaggaaataggccaggtgcaggggcttacacttgtaatcccagcactttgggaggctcaggtgagagcatcgcttgagtccaggagtttgagaccagtccagacaacatagtgaggccccatctctacaaaaacttgaaaaaaaaaattagctagcatggtggcgtacatctgtagttccagctactctggcagctgaggtgggaggatcagttgagcctgggaggtggaagctgcaatgtgccatgatcacaccaccacactccaaactgggtgacagagtgagactttgtctcaaaaaaaaaaaaaaaaaaaaggaggaaatacagtttagattttgttataacatataggatgtaagctttatttattctttatttagatatattcaatatttattttcatgagattactttcttttgtagataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtaagtataaaatgttttaaggagcaacatttttaatagagataaaactgaagttacccatttgaagttatttattagcagtgtatattctatgaatgagatgattg

SEQ ID NO: 25810 - DNA, 1638 bp, Homo sapiens
atcggcacccgtaattcatcagctgcaatttctgttttcagtttattaaaatggagtgaaaatctaaaaattttttgaaggagtctgagtgcagaatcctttggttttagtatatccctctaggtaattatagttgcatgtatctaatttggaggcaatttttaaattgagtccttctatattcaacttaactgtagatattacagttctctgagatttcatcagtctcatatgttaccatatgaccatactacatactaacataagcaaaggactttgaaaagcgtacaacttaattagtgaaatcagaaatatgtggggcataatagaacattagccactatctgagaatacttgttaacctgaagagtcacttaaaaggaagttaggagaatgtttatgaaactaataaagttgaaacatgagcacaccctatgtaatactatcagttccatttctgagtatatactctagggaatgtttgtgcatatgcatgacaggtacaagaatgttgctgcattgtttgtggtaggaaaatgaataaaatatgtttttttcatataatggaatactatatagcagttaaaataattgaattttgatgtatcaactgaataattccccaaaatatcaaggtgaatgggtacaaaagcacatcgcagagggttttcttgcagaatggttccatttatataaatgaaaataatgcattttttatgttcattttaataaaacacttccagcttacagaaatatatagataataatataacagacactcatatactccctgttggctttatcaaaactaacttgccatattttttttcagatttttttttaaaacattacagatatagttggagtttcatatgtaccccttcacattcccattcccattctaccccctcttcctccatctctcaaggtatgctgaatttggagtgtatcactcctatatttacttatgttgttatgatgtgtatatacggtattatttttcttgttttcaaagttgctataaatttaatgtctgtcatacatattattctgcatattttttatccagtgttatttttgagatctattcgtattgatacctgttcatattgatctaattcatattgaaatagagttcttatttatttttaactcctacataatcctctcttatgaggatgctgtaattcagccattctgcctctaatgtgcatttgtttctagctttttgctattacaaataatgctccagttacattcttgtgtttccctgtgcacatgtgccttgatgtgctctagaatgtattcctagaaattggaacttatttataatggcctacttaattgagttttttttttaatttaaagcataaacacattcattattctggagttttaaaaattcctgcattttctgtttttaaaaattagatgtataatggataatcaaatgcaaatgttattttaaaaaattaaaaatagtaaaacaaaaatgagatgaagagaaataccctaattgttgaatgatgaataggagaaggtaaaagaagatatgtcagttttatctctggttgtaatcttactttttatcagaatatttatgctatgttgtcttttaataattccacatctgcatcc

SEQ ID NO: 25811 - DNA, 1038 bp, Homo sapiens
atccagtggcttgataaagtgattcagtggtttttaaaatttagatagaattggtgaaatctggggttccaaattttaggtagttaagttgctatcacatgggcttaattggttctttttctttctaaacatttttattcttccaaaacagattcaaatgtgccttttacccccatttgaatgttatttttaaagttgagagaattttctttctttgttactttcttgggaaaaactcaatacactgcagagagagagagacaaatgggatcaatagtgattatggtgcttgctgttctgacttacatgttgtttattttgtgtctgttttacctcaagtatttatttgtgttgagaacacttaaaatctactgtcttagcagtttgcaagtgtaatacattgttagtaatatgttgttattatatatgttgtacaatagattggttcttcactgcgtttcatattcgtatcacaggcatctttttaaaaaattattttgaataattttcctcagaaaaacattttgtgatgctctctgatctttatcttgccttcatttttacttagtacataatatgaagtagacttaattttcagttccacagaaataagattaaagtgaatatagttagtttttggttctttgacaacgtataaccaagtgtttgatttttttcacagtattttaaagtatctgcttatatatgatctgtactgctaattctttttgttttggtttggttctggaaaaggtatgtactgctaatcttgaagatgtttttatttacataagtaacagtattgtttaaaaaattctatgtttcagaaaaccgaaaaaagtgaatttctaaattttttctacaaccattgtatgcatgttctcacagcaccacttttgaccaatacttcagaagacaaatgtgaaaagggtagggtctctttatttatctgctgtgatttctgtttttaaagaaggatgagataaatattaaactaacaggcaatttacttgagactttataagacagggagattac

SEQ ID NO: 25812 - DNA, 1043 bp, Homo sapiens
tttttaaaaatgcgtgcttgactatatatatattatatatatataatatattaaatatatatataaatatatatataattatatatattttttatatatatataattttttttttttttgagatggagtctcgctcttttgtccaggctggaatacagtggcacaatctcggctcactgcaagctccccctcccgggttcacgccattctcctgcctcagcctcccaggtagctgccactacaggcgcccaccaccatgcctggctaatttttttgtatttttagtagagacagggttttaccatgttagccagggtggtctcgatctcatgacctcgtgatccgcccgcctcggccttccaaagtgctgggattacgggcgtgagccaccgcgcctggccacttgactatatttttctgtttgtccttttagacaacgcctgtagaaattagcacttgtctttctttttaataccccagagtcattagtatgaaaagcagttattgtagtgctttgtcatttagttatatccttggggaccgcaagaacgtgtaaaactgtgcaccagttggttgtaggttgttgtattttatgagttattgtattttaaatagctttgtaactttatctactgtcggaattcagcctcctttactgttttccttgttccttgtcttacaattcttgtttttctaatctgttataaactgacaataagatccttaggcttgtttgaattatgtttaaattaagagtaagtagaccctgaaagggggctagagaatctaagttaagtgagttttcacgtaacacctctagaacaaatatttttgttttccagagagttatttgtagttgaggtttttagttaaactagatattgatgtatttataacaagaattgaatggtgtagtcaaattttagaaaattgtaacacagaaatacaccccagaatattaggtttcatgatgaaaatactacttgtcaactattttttataatttgtgtaagtcatataaatgagtataactttattctttt

SEQ ID NO: 25813 - DNA, 1069 bp, Homo sapiens
ccaggaggatcacttgtggtcaggagtttgagaccagcctgaccaacatggcgaaactccatctctactaaaaatacaaaaattagccaggcacagtggcacgtgcctgtaatcccagctactcaggaagctgaagtgggagaattgcttgaaccgagaggcggaggttgcagtgagctgagattgtgccactgtactccagccagggtgacagagcgagactgtctgaaaaaaaaaaaaaaaaaagtttaaaagggtcctgatacaaataattgagattctatctctgacttagtgcctagctaatcgacttcattttgcgacgtttcccaccagtagtcacctattattgtttactttaattttttgcataggatttacttttctttcaggtcatttattcacctaccaattttttgttattcaccaataatgagtgtgggggaggttagatgtacatatcaggttctttttataatatataggacctgtgtatttttaaactgtagtatacaattcagggtgctatttcacttgttgacagaaaaacatttaataatcttaggagattggacagagtcacagtctgtagttgataaaaagaggaccaggaacagaagctcatatgtagctttcaaatgactgtttttgtcttcagaagggtttccaaattcatactagtaaatcgtaaatacttttttatattcagaaaataaattatatgaactataaatatttgtaaaactttgtcattttatgtattttataataggtttatttgtgaaggctataattacgtaaatcaagtgcagctttttatttttctaaaagatttactcatttctgcttcatgagatgcatttcatgaaatagccagattctgtgaactgtctgttatttacataacatttactacttaattatctcttatgtgccagcaatgatgttgaatttttttttttttttttttattttagattcagagggcacataggcttatttgttacatgggtattgcatgagtaatggtggagattgggcttctagtgtacccatcaccgtgatattg

SEQ ID NO: 25814 - DNA, 1099 bp, Homo sapiens
acacgttgtatgaaaggaagacctccatagtgagccaattatacattatttactaatactttatttttctcaatgacttgtgatgtcaccatatgatagtcaaagtttataaatgcatgttaaactatatcctttttcattgttacgtgaattttctgggccactgtcaaactattttaattattatgatttaggggtatattttaatatctgagaagcaagtcatcttccctgtttgttcaatcccctcaaaattatcttaaaatttagatacatttgttcctttatttgaattttagtattatatcaagttctcaaaatatccttctaggatttataattataattatactaaatttttatattaatctgagagaagaatcatacttttacaatttaagttatagtctacaatgaatagagtcagtgtcacctttgattcaggttttcttttatgctctttagtcaagtttttaaaatgcctttattaagatgttctgcatacttttgttatccattgtgacaatctctggctttgtaactgtagtacttagtccattcatgttaaatttaatcattgatgtgattgaatttaccgtcattttattatttgtttttcttttgcccttctgttttttgtttctctattttttactttcagccttctttttgaatgaattgaattgtttttagaattttaatttaatttgcctatttattttttagctgtacttctgagttattttccagtgattactatagaaataacagtatacatccataacttctcacaactttttatttatatattgtaaaaaatttttgtagagtcagggtttcgccatattgcccaggctagtcttgaattcccgggctcccgcagtcctcctaccttcgcctcccaaggtgctggtattacaggcataagaccctcacagtctttttagaattaattttgtaccacttaacataaaatgaagaaacttcgcaaccatttaggtgcatttcctgccccttctatcctttatattgcagttgtcttatcagttacatctacatgtgtcataaacccccacaaggtggtgttataactttcata

SEQ ID NO: 25815 - DNA, 1030 bp, Homo sapiens
cttttttttttttaagagacagggtcttgctctgtcacccaggctagagttgttcagtggtgtgatcatagttcactgcagcctcaaactcctgggcttaagcaatcctcccacctcagccttctgagtagctaggactatgggcacaggccattgtgcccaactaattttttttttgttgggggtagagacaaggtctttctgtgttacccaggcagttctaaaaccctggcctcaagtggtcctcctgctttggcctcccaaagtgctgggattacaggcgtgagccactgcacctgaacgttttttaaaatcactttgcagaaacatttctatcaactttcctctccccaaaagatacaaaatgctaagtaaataacattttctactctgagtctagactgtgttgttagcaacctcaggagaattagcattcatacagtatagtttgtttctgcaaaaagaattatatgaacttttttttattgctgcttcaggttgactacagacaaaaagctgctgcagcaggtagaattcccacaaactatctgagaagagagattggtacttctgataaagaaattctaacaagtcgaataataggtaagatattaacatagaggcgttcatcttctctggtatgcctatgttagcatctcttctcttgcatctgtgttctacaataagtcttaagttttccttcatagcattaacaccacctaagattattcactccttctcttccctcactcaaatgtgggcactgtgaaagaaaaaacttttatttcttcagggttgaatccctagtacctgttatactgcttagcacagaataggcattcaataaatatttgttgactaaatgagtaaatctctattgagcatatgaattttttggcccatgcctctactttgttgaatctattcctagtacattttttcatgttcagaatagtaattcctaaacattatgttcatcagctactgaaatatgtccataatctttcaaatctttaacatccctacatat

SEQ ID NO: 25816 - DNA, 1045 bp, Homo sapiens
gacacctttattaagatataattcacataccatacagttaatttaaagtgtacaactcgtctgggagcagtggcttatatttgtaatcctagcactttgagaggccaaggcaggaggattgcttgagtccaggagtttgagaccagcctgggtaacatagtgagacctcatctctacaaaaaatttaaaaattagcccagcatggtggtgcacacctgtatttcgagctactcgggaggctgagatgggaggatcacttgagcctgggaggtcaaggctgagatgagctgagatggcaccacggcactccagcctgggcaacagagcaagaccctatctcaaaataagtaaatacagataaataaagtgtacagttcaatggatattagtatattcaaagttttgcagccattaccaccatcaattttagaacacttctatcaccctaaaaagaaattcattagtagtagtcacttagcgtttctccccagccccaggtaaccactaatctactttccatcgctgtggatttgcctattatgaatatttcttacatggaaacatagtctttggtgactgtcttctttcacttaacataatgttgtcagggtttatccatgttgtgacatgtattagtactttgttcctttttatcgctgaataataatcagttgtatggattataccacatttagcttatccattcatcagttgatggacatttgggttgtttccatttgggaactattatgaataatgctacaaggaacattcataacagctgtcaagtggtattcactgtgatttggatttgtatttccctgatagttaatgatattgagcatatttttatgtacttactggccatttgtatgtcttttttggagacatggctattcaaatcctttgccaagttttaaaattcagttgtctttattgttgaattgtaagcattctttaaatattctagatattaacacaagtcccttatcagatacatggtttgcaaatatttttctcttaatctatggtgtttcttttactt

SEQ ID NO: 25817 - DNA, 1028 bp, Homo sapiens
aaaagcatgtttcataagagaaaaacatgattaactgaactctattaaaaaaaaaaaatggccgggcgcagtggctcatgcctataatcccagcactttgggaagccaaggcaggcagatcacttgaggtcaggagtttgagaccagcctggtaacatggtgaaacctcgcctctactaaaaatacaaaaactagccgggcgtggtagcatttgtctggaatcccagctactcgggaggctgaggcggtagaattgcttgaacccgggaagcagaggttgcagagagcagagatctcaccactgcactccagcctgggcaacacagtgagaccctgtctcaaaaaataataataataaattttaaaaaaacaacttttgctccatgaagaacctcattaagaagataaatagacaagctacagggtgaaagaaaatatttacaaaccctatatgcaacaaattactaagatgtagactatataaaggattcataaaacttaatagtaagcaaaaatccaattatggaatgaacaaaaaacacaaagaagtaacttctcaaaaagaatatatagatgacaaataagcttataaaaacatgtttaacatcgttagccattaggaaaacgcaaattaaaatcacaatgagatattactatatatttctcggaatggcctaaaaaaagtaaaatatcaaatgctggcaaagatatggacaaactagatcacacgtacattgataatgggaatgtaaaattatacaggcattctggaaaatactttgatagtttatttaaaaaagtaagtgtacaactactttatgccccattatttgtacctttagaaatttatctcacataaatgaaaatatgttaatacgaaaacatgtgcatgaatatttatagcaactttattcacaatatctccaaaaaagacacaactctgatgttcttcaatggttgaatgtttaaataaactatgacatatgtctagcatggaatactgctcagcaagaaaaaggaatgcatta

SEQ ID NO: 25818 - DNA, 1030 bp, Homo sapiens
ccttcccatctgttatgtttgtttttaccctgttacacttgttataaattattttgaagagattatggctggatcctggtctaaaatatgccaccatagtttgcacatctaatctgtatttaatttcatttcttccgctttaatctactttgcttctgatcataaatggaaatgagccagcagaaaggagatggcatctatccacccagtatgtgtgtgggagttcactgttctggaacctgaacgccatgaaccctcactcatgaccatagatatgaacctaggaaaatacttgtaaatgaattaattgaaatgatacacattaaaaatgttgctaatgtgaatgtgaatgcaaatacaagtagatacaatcaatttaagtgaatgcaccagaccattcatgtggccacaatttctcaagccccactaacttcaaatattttctgtatcttgctagctttatttatgtctcttcagcagtttgccttagtgtggaagaactgtattaggagaaaagactgatgatgtgttgagcaacactggaggtgagggttggagtataacatgtgacaaattaacttctccctgattgttatctctggcaggtgttttgtcttccaacatgaagtatgtaaaaatatattcagatctgcactctttttggttgtatgatattagagacatgacaaacagacaaccaattaaagaacacctttacacaggggcacggaagcatttatatcagtgaaaaagagaaaaatgcctttgcttttctccccccagcccccgtcacacacctccccccgccccacaacacacacacctctctctcacacatctaattcacacacacacacacccatgcacacacatcccaatttctcaccccagggctcggatgatcaatgctcagtctcagccttgctcctgctgaagtcacaagtgagttctaacaaacccccctctaaggctacctcctattgcctgctcttcaggacatgaggaacacatccaccgaaaactatgtttt

SEQ ID NO: 25819 - DNA, 1083 bp, Homo sapiens
ctttagtcaaagcagcagcaatccccttagaggaggttagagaggctactacccttgaggttggagagatcccctccagtagggctggggaggtctcttctactgtcaaagaagactcattcgaatttaggagtttaatgtccctagcttcatctgggtcttccaacttacatgatcctattctttcccaatcaatgcccttgctttaacagtagacaccctaccaaagtgagaaaatgtttacctcctatctcactgaatgtttttactgaccctctcaataattcttccatgtctttttatatatcttacatatgttttatatttttcttcttcttgcatttttatgtcatttcaacagatttgttttgcatcaacatttcttcagttaggcctcatttattttttactttacccattgtcttttaaattttaattatcttattattaaaagcaacatataatccaaattttataaaaatatcaatatttagaagaccagaaacaactgtatcaaaaagcaagagatatctgaaaaagtgctagagtaagaaattttcattttaatctacacactttctataattttgaaattttccattatgagcttgcattacttttgtaaccacagaagattctacatttttagaagaaagcaatctatttagataatattttaaatgttaatatctttatcttcttagatgttgtttaatccctgtgtaaacatggtttcctgacaaaatagtttttgcatataaatccctacaggctgacctggctaattatatagtcatatcatgcagaatacaatatattggacaaaacttaatattttctagatgataattaaaattgcaagccttctttcttcattgcatgaatgttaacataatgtttatacatttctttgcctttcaagtgtgaaattagagtaaatgggccactaactggtccctggaagtagaataatgaccagctaactggactgtaagtctctacattcactgtaactgcagagaatttgataggtgattatttaatacagtttcaaatgattttccactatactggaagaactag

SEQ ID NO: 25820 - DNA, 1025 bp, Homo sapiens
agctaatatcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattctcagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggc

SEQ ID NO: 25821 - DNA, 1078 bp, Homo sapiens
aaactttaatacagttgaccagaattgcaatctaattaaatatatcaatttgttgactggctgaaatttaagatcctttcaatgataatcatatcaaaattacttcttttggttcaattatatttaccattacataaaactacaaaacatttggttaatctttccgtgggtatacagtgaaataggtagccagaccaacacctctttattttttattgggttgtttgatgagctgttctacttctaaaagatttaatcttgtttcattctaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataattttgattttctaatcaagtagttaagaaacattctgtatcaaatgtggctttagaaaccaagagtagagcatgcaattattaaattttttttttttaatctgaagtggtaaaacccctgggaattaagctgagcaggaacatacatttgtggtaggtaccttggcaatataatttttactttttggtgattttacaaagttcacagcataatttttttccccatgctttcagggatccagaaaatagtgtgttacaaaatttgaaagatgttttagaaattgattttccagctcgtgctatcctggaaaaatctgtaagttttatcagtgttttgatattccagacagtattgcataatgaagtttaaatgcttctctcagtgaaaaatgaggctgaaaaaggagggaattagaaaaatattataacacagacttctgatctgcatcaaaaaacttgtttacctttga

SEQ ID NO: 25822 - DNA, 1019 bp, Homo sapiens
atcacctgccttctgccttgatctcgctgggagctgcagactggagctgttcctgtttggccatcttgccagccaccaagaatgttagctatttttatttttaaaaatattttttagagaattcatctccctgcaaaatacttactgaactttgattttaattttggccatattatttcttggcatttgtggtgctgtatataaagtatttaattccattggtaatatttagaaataatttatttttttcaatttggggaaaaaattcaaaataagggtttttagtgatttaatggacaaaataagcagttggagaaaaaactattaatcgcatagcttactgatataatagttttgatgtctaccccctaagttcgttgaaattgctaagagaagtgtttctatgtccaacttgtcacatttttgatctttcttttccccatctggaatgtaaaaataatgtttaatgtatctacctcaaatggctagctagtaaaatcgtataatggcttttagggtttaaaattcactttttctgtaattaccaagtaacttctagttccagggatgttttgtttttggctattttcttattaagaatacatttttctgttcaaaatgcaattaggattttatttgcagttgtgcataagagaaatggacaatgccattggaaaaaacttcaaataaaagatgccactgtgaaaatattttataactctttttttggcaggggagttaaccttatcttgggtatacaaaggaataggtaattacggattttaaatacacatgtagaaacagacagagaaaggagaaacagagatatactattgtactgattttaaaactagcttcttgggagtttaattttctgatttctggattctgtcacctaaacttacaggtaagtaaagtataccagaagagaacagacattataccgtcaatatcctcaaaggttatttttcgggtattaggctctaattcctacttcacaccttttttttctttttgag

SEQ ID NO: 25823 - DNA, 1007 bp, Homo sapiens
tgggttggtttcaagtctttgctattgtgaataatgctggaataaacatatgtatgcatgtctttatagtagcatgatttataattctttgggtatataccccataatgggattgctggatcaaacagtatttctgcttctagatccttgaggaatcgccacactgtcttccacaatggttgaactaatttacacttcgaccaacagtgtcaaagcattcctatttctccacatcctcttcagcatctgttgtttcctgactttttaatgatcgccattctaactggcatgtggtagtatctcattgtggttttgatttgcatttttctaatgaccagtgatgatgagctttttttcatatgtttgttggccgcataaatgtgttcttttgagaaatgtctgttcatatcctttgcctacttttagatacggttgtttttttcttgtaaatttaagttccttgtagattctggatattagccctttgtcagatggatagattgcagaaatattctcccattatgtagattgcctgttcactctaatgatagtttcttttgctgtgaaggagctctttagtttaattagatcccatttgtcagtttttgttgccattgcttttggtgttttagtcatgaagtctttgcccatgccaatgtactgaatggttttgcctaggttttcttctagggtttttatggttttaggtcttatgtttaagtctttaatccatattgtgttaatttttgtataaggtgtaagggaggggtcccgtttgagttttctgcatatggctagccagttttcccaacaccgtttaataaatagggaatcctttccccattgcttgtttttgtcatgtttgtcaaagatcagatggttgtagatgtgtggcgttatttctgaggcctctgttttgttccattggtctatatctctgttttggtaccagtaccatgctgttttggttacagcatgccttgcagtatagtttgaagtcaggtagc

SEQ ID NO: 25824 - DNA, 1098 bp, Homo sapiens
tctggttttgatttttgcagcactttttactcaaccacattgcttcagtcagcttcgtggtggtgtatgttgacaaaacaattcactgcggttccgccactttacttctttttgccccagggattttctaatgctgtaagaccaaggatgcttgtggaagccacaaggcatacatacatatctacacctgtaagtgtgagagactgaatcccctttagggcaattcagccagtggcatggaagccggaaaaaaatgctcttgcattctggttcttggacaggaattctgaggaactttttctacagctgcttacatagctaccattgactacaataaccagcttgaaagcacatccttattttggcattccctactgtgtttcactctttccagtccccactcttcgttccctgagttcacttccaataaattttccccatacatgtccttgtctctggctttgccttctggggaaatctcaagcttgggccaattgtcattgttgtatgctacagatgaagatatgtaggacaagggtccaaatataccaatcatacttatggcccagaaatttaccttcttaaagaaaattctgatgtttgctttttgattatttgacttatttttcaagattgaacaaaacctatgcaattatatatgacctcctaagcagtataacttggcaggccttctttaaaatcaatttataaatcaaaggctgcactaggcttctctcaaattatttccttgcccctagaaaattgtaatcttcttcacagttgctgtcggcttcctttgacttgtcactatttgaaaaattttctgtgactactgtataactaacagtgggtaataggcactgacttcttagctgcacttgtacctagtttgcagaatgtaagtgtttctcaatatttcagtgataggtactaatatgttttttaaaatgtttagacctaagtgtacaagtaattcagcagtggaaaataacactgtacaagccaaactactgactccttgactaaaattatattccctagtcatggaactaacagaatttttgtttatctcctgattccttaacttgtgcttcttaa

SEQ ID NO: 25825 - DNA, 1029 bp, Homo sapiens
gtagataatgaggagtttgttgttttctccacctaccctcactccatcctatcttcctgctttccccaaataactatattgtaatttggataataatattcagtgtttacattattatgaagatatttgtatcctatgtagatataagtaatgtggttacttatgtctaatgtaatgtggttaacggtgattaattttcctttgtcaccctcgtttttattattcctagaggtcactttttaaaaaacttttccatttctttagttttctaagttgttataactcattcaacctccatatactaaaataccaatggtatttcttaagtaaatgtgttttatgggcagtgggatggatatatgactttgaatctcacttacttgccagattaaagaagatattatatcgctatagtttcagttgatttctaagattataaaaattggtttaagctttgtagaagatttgagatctgtgcattttgagcacatgagatacttgtggaatggcaaagctctctcatgaatttaaagacccaaagaaactagttgcatggaacaggtttttttaatcaaatgccttcattggtacgttaactgatttacttgctgatgttaataaatatgactttactatagaccttcacagtaggcttcatatctgctcagccactgtagcatagtataaagagaatacagagtcttaaagtctggatcaaattctggctctgtctttaccagtgcatgaccttgtgtaaattacttatttataaaaagagagaaagaatatctgtgtcatagattacatatgagaacaaattggggtgttgtatatgaaaatccttttgaattgtaaaatgctgtacaaatgtacaaagtgatgtagggagttaatgcagtttgtaaactggtgaactcttaatatagtgagagctaatatgggcaaagaagtagtctctctccatgtgtaatgatattgtatatttgtggatttatacacacatatctgtcagacagcaattattatcta

SEQ ID NO: 25826 - DNA, 1055 bp, Homo sapiens
ccatccatgtaagatgggacttgctcctctttgccttccaccatgattgtgaggcttccccagccatgtggaactgtaagtccaattaaacctctttcttttgtaaattgcccaatcttgggtatgtctttatcagcagcatgaaaacagactaatacagtaaattggtaccagtagagtggggcattgctgagaagatacctgaaaatgtggaagcgactttggaactgggtagcaggcagaggttggaacggtttggaaggctcagaagataggaaaatgtgggagagtttggaacttcctagagactagttgcttggctttgcccaaaatgctgatggtgatatggacagtaaggtccaggctgaggtggtctcagatggaggtgaggaatttgttgggaactggagcaaaggttactcttgttatgttttagcaaagaggctggtggtattttgcccctgccctagagatatgtggaactatgaacttgagagagatgatttagggtatctggtggaagaaatttctaagcagcaaaacattgaagaggtgacttgggtgctattaaaagcatttagttttaaaagggaaacagcataaaataaaagttcaaaaaatttgcagcctgacaatgtgatagaaaagaaaatcccgttttctgagcagaaattcaagccagctgcagaaatttgcataagtaacaaggagccaaatgttagtccccaagataatggggaaaatgtctccagggcatgccagaggtcttcacggcagccactcacataacagccctggaggtgtaggaggaaaaagtgggcacagggtcccagcactgtgtgcaggctagggacttggttccctgcatcccagctgctccagctgtggctgaaaagggccagtgtagagcttgggccgtggctgcagagggtgcaaaccccaagccttggcagcttccacatgttgttgagcctgtgggtgcacagaagtccagaactgaggtttcagaacctccgcctagatttcagaagatgtatggaaattcctggatgccc

SEQ ID NO: 25827 - DNA, 1080 bp, Homo sapiens
taagaattattttcgttgcctttgccttctacttccctttatattccttaaaaggcttttatttagaacagtttctcttcttatgtgtagatcaattttttcccttttgttttaaccactaaaatttgactgagtgggccatacctcttttggtgcacctatgtgcagagataggttagccattccttcagtcatgactttatgtagacttaattttttatgaatacttctttaccttaccgttttccttaccgcctccctgattaagagtcaaagtgtgtacgatctgtacttaagagccaagttatttaaatcctggtcttgataaaaattacagcctcggatttcaactgttaaaaccttactaaaatcgcgattgcatgtaatagtgtttcactgcagatggactgcttaaagtctctgtaatcttattttatatgttttctcagttttacccatggatattagaaccgagctactttattttgctctcttgtataattgctcttgaggatgccactgacttggattaaaggatgttgtatgaaatagtcctaagatatgcagtagggattttatgtttggatgtcttccattgtatgataatagcactatctttatgagaagccatgaaagaagttttattctgtttcagatgctagaaaagtcatgctttgcctgactatccaacctgccacttaatgaataatgtgaactatgtaattgactatgttctctttgacttggcctctaggaaatttagagtcaaatttttggcacactttttagagccatgctggatataggatttatatttctgtatgctaatcttacctgacttttgttctcctgtgattcttctcttcatatcaagggtacatgttatctctgtgactcatcactgttgatcttgatcttgattacctggtgaggtagtatttgtcgggtttctgcaccgtaaagttactgtttttttctctctctccacactttactctttggaagtcactatatgtagctcacacttcaggagtgggcagttacgctcacacctcctttagggcacagtatttacacaga

SEQ ID NO: 25828 - DNA, 1029 bp, Homo sapiens
tggttttatttattcttaatatggtaattgatgtagctttttggtatgatatgtggggagatggaggtttaggtaactgttagtatttctgttgcctgaaagcctggaaaatctggcttttttgagaacaattaatatttctagatactttaactaaaaagctaattttggacattttcttgaatcaggaaagtatcgtggcatgtgacatgttatttgaccttttaaaatggctgggctttgcaaataagggactttggaattttattctttcagataacagcacagatttctatatagaatagttcttctatttttcgtgtaaattaagaattccaaattgttcttacacctttgtgtgggatgtctataatgttaggttaaagttactacataataccttttagtgctttaatgaaacagtgaattattgttacttgaccttttgaaaaggtcagtagtacattttgtttcatttttttaaaggacatttaaatgtaatgaaagtcagaactgtaatattaccatgaaagtaaaggttatagggtacatttaattgtgttcctctgtttttgaaactgctttgagggagactgtgttaaaattccacatggtaattgttttttgagaattttattactttttcattttattctgttagagtaaaagattacatttctgtttgtctttttctgctatttttgctcaagtttcctgtgtattatcctatttaagttataaagtttaaactacttacccattcacttttccaagaaagtaaaatggaataaatgtctcagaggtctttcttctcttagaaagactcttgagtaaaattctgtttgttcaaatatatagttaatatgttactgatttcaaaaaagttagaggcccactaatgggagaattaaatatactctgatttatgcaagtatttcacttatgtctgtatagattgtgtaactaaatatattttcattttattaaaatttagaaagtaagctgaaaacgactatataatgttatata

SEQ ID NO: 25829 - DNA, 1021 bp, Homo sapiens
ccttgtatgaactttgagattgttttgcagactgttcctgtacgttcccacctttgggtgttttcctcatatccatggagcaagcagtactcagctgaagactccttgtcaggaatcctctgaaattcgctggcgtttctctgtgtatatttctctactctccatgcatttctctcctgcttggtactataccttgcgaattgtacaattgttggcctccccttgatcacatgtttcttctcacatcagggagaatattatgctcttatttgtttgtccatccctatcttgcagcctgaaaatactcccatcatagaaccagacaattttaggcattttcacatttgtttcccttatttcaaggatcactgtcctcgctgcctattgtttaatgtctgaaaatcattgtttcatatgttttgtccaatttttaaataaggagggaagataaatcctgtccttttaactccataatagctagaagcagttctcttcagtttcttaacattttctatttcattcttgcttcattttttaatttgctttaagaagtctgtttccaattatattctgttttctatatatttgatcttttacctagagactctggacttttttcttattttgaaaatctgttgattaagatatatctcaagagttgatcattgtgaatcacttttatcatgtggccacttatcccttttggtatgtggaactccaggaagtgtacttggattatatttttaaatttttttttctactattttatttttctttccaagatctccaattatatgtactctggacttttttgggtctgtgttccacttcaactccttttctctgatggtctttaatttttttctcatttggtaattttcttgctttttctttgccctttatgacatttgtatttcattttgttcttccttggactctttttaaatttattccttcactttcatataattttgtgtttttctttattttcatttcaccctgcgtttattcagctcattca

SEQ ID NO: 25830 - DNA, 1042 bp, Homo sapiens
ttttaaaatatttattgagccttaattttatgaccaataatatagtctatcctggtgaatatactgtgtgtactctaagagaatgactattctgttgctattgggtagagtattatataaatgccagttaggtcaaattggttcagagtgctacccaggcccttattgggtagcactgtgctcactgacttttttgtctgctttttctatcagttagtgagagggggtgttgaaatctccaacgatctttgttgatttttcaatttctatttaatttctatcagttttgcttcatatattttgaagttctgttattaggtccataaacttttagaattgttaagcactctttatgaattgactcctttaggattatgaaatgaccttttttatctttagtaataatgttttctctgaaatctgtattttccaatattaacatatagattgcatctttcttttgattgatgttaccatggtttatctttacttctttattttaaacttatttgtgttttaatatttagtgtgtttcttctgtgctttgctttgttatgcaatatgatagtcattgccttttacttgggggtgcttcgactatttacatttaacgtggttattcatatggttggatttaaatctactcttgctgtgtgttttctgtttgtcttacatatttttaattgttttggtatttttctgtattttatattattggaattcttttttgtaattctgttttatctcctttgccagtttattggctgtgtgtgtgtgtgttttttttttaactagttgcttaaagggtttataatatacatattaaatctatcatggtctgccttaacgtaatattaggattccattttttatgcactattggtttatcaactatataattttgtcacttttgatactgtaaagatgttacttcactgtcttgcactgttttctacgagaaatctctgctcttttctttgtttctctgtaaatagaatatttttttcctctggctgcttttaagatttttctttttggtcat

SEQ ID NO: 25831 - DNA, 1029 bp, Homo sapiens
aggccccatcctctcctgcttgtagtactttgctcacagagactgagggaggaaatacagtgttttcttgttttaagcctcttttccccctccgtacacacatgaacatgacttcttatgactgtgttgtaactgtgtgttcctcattacgattctgttactccattgtccctgggcctggtgtgttcaggaatgtacccatcccattctctttttttcagacaacttcccataaaaaaaaaattgtgggaactttgccgatatgaggatgggattggcagagttctctcaacctgcttggaaaaatgtttcttaaaagactgctaacttttaaaaggcatgagccatctagcagattttcctagttgtctcctaaagccctgcatatttcccaatagaaaataaacgaacccattgttagagaaatggacatcagaacacatagagggaattggtatgatgtgtatttactctagggctgctatagctatgaactgtggacatgggttgtccggtctgcacttctgcttgctggcatctcgttatcccattagcccgctgtttaatttactacatacagcacgaggccagtgactcagcctttaggggaatggggctgtttctctctctctctctctctttctctctctctatttcccagcgtcatctacggtcatgggataccattaattcctcccttccaaatgggaaagagaccaatccagttcacacgggtcattgtacttgagaacctaaacttggctgaacacagctcgatggttgatccaaatacgtttttcctttctgtaaagtggcaaaaactatttcaagggagcacgtgtatcagatctttcatagggatggtagaaaaggcaaattaagccatttccccaagtatcctctaaagcgggagcccctaaacccataggggggctgtgcttttaaatagctgtgaacgtggtacatgcccatgatatactttgtctattagaatttgaatattggtagcaggttggacgaaagggtttg

SEQ ID NO: 25832 - DNA, 1029 bp, Homo sapiens
tttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctg

SEQ ID NO: 25833 - DNA, 1005 bp, Homo sapiens
acctgattgaaatgtcgactaaaaatcaatgctgttgactagtgataatttacaacgttcctggtgctaagtagttccccgcttaagaatgcgttggctgggcagagattagcgcagggagttgtgtgtgtcacaatgaatcagacgcattataggtcagccctttatttgtttcatcatgacttttacacagttgtcatgtaatttatggctgctttcacgttgtcaaacattttcattgcatcttcttctttaacaccctcctgacatagacacactgcacttgaaggcttggtattgtttcataatccgagaggaggcctataaaccatcaaattacactatctttgggctaatctaaatgcgctgcagattaaaatcagagctcatttgtccctgatgcaaattattaagttctaattataaatacccatttaattacccgacacatttttattttgcggacccttttgagcactgctgtctgcgatgcagagggggtggggggagatgcataggagacaatctgcagtaattaatgtacacttcccaaatggtaaaggataaacatatgctgctttgtttgtcttatttatttattgattagatgtatagagactttggcgtgggcacaatctgaagttgaaatccttttaaagatgaaaactatttaaaaatcttttggggaagaaagagcaaaatatagccaaccaatagctttctgctagaacacatcatcccaaaatatgggattctgaatttgatcaaatcaccagtttctgaatttgatcaaatctagattttgcagaagttcagggtgagagaaaccatgcctgttttatatctagaaagtgaaatcattgttatagaaaaaacctactgtggttagaaaaaaaccacattcttttttcccagccctgctgccatcctctaccagaaaataacagtatctgcctgtagtatgaagaccttccaattgagagcattatgataaactatttttga

SEQ ID NO: 25834 - DNA, 1053 bp, Homo sapiens
gggtgcggagagaggttcttggaatattcttcgatagcagttcaaatgaaatccccacagcagagagcttttgggtctagcagtggagcggtaagctgggacacgtggcctttcgaagctgttattctcagtctgacttgcacaccagctgagataggacttaacatatactttcttgctttcacctgggttggagaggttggggttgggaggaagaggaggagttcattgggaattctgtcactagaattttttaaatgtcaggaggttagcaaggtgtgagttagcattcaagcaaaggattcttctccagactagtaattggaaagcctgcaaatccaggttcccacgatactctctaataactggggtgggatggtggtggtgggtggacaccacaactttctgaatgtcagctgatgtctgcatgacccgttcaccatggattaaatgcggctggtgccgaatggaggaaatcagaaaggcaaatctcaagcaacaggatttgcactcctcagaagtaaaccagaccttgctcctctccctcctgtgcttctcctttcttgctggtttccctttggaagcagaaacttctaaaattaatgccactccaagccaatgaaaaagctgtttttataccacagtggatgtttacacaggagagacaacttgagggggaaaaggctttttggaagggtggagggactcgtgttaatctgttctgttggaggactatgcagtattgcctatgagcgactctgggctgtttttgataaattaccatgtttagagataggtttggctcttaagggcttagttttatgaacaaagtccgtgacgatgtttgcagcctctgtttgtatcttagcccctttggcttgactagaagctctatgtttagtttaagctcagtctggaagatattacaattttgcattaaaaaaatgaggaaatcataggaagaaaaaccctttgctttttggatgaatcttactgataatttgctaaagctcatttgaattttaagcacttctttaatcttcaaaggctaaa

SEQ ID NO: 25835 - DNA, 1086 bp, Homo sapiens
tcagtaactagaatcacgacttctcataattcacagtaatgaattaagagtttcctatggtgaagttaacattctaccattgcacataaattccgacgctctggccctcaggtgcccctgaagcgaagttctggaagacggctgtgtgtgtacccccagcccatttctctaaagcacgtctgcacaattccaagtctgcttttctttttatgatgaggaaggaaacaataacagtaatcattcagtagatatttgaattgtgtcacaaaaagaaaggagaagcaatgccttgtattaaggaaagagatatattgatgaatctctagaagaatgtgtttggcaaccacataaaaggtagtcatttaagcgtgctgggtaggaaaggctttattaaagtgatgtaagttggatttgagttcactgtgagcctgtactattttataggcaggaagcaagaataaaacagtgacagatcttcttcctaagataaataaagcttagaattcgggactttcagataggagaataaggcagagttctttaaatcttgagtaaaatggtatgcattttcactgtactcaggcctctccaagctgagttttttttttttttttttttttttagacagagttttgctcttgttgcccaggctggagtgcagtggcatgattttggctcactgcaacctctgcctcctaggttcaagcgattctcctgcctcagcctcccaagtagctgggattacaggcgtgtgccactacgcccagctagttttttgtattttcagtagaggcagggtttcaccatgttggccaggctggtcttgaactcctgacctcaggtgatccacctggcttggcctcccaaagtgctgggattacaggcttgagcgaccgcacctggcccaaactgagtattttttagaggattctttttacctggtgaatagatgggtatgtgctcccccacttcatccacgtacacatatgagctgtacacatagatgttaatcaggttgcttttttcattttatttaaatattcaaaatattgtgtgattgtgatccattgagatcattgaagtagt

SEQ ID NO: 25836 - DNA, 1088 bp, Homo sapiens
atccaaaacagggagatagtgggggaaaaggcacttgccacttcttcctctccttcacctccctgtctctacctcttttccaccattccaaaacctctagcagaaaccctgtcagcagtctgtcctttagcttttcataatctgtagtttttcaggggtctgatgcacttgttttcttacagcgatctccttgaaaacaggaaagattactgttcctaccttaagtgtctaagagccaactccttaaaattaagtggctgcataaataatgcttgttaagttacaaaggcagaattgggaagaggaggaggtactaatgtttggctcattccttggatcaggcataaaggatccccactacctttcagtccctgaaaaaactgttgattgtactgcctggttgcatctgctctaccccattggaagagatgaatttattcaccttccttaggtgcaacccttgacccacatcatgctttcctgaagtattttgagtctggttcagcctcctaccaggctgtagtgtgctctggattctcctagatgtttgccatcctgtactctactggtggtttctctacttttccaaaacagaactcaagtgtagagaccttatcagagtcatctccatcccctgaagaaatgccacgttgttctctacagtagaaatctttcagaggctagtatacactgatcttagctcacttgacttagcatacagtaggcattcagaaaatgacttttatcagttgatttttgagctgagtgttctgttcagtcaattggagatctcgttttccctctccactgctactgctgttctttttcattcttcctgatttgggtagtttcttggtttctgtactctcccactacctattgctccctattgctttctctacttctgcatcgcaggactcccttcgcttgacttctttcacagacagaactcactgtgcccccaaatttcccttaaaacaaagcctaaccatataaggcctccaaagcttccagtgctatagaagcagccatcctgagcaagaaacagaggcagaggcacaggctgtgactggtagaccaaggcaggt

SEQ ID NO: 25837 - DNA, 1113 bp, Homo sapiens
tattacagtgtgtaagctgtagtgaactggtggaagaggattcaaagaagggtgctgtatagtaaaataggaaaaaaactaagggcttaattaagctaatacagttaaaggaattaaaagatttaacaagccaatataaaggaaatgaattcctaccttttgcagctctttttacctctttcaggcctactcttttgagtatggctgacagtcactttaccattgtctttggacagagaccctggaaagttggttaaagcagttgcctattctccctaatcttttgtgacctactgctttgtaattttgaagacttaacaatcttagagcaagtacttttttaaaaaaatgtgattaaactatttcttcagactagaatatacacacaaaatagcagagctctgaaggtgaggaatgtttaaaagagcttaatgagagtttaacttcaggatagaaagcaaatacgtttgctttgcacacatgtgcacacacagtctgagtctgaaaacatctatcgtagaggacgagtactaccattttgtggctcagtaagcaaaaatgaaattaagttttcaattttttcaaatcatttgtagtctttcaacactttgcacatgatgtatcacgaagctacagcttgccatgtgactggagatttagtagaacttctgtcaatatttctttcggttttgaagtctacacgcccttatcttcagagaaaaggtttgctcattcctacttcttatgttttgttcgtgctactagtaaagagagagaaggttttaaaatcatgtgccccagagaaattgtttttatcctagtttatgcacagaagatgaggctgaagctagctaaccatcaggaaatgtttgtcatgaactcctgatgtaaagctggaaggctcttttatgtttttgtacctgcctgaaaaatacgcaagcaggtatcaagatttcagagattggaaaacatttccaaacacagtaacaagctgggcactttgtaaagattctccagctggaaacttctttggcttagattagatcatttgcagtttcatgcgagatgactataaaacctacctgtcttatgtccctataagatactgtgaac

SEQ ID NO: 25838 - DNA, 1031 bp, Homo sapiens
ctgttaattaaaaagtcaaacctagatctcatcaagtctggatctgactaccagtttatagaaaatgcagggacagagaaacatgttaagacagcaccataaggatacaatcagcaaagtgtaaatgtgagagaaactacaggacaaatgaccttcaacagataaattgcaaacacaaagctggtggggaaaccaatagattaaaatatttaagagacttttcaactaattatggcaaaaggctttatttgaatcctgattcaaacaagttaattttaaaaatctttttagaaacttcaggaaatgtgtacgctggatattgtatgacagtgcggaattattcatttaggcatgaataatggtaccgtggttgtttttgaaacctatctgttaaagatactatgatttatggattaaatgataaaatgcctggaatttgcttcagaataattcatattgagtggatgggggttcaaatgaaacaagactggctctgattttggtaaatttgaagctgactgatggaatacttgtactattctgttttttaatatagctgaaatttttataagttataaaagaaatatgcaatctaggtgtagtggcttgtgcctgaatcctggttacatagaaggatcccctgagcctagtaattcaaggctgcagtgagctgcgatcacatcactgcattcccgcctgggcaacagaagtagactccatctctaaaaagaaggaaagaaaaaaaggaagaaatatacagtaattttaaactgggagatgaaatgctaatttctagaagtccatttggttttgaagggtctcatgtcaaaaaaaaaaaaaagtaagtaaaataagacccatcctactgttttatatactaaaatagtaagttaattaaatgaaaatgaagtacatttgggctttcatttaccaatcctggaatgttgaaaagttgcccaaaagacatttagcaagcaaatgtagctagcaaaaaatcattttatgatggcaggttaatacaattataattg

SEQ ID NO: 25839 - DNA, 1030 bp, Homo sapiens
taattttatagtaattatatgctgaacagatctctgttttagtccatatcttgacttcaatttgattataagctgctaaacagcagagccatattacttgcagtcttccataaagctggcaaaaataactaatgtatactcttagcttgtggacgcctattattccacaagactttcaaagttatgagaggtaataatttgtaataagaataatacctactttatagattcattttaatacttgagtgaggtggaatatgtgtaataagtaccttgcatgaatatggatctttcctataaggcttggtgttcaatactaaatctctaatgtgtgagtctagccagattcctgaatttgacttattgatagttgaatatttagacagttttcaaagatcctggctggtattcctcttcagtgtgaagaatatactgttccagaaagagtaaagatatgaataaatgatgatgagatgtcattggttaatatttcaaatgtatttttttaatgtgtaggtttacttgtggaagacaactttgattgcacctgaagtgtttttcattcttgcattcttggaaatcatcagcattgtaccaaataagtgttaacctagaaagtgatttttaaaattctctcttcggtttccttataagatagtaatagctgtatttatgtaacaaagcattacaatttttaatgctataattactaaagaattgaatgtgttggtgtttttcttttatatagccaaaagaatgaaaacagatacagtgtacattgcaagactttctttgctagaatgcctaatttactaccatcatgtctgtgtttttaatggtgttttctcttgattttcagtattcagaggatatgaagcacaagaccactcttctggagcttcagaaaatgtttacatatttaatggtatgtttaagaatcatggaggctaggccaggcactgtggctcatgcctgtaattatagcattttgggaggccaaggtgggtggatggcttgagttcaagagctt

SEQ ID NO: 25840 - DNA, 1057 bp, Homo sapiens
attcttaagatgaacacttcagttaattatattattcccttttctgatgctcacatgaagtttaaagaaagctacatatattctaattgtggtaaaatatatgcaacattaaattcatcattttaaccatttatacatatatacagttgatgggattaaatacattcacattattttgcagccatcaccaccattccatcttgaactttttcaccttcccaacagaaacttgttaaacacttaactctccattctccctcccaaccccccttgcaaccactattctactttccatctctatgcattcaactgtttcaggtacctcatataagtggagtcagatttgtctttttgtgactggctgtgagtggcttatttcacttaggatatcttcaagggttatccatgctgttgtatgtgtcagaagttctttcctttttaaggctgaattataatttattgtatttaccacattttatttattctttcacttatcagtggatacttgggttgctttcaccttttggctgttgtgaataatgctgttacggacatgggtgtacaaacatgtttgagttcctgcttttactacttttgggtgtatacccagaagtggaattgttggatcatatgggaattgtgtgtttagttttttgaggaatagccttaccttttccatagggcttacaccgttttgcatgcataagggtttaatttctcgacgtccttgctaacacttgacattttctgtttgttttaataatagccatcctaatggatgtgaacacaattttttaagtagtaaatacatatagatgcaggctatgtatttatttaaaaattgcgcattaagtaaaattcccttgttgttgcttgactttaataaatttaggcagctctttagccaactcatacttcattctctaataataaaaatataaatccaggtctttattcctgaacttttttgtatcctgaatcaatactttgatacgttggaaaatttcattttgtgtgacttttttcgtaatatggaatattaagcctctcatataac

SEQ ID NO: 25841 - DNA, 1043 bp, Homo sapiens
aaaggagacatacatgcggccaataagcatatgaaaaaatgctcagtattactcatcattagagaaatacaaaactaaaccacagtgagataacatctcaaaccagtcagaatagctgttaataaaaagtcaaaaaataactgatgctggcgatgttgtaaagaaaagggaatgcatatacactgctgatggaaatgtaaattagttcagccattgtgagaagcagcttggcaatttctgaaagaactttaaacagaattactattcggctcagctattccattgggtatatacccaaaggaatataaatcatcctaccatgaagacacatccacaagcatgtttaccacagcagtgttcacactagcaaaaacatggaatcaacctacatgcccatcaacagtggactagataaagaaaatgtggtacatatacagcatagaacactatgcagccataaaaaaagaacaagaccatgtcttttgcaaaaacatgtatggaactggaggccattatcctaagtgaactaacatagcaacagggaaccaaataccatatgttctcacttataagtgggagctaaatattgagtacatatggacacacaggaacaatggacgttgtgtcctacctgagggtggagtgtgggaagaggaacaggattgaaaaactacctattggtactattattacctgggtgatagaacaatctatataccaaacttacgtgacacacggtttacctatataacctgcatatgtacccctgaacctaaaataagagtaaacagtaaaaaaaaaaaggagacctgtgtacatatatttctatatctatctatctatctatctatctatatatatatatatatttttttttttttttttttttttttttttgacgaagtcttgctttgttacccaagctagagtgcagtggcgcgatcttggctcactgcaacctctgcctcctgggttccggcagttctcctgcctcagcctcccgaatagctgggattacaggcacctggctaatttttgtattt

SEQ ID NO: 25842 - DNA, 1050 bp, Homo sapiens
cctttctgtgggtatcaagagtctcagtcttactgtgctatctcttttctgcacagtactccaggaggttttatactgcagaccaatgtaccatagtactatttgggatgtgtgagggtgataacttggtaaaatagcaaaggaccaattagaaaagaataagtggaaaagataacccagcacccactttctcagacagacttaattttggaaaaagtacaacagtactacctttcaacagtataagtaaactgttgattttgccactgttattgttgctattatttattagtagagtgaagtaaggggaaagttaatgcagaagcgccagtcagacttgtcaagggaataatgaggccttaacaaaaactttacatcacttaatggaatagaaaataacaacattgtacgtgaagagtctaagaatgagcttattaggtatcaaaaaggagagaagagtaaaagttgatcgccgccttcgttttctcttaagagaaatgaacacggaggactttcagatgatggtatatcatgctgctatacgtttttgagtagcttaattgtagcctgtcatcctgtgtatatgttaactatatttggaatgtaattaatatctcagtttagataacatgtttccttttactccccaggaatttttgagagatatcttcaatctcctgtttttgttgccaagtctaaaggaccgacaacagccaaagtgcaaatcacattcttcaagagctgccgcttacgatttgttagtagagatggtaaaggggtctgttgagaactacaggctaatacacaactgggttatggcacaacacatgcagtgtaagcattcttcttttcctttaatctttatagattttgaattcagaaataagattttgagggcactgtttaacaaaagaatctgctcttcacacactttaacattataaatgattattggtagggtgttattaaagttaaaaagtaaacattgatgtgaaggacctttttatatgcattttaaatacttcggctttttctgtaaaagtaatttgg

SEQ ID NO: 25843 - DNA, 1028 bp, Homo sapiens
aagcttcacccaggttggagtgcagtggtgcgatctcggtccactgcaacctctgccttccaggttccagcgattcccctgcctcagcctcccaaagagtagctgggattacaggcgtgtgtcaccacacccagctaaatttttgttgttgttgttttgttttgtttttgtagaggcgggttttcaccatgttggccatgctggtctcgaattcctgacctcagatgatccgcccaccttagcctcccagtgtgctgggattacaggcatgagccaccgcgcctggccagatacagcttttttaatggatatcttttgtagaaaagtaagggaaacatttaactcataggaaagaatatgagtaaaaattaagtcataggaaagcaatggtttcatgcagaaaattggttggttcagtttagcctatgttttaggaagtataggagaaacttggtggccatctattgtgggcacaggaaattatttttatatataaaatgaaagcattattgtcttagtctgttcaggctgctgtaataaaatattgtaaactgggccaggcgcagtggctcatgtctgtaatcccagcacattgggaggccaaggcagctggattgcttgagctcaggagtttgagaccagcctggccaatgtggtgaaacccagtctctactaaaaatacaaaaattagccaggcatggcggtgcatacccgtaatcacagctactcgggaggctgaggcacgagaatcccttgaaccagggaggtggaggctgcagtgagccgagatcgtgccactacactccagcctggcaacaaagcaagacactctcaaaaataaataaaataaaatattgtatactgggtagcttataacaacagaaatttacttttcacaattctggaggctgggagtagtacaagatcaaaactctggcagattcacagtgtcttgtgaaggcctactttttgattcacggagtcttgtgaaggcctactttttgattcacggatggcaccttctcatg

SEQ ID NO: 25844 - DNA, 1058 bp, Homo sapiens
gaatcagttcatctagttctttaaaaaaataaaattgtgttacttttttggttgagattgtattatatttccagattgatgcagaattaactttatgatactcaatttgcctgtggaagagtatgatttgttgtatttatgcaaagccaatcgttttatgttttttatttagaagattctttttcctacaaaatttaggttttaagtatttcttagtaagtttattcttaggagttttgtcctttttgttggtatgttgatatggaatcattgcttatgttttttaacttgtcatttatgtgtagtaagaatttgtgtatacagttgttgcaggccatctgaaattgacttattgttggtagactgttttcagttatctttagctgttagtgttctttggttcttcatttgtttttggtttattatctgcaagtaattcttgtttttcttttattttccccaagcagactcatgtcacaatcatctgcaagtaattctattacttcctgttttacaagtttaactctttccatttcttcaccaaattttttctgaaacattcagaataatgttaagttagttgttcttagcattctttattgaaaaggtcttcatgttcatgtcaaattataatttccccttcgtttcagtgttaagggaaaactttagaagctttcatacaggagagatgtgatctgaattaacatttcagagggtttactcgtatgctagttggaaaattagtctgtgggcaaactcaaagggcaaatgtatgagtcaagggatccagttaggaagtttttcgatggttccagagagggacaatggtgaaaagtgctttgacgtggaatatttattgaaggtagagctcacaggtctcagatttggatatatatgttggatttgagagaggttaataaagaatgactcctaatttttttttttttttttttttgagatggggtctccctctgtcacccaggctggagtgcagtggcatgatcttggctcactgcaagctctgcctcccaggttcacaccattctcccgctgcagcc

SEQ ID NO: 25845 - DNA, 1040 bp, Homo sapiens
tcttttgcaaaaattagctgagtgtggtggcacatgcttgtagtcccagctattgggaggctgaggtgggagggttgcttgagcctggaaggtcaaggctgcagtgagccatgatcatgccactgcactccagcctgggcaacagagtgagaccctgtctcctgtcttttaaaacacacacacactcacactctctctcactctcactctcactctcactcacacacccactgctttccttttttgggggggaagtgataaccttaaaggatatatgttaataaattgaattatttttaattcattgctgaatttaattggtggtggtggtgtttttactttacagagttttaaaagctcagtctgatcacaggtctagacatgaaggtaagggttccacaaagttaacttttaataaataaaaacttgaataatatattgatatattttacctttaatattgaacattgtgttttcattttagcacaaaccttttatagtgaactgttttctaatttttctttagtttcacattattcaatgtggctcttggtgagttgggctcattgctgttctttagtgaaatctagccttgctgatagcgatcatttacaagattggctaaagaaattgactctccttattcctgaggtaagataaagattgaaggttagtactgttattttttgtatgttttcatgttattagcattgataataaaagagctaatggaaacaaatatgcgtgagtccataaatatatcacattatctgcttaatcctttaaggtctagagtgttttgaactatgtacaatgtttaagaacttctgactattatatattatgtagcatttatatttttctgaaatgtttatagaatgattattttgctttggattaataaaaaaaagtttttccaggtagtaggaagggcttgagaatttattttggtaatttatgttttagaaaagttctgtggccttttttttttctttctttgagacagaatctccctgttccctgtatcacccaggctagag

SEQ ID NO: 25846 - DNA, 1030 bp, Homo sapiens
tgttacgatattctggctgggccgtggtggctcatggctgtaatcccagcactttggggggccgaggcaggcggatcaccggaggtcaagagttcaagaccagcctggccaacatggagaaacccgtctctactaaaaatacaaaaattagttaagtgtgatggtgcacgcctgtagtcccagctattcaggaggccgagactggagaattgcttgaacccaggaggcggaggttgcagtgagctgagattgagccactgcactccagcctgggtgacagagtgacactccgtctcaaaaaaaaaaacttacaataatatgaggtctttgtaaaatgtgagaataaaacttttggagataagcgaacatctgagtaaattgaaatagcatgtctctgtacagaatattgtaaagatgttaggtaaatttattttttaaaatgttctatcagtaattccaatgtaatttttgtttaaaatttgatgaaattactgtgaagttatctgtatgaataaactaagcaatattataagttctgggaggtcagtaaattggcactttatgaaaaaagaaaaaacaaaaaagtcctgggagaaaaattcaaaaggataatagaaagttgaacttccgtactagctgtataaacattaaaccataatttgattttggtatgggaattgttagttaaatgatatagaatggatactgaaaattagtcatatatgacttgttcagtttggggaaagaaaaacccctttttctaatatttaggatatgtttaaaatgttgtatctgtgttaacaatggtaggaaaatttagaagaaaataggattgaacgtttgtcaaaccattttgagggccaagattgagggctagaaataatgagaaagggaaagaatcatagatttagctacacaatgattagcaatttacttataaaaaaattgtgcttaaggcaaattgccaatatgactcgtcttggaagaaaaacatattccttctgtgtttgaaatatttttccacaaacct

SEQ ID NO: 25847 - DNA, 1025 bp, Homo sapiens
tcttccagaggtagaacttttatgtgaaatcgaccccatgttttggtaataagtctagagaaagttgtctaccacaaacaatacattaagaagatgtgttgtatgctttattctaaataagcttttggagagatttcggagacatttgaattttagggaaaattcgacttgttgaaggattcatttgtgagatcaagttctcaattctaagcttaggtggtaagaacacttgcttgctttcacagtggagtatcacttttatagttcttggaagtctgcactataattccagattagatgaagttaattcttctgagtcatataccttgcttctaattgttcttttaaagggaatatgtttaatctggacctttattattatttagaagtatcttagtctctttctttggttaatactacagtaagaatccagtgaaggttctgtttttgcaaggaaggtccttcagcttccaaaaggaggggtaagggaaagcatttaacatcactgaagaacaagaatagtgtgagccatttttcattgcctctttctataatttttaagtggctgaatttcaaaattctaatgcagtaaaggcagtcatttggtgctaacacgggcgagcaggtgtcattatagtcagtggaggtggttcatattaaggagtaactttcttgtatagaaggggcagtctctgaatattcagttacttaatcaagtacccgaacctaaatatattgagttgaaactcttttagcttgttccttaaattaaatgtaaataagcttaattaaggaaaattcacagggtttccattaccacaagagattggtatcctaaatctcataaactacatcacttaaaagaactcctgtggttatttgacatcagtaacaacaaaagctgtcatttattgtgagtctagtatgtatagcagcacttaatatttagtacatattatctcttaaactcgttctaatggcccatagtttaaaattggaaacttacccttgattcttctaataaa

SEQ ID NO: 25848 - DNA, 1051 bp, Homo sapiens
gaaatcgcctggtgcggtggctcacatctgtaatcccagaactttgggaggccgagacaggtggatcatctgaggtcagcatctcgaggccagcctggccaacatggtgaaaccccgttggtactaaaaatacaaaaatcagctgggtgtgatggcgggcacctgtcgtcccagctactcgggacgctgaggcaggagaatcacttgaacctgagaggcggggaggttgcagtgagccaagatcataccactccactccagcctgggcaacacagcgagactgcatctcaaaaaaaaaaaaaaaaaaaaaaagaaagacctgagtctgggtagtttataaacaaaagtggtttattttggctcacagttgtgcaggttgtgcaagaagcatagtgccagcatctgcttctggtgagggccacaggaagcttacaatcatggtagaatgtgaagggggagcaggggtctcatggcagaagtggaaacggggggttggaggggtgtcactctcttctaaacaaccagatcttatctgaactcaatgtaagaattcacactatggtgaggacagcatgaagacattcatgagggatctgctctcttgacccaaacgccttctactagactcacctccaacactggaggtcacatttcaacatgagatttggaggggacaaaacattcaaactgtatcaaactgctttatcacaaagttaaatatatacctaccatatgacccagcagtttttttgccttaggtttttactcaagagaagtgaaaacatgtctgtgaaaagatttgttcatgtgtgctgctttattcagaaggccttccaactggaattaactgataaattcacatagtggaattttgctcatcagtagaaaggaaagaactacagacacatccaacatcatggatgaatattgaaaacatcattctgagcaaaagaagctagaaatagaagaaagtacatactgtgtattacttatgtgcagttctagaacagtcaaaagtaatttgtaaggaaagaaagctcctcaatcattg

SEQ ID NO: 25849 - DNA, 1079 bp, Homo sapiens
tattcagcggggaaagaaaatatatagcaataatatgtaataattaaagctctatattttagaaaatatatggttgtattagaatttatactcagaaatcctaggacctaaaagtataggaaatcacaaaagataaaattgtatgattccatttatatgatatgtctagaataggcaaatctgcaggcagaaggttagtggttgcttggggttagggaagggtaggagggaataaggaggggcgagtgtgagaaatgattgttcaagtctaaatcactcttaaagtaataggacatgaccagacttgaaagaatggaggatggaggaaggtaaagagtagtagggaattaatgagtaaagcaagaaaaaataagaaagtgaaaaacagttttagaattggcagtttaaaggccttaaacctcttgtttggttggtatcatcaacatatgctggcctagtaaatgggttttggatagccagtacattataagtaaaccggatggattacgtttatgcaaagaggccataaacacacttagaaacacaacttgtggaccttggcaacaatttactgatttgtatgtgttttttgtacatgatctgtctaggttaagttactttgacttattttattgttgtgctgttgtggttgttgagaaaggaataggttagattgaggtcatctgactgaatgtgatgccatatttgtaaattgttaccattcttttctcaaattttcctttaatcaatattttacctattttttactgcgtggagttagaaattgaacaaaatggttttcttttcacaacccattgtagacagaataaaatgatagtatatgttaatgctttccaaatctaccttgttttacaatgtttttagtactagaagacctcctccaacagagtaagacagtcagtttaaaaatgggcaaaagtgttgatcagatactacataaaagatgatacatagaaatggtcaataagggctgggcatggtggctcacacctataatcccagcactttggaaggctgaggtgggcagatcacttgaggtcaggagttcgagactagtc

SEQ ID NO: 25850 - DNA, 1070 bp, Homo sapiens
cccaacaaggtttcaataatatacttaattatcaaaattaagtatattatggaaatttcattatattaatggttaaattggcagaaaattggaagtttattatgtattacatatagtgtatagtttagtatatacatatactatatatataaacatgtatatatgtgtttttatcatattttaagtagaaaaaccatgtaagagttacttgttggcaaaaagtagagaaaactgttagtacaaattgagaattcctaatccaaaactctaaaatttgaactgctacaaagtttgagatctgagtgccaacatggtgctcaaagaagtactcattggaacatttaagattttggattattgaattagagatcttcaactggtaagtatataatgcagatactccaaagtgtggaaaaatccaaaacctgaaacacttctgcttccaagcatttcagataggggatacttaacttgcatattttaatctgtaatgttatttaatactatatttaaattaacattcttagtcaagacctgtaaaagtggtaaacttactgagtattcacttgtccttaaaatcaaatactgtttgtagtattgaagtactgccattgttttttaaatggatacttagtggtgttaaagtaaatagcagtagaagcagatagtgtaatttataagaagcctcaccaagatagaagaattcctgcagtattatgttttcttacatgtatttcaccttatatttcagtattaggttgtgcatatttaccctgaaagagaagcagcagaagagaattcatatgtgtatgcctacaaaatataaaaatcagtatttttgagtaaaatctatattttaatagatttttttatgtattaaaagtaggaaactttgcatttgacagccctcaaattgggaattacttgtctaatcttctgtttattaccctatcttgatttagtagttagcagcttcatggctgtaaaatacttttattttacatgacataatatttagtgtttatatcttcataaatattgtccctcatgaatttacatgtttgtgttta

SEQ ID NO: 25851 - DNA, 1084 bp, Homo sapiens
acattaaattacatgatctttgccaacctgatgggtgaaaagtgatatcattggtattttaaatttgcgtttcttttatcatgagtgagtttgcaaatcttgtgtttaagagccattttgttgctttttctggaattgttcatattttttgctatttatcaattgtttttcttattttttttatttgtaggagttctttatgtgtcactgaagttgatcttttgtttgtgattacaacttattactgtatcctggtttgatgcctttttgctttgcttaaggtggtttttactgttcagtttcatatttgtggttgtagtttttatggtctgtagattttgtatcttggtttgaaatgccttctccattcacaacattataagagaattctcctttagtttctccctatacattttctattgcaattatatatcttaatctttgatccagctgggatttatgttggtttaaagtgttatgtatgtgtccaactttcctcccttttttgttgtgcaatttttccaattccatttgtttactaactcttctttctgacttgatataccaattttttcttgactgggtaattttttgaactttctagactgacctatttgtgtgtataattatgatctataccagggattggtaaacttatagtctgtgggccagctatctgtttttggaaattcttgctacacagacatgcccattcttcttttttttttttgagatggagtcttgctctgtcacccaggctggagtgcagtggcgtgatcttggctcacagcaacctctgcctcccgggttcaaaggattctcctgcctcagcctcctcactagctgggattacaggcacgcgccaccacgcccagctaatttttgtgtttttagtagagaccgggtttcaccatgttggccaagatggtctcaatctcttaacctcataatccttccgccttggcctcacaaagtgctggtattacaggcgtgagccaatgggcccggcctgacgtgcccattcttttacatattgtccatggtggcttccacagcacaacagcagagttcagtaatcataaca

SEQ ID NO: 25852 - DNA, 1066 bp, Homo sapiens
gtacttaatgacagggatacattctgagaaatgcatcatgaggtgacttcattgtacaaagttacacaaacctaggtggtataacctgttgctgcttgactccaagcctgtacagcatcttactgtacttaattctgtgggcatttgtaacactttgtaaatatttgtgtatctaaacatatctaactgtagaaaaaataatgtaaaaaacctgcaaaaaagataaaatagggtattgcctgtataggacgcttaccaagaatggagcttgcaggactggaagttgctctgggtgagttggtgagtgatcgctgagaagatgtgaaggcctaggatgtgactctacactactgtagactttgtaagcactgtacacttaggctatacaaattatttaaaaatttttttcttcactattaaattaaccttagcttactctaactttttatttacttttataaacttaaaattttttaacgttttgactcttataataacatttaaaacacaaacacgttgtatggctgtacaaaagtattttttctttatattcttattctgtgagctgttttctttcctttttttttttttaactttttaataatacacatggagctgtcatctcccatgctgactgtgcctttttttaaaaaaactagaaagagtatcctttaaagatgaaaagtataataaatacataaaccagcaacagtcatttattaagtattatatactgtatgtacatgctatacttttatatgactggcagtgcagtagatttgtttacatcagcatcaccacaaacctgtgagtaatgcattgctctatgacatggtggccacagtgacattaggtgataggaattgttcaagtcacttttaatcttatgggaccactgttgtatatttggtccatcctttggtctgccattgaccaaatcattattatgcagtacatgactgtctgttacttcacttttcatctattgaatcttcaatagtatcagccaggagacttacagtttggcttggggataattcttttgttgttcatccttttgacaacc

SEQ ID NO: 25853 - DNA, 1067 bp, Homo sapiens
tttgtctctgtactttattcctttttattgcttaatagtatcacattgtatagatataccacacttgatcaagtaccagttgatggatatttggattgtttctacttttttttttttttttttttttttttgagacagagtcttggtctgtcacccaggctggagtgcagtggcgcgatcttggctcactgcaagctccgcctcccagattcacgccattctcctgcttcagcctcccgagtagctgggactacaggcacccgccaccacttccggctaattttttgtatttttagtagagacggggtttcactgtgttagccaggatggactcgatctcctgacctcgtgatccgcctgccttggcctcccaaagtgctgggattacaggcgtgagccaccgcgccccgcctgtttctactttttgattaatataaataatgccattataaacatttatgtaaagtccttttgtgatcatatgttttcatttttcatggtagatacttaggattagaattgttgcttatatgattagtttacctttaactttcattggagctgtcaaactgttttccagtatacctgcattattttacatccccactagcattgtaggaggtttccagtttctccctattcttgccagcagttgttattatctagatttattattgccatttagggggtgtaaagtagcatttcatcatggttttaatttgcatttccctaattattaatgatgtagagcagctttttatgtggttatttgccataatgtttcttcattcacaatattgtccagtttttaattggattcttggttgtgttttatggcttaatgtggtctgtactacagactgttctgtgtgtgcctaagaagactgtacattctgctgttgtcgtatggggtattctgtggggtgttctatagatgtctattaggtcaaattggtttgtagtgttgttgtctgtttcctatattcttgttgcattttctgcctagttcttctctattattgaaagtaggagactgagtgcagtggctcatgcctgtaatcccagca

SEQ ID NO: 25854 - DNA, 1235 bp, Homo sapiens
ccttcctcagccctcagctctttgccagagtttgtcatttcatacataacaccttttattaatttataaagaatccaatagagacaaggggtttattttattatggagtagaaagaagtgcaaatgaggattaataaaaagaacttcacacaaaatatgctttagtcaaaggtataagcttgtagggcttaagtaacgtataggggaacacaatagcaatttctgaatgttcagtgtcctaagactgctttttacaaatatactagcaaagactgtttaatatcagaaactagggtaggattacatattttttgatatctctttactagataggagaataggaaattaagttttcatgatgccactttgcactttgtcagaactaggtttgatgcagaacgctgtttttctgcagttacagggagcaaggaactttttttttctttttttccctatttctgagagttttaacctaggttaaaaggttaggagggctgctagaattccattagcactaagcagggggtggggagaaggaaacctgaaaagctcaaaacttaaaaaaaaatgataaaggacacactgtaggattaatagcatatgcaatttggtttttatgatgttgggatctatagtagtgttaaagaatgctgatttttataatgatataatcctaggtttgaattgtacctctgttgcatagtatgtaattttgttttcattacttttataagcattacttttctcatttatcacaatgggaatattaaggacttagtaaatggtagatcttccttgtattaaaattttttcttgtattgacatttttcttcatttgctgttttttaattgaaatttttaatcacttgtgtctgtgtattctaaaataaaagatataactatgccctctgatgtatcttgtataaaataggatttttaaccttctgttaaaatttgaaaaataacattcataaagaaacgtacacaaagtgataacatgtggctcagtgatttatcaaagcaaatattcgtttaaccatcactcaaaccaagaaacagaacattgtcaactccccagaagcctaccttatgagtcctcaggccactaactattccatctcttctcctttaaaaataaacacaattcatcctttaatgctgatcattctcctgctttttttaaacaaagttttatcacctaatcttatatccctaaacactacaatttggttttg

SEQ ID NO: 25855 - DNA, 1033 bp, Homo sapiens
taaattaatatattttttgaacaccgtaatactataatactatataatctgtttgttaattttctgagaataataactcaatggagtaactctttaataggcatcttttccttataaaaaatattgtagattggctctctgcaagctaatttcttttatatggttaatattttagtgtacattaagagcttagagttctttttgtaatcaagcttgctacagaagctgtgctttatttatttcatagtaatttcctctagtgggtcattgtataaaccctgatcatttttgtatgtctattccttttcttgcgaagtgggcagcttgtttagccatggtgttttggcttcaatagggtgaggtctctatttgggaatctctgaatttcacaggaatgagtagaactatatttaacaatgaaaaaaatagtattagattttagggcagccgtttgtaaagaaaagaaaataactcataaatcacttttgtggcaggaaagatacggactaacgttactgaatacttctttttctctattatactaaatcacacattcagaagagaacatgtttatagcatttcctgggactcaggaaatgatcccattctgtttattttctagtatgatttcctcctcacttaaagaaaaagctatatatttattttgagactggctaatttttgtgtttctggtagaggtagtgtttcaccatgttccccaggctggtcttgaactcctgggctcaaatgatccgcccgccttggcctcctaaagtgctgggattacaggtgtgtgccattgcacctggctgatttcctcactcttactgaggcaaggtaactttgtcagatggtgagtgttattttttcgttttttttttgagctggagtctcgctctgtcaccaggctggagtgcagtggtatgatccctgctcacctcagcctccgcctcccagattcaagcgattctcctgccttagcttcccgagtagctgggactacaggcacgcaccaccatgcccagctaatttt

SEQ ID NO: 25856 - DNA, 1044 bp, Homo sapiens
ggacttagatatgtgaaattcacagaaattttttccaattaaaaatttcttaatgatatagaactatataagtaatactgagtctgctgcttctaaaataaacttgctcatcagtgttttttctttcctgttttcaaaaatggtaatctctaaatgtaggcatagttacactcctgtactttgttttaaagtactttgttattattattcgtgagtattttatgttactacttggttgaaagcagtggttttttgaggtcttcgaggaaaattctgacaaaaaatacccatagagataataaaggagttacctccttataccaaattctattaatatattagatatgtgcctctttaattttcttttcgtaatagttgtttccgaggtttctattatcttaataatgatctgttacaagtgctctaaaatttctagtttctatcccagtggccatttaattaaatgcggtaagggtcaactgtttcaaatggtcttagatcaaagacttggtagcatacatgttataaaattatatatatgtataaattttgtatgtatatacacacaattattttaaagcaaacaaattattatgaaatgtaatacagcttactagagatttttatcccacttttctttgaggaaattgtccatctagtcttttctttgtgctgctgtgctatcctttcttaagcctttgattttgatttttcgttaatattttttaaagaggcacaacttagccaaaattcttaggaggacaagattcaaaactcatgtgttagtattttgatagctgtgtctttagaaacctactcaacacttttattttatagaagaagcaactggcctacagaggttaaaagatttgattgggcatattgctgagaagagtcctagaatccgggtcttactctactgcactacttctaaatcattttgaactaattactgtattctaaataatatgggaacttggagccactccttctgtctcccttccttcttctctttcctattgtccccatcaaagctgatatttt

SEQ ID NO: 25857 - DNA, 1024 bp, Homo sapiens
tccacccgccttggcctcccaaagtgctaggattacaggcgtgagccactcactcggcctcttttgtttttttatttttttattttaatttttttgagactgagtctcactgtattgccaggatggagtgcaatggcgcgatcttggctcactgcagcctccgccttccaggttcaggcaattctgcctcagcctcctgagtatctggagctacaggcacatgccaccacacccagctaatttttgtatttttagtagagtcagggtttcaccgtgttggccaggatggtctcaatctcctgacctcctgatctgcccgcctcagccttccaaagtgctgggattacaggcatgagccaccgcgcccggcctccttgatactcttaattactctccctgaaagcttttagaatctttatccctcctcagcttcagaaattttgtctgttttggtgggccttttggttgtgaaaattttatttcataatttccttacctccatatttattgctctcacttcttggaactatgttagtcagatattgtacccttcttgattacttccttttcatattctctcttttttttttttttttttgagatgggattgctgtgttgctaaggttggagtgcagtggcgttatgatggctcactgcggcctcgacttcctgggctcaagtgattctcccacctctgcctcccaagtagctgggaccacaggcatgtgccactatgctcagctaatatatttttttattgtagaaaggaggtctcgcgatgttgcccaggttggtcttgaactcctgggttcaagcagtcatcccaccttagcctactaaagtgctgggattacaggtgtgagccactgcaccaggccttttctctccattattaatatttttttctattttgtgggagatttcatttttcccttttgtggaccttttgttgaattttacaaattgctataattttaattggtttttaaactgtaaatgatatatatacaaaaggtatatgata

SEQ ID NO: 25858 - DNA, 1441 bp, Homo sapiens
aagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacatttatttttcctttattgactcatttattcctatattaatgatagtgggtatttgtgtttaagcatcaagtaacattttaaatgaagttggaccccttgatttacaaacaagatttctaaggttattgttcctagtaaatgcagcagttgtgtaaaatgaacatgttcctaagataccttttgttctcaagaaacaaattcctcctgtggcattttgactcattttacctttatttgggattagagggcacttcttgtctaactctacttagcatctaaatgtaacaaagaataaacattagccttggaatgagaacacagatgtaacctggtacaaatactaattgtattcttaaaaaatgtaagtaaactaagtagccatgagccttctcaaaagggtgagtggagccaggcttggtagctcacacctgtaatccctgccctttgggaggccaaggtgggcggatcacttgaggccaaga

SEQ ID NO: 25859 - DNA, 1027 bp, Homo sapiens
gtgatttctgagattttggtgcacctgtcatgtgagcagtatgaactctactttatgtgtagtcttatccctcatgtgtatgaactccaccttatgtgtagtcttatccctcacccactcctgcccttccccacaagtccccaaagtccattatatgatctttatgcctttacatcttcacagtttagctctcacacaacttattataatttataagtaagccagcattggatatagttgtattccattattaatttaagaaaccttatgcaagtaattattagtcatcatcccaaaaaaaagggagaacagggttagattcagaatactttgataagagctaaatactatcatgagtgctgtcagtctgtagtaactttccattggtattctatgtcttttaggcttacagatactttttacactcttacaaaatgttgcacaagaagaagctgcagctcagagtttttatcaaacttatttttgtgatattctccagcatatcttttctgttgtgacagacacttcacatactgctggtaagaatttaatacgatttaaatgttaagtgccagctgggcacagggcctcacgcctataatcccagcactttgggaggtcgaggcggggagattatgaggtcaggagttcgagaacagcctggccaccatggtgaaactgtctgtactaaaaataccataaaaaaataaaagatacaataaaaatactgggcatggtggcatgtgattgcaatcccacctattcgggaggctgaggcaggagaatggcttggaccgaggaggcagaggttgcagtgaactaagattgcgccacggcattccagcttgggtgacagagcgagactccgtctaaaaaaaaaaaacaaaacaaaaaaaaacgctaagatctatagttatattacattttggagttaataattttcttcttatcaacaggtttaacaatgcatgcatcaattcttgcatatatgtttaatttggttgaagaaggaaaaataagtacatca

SEQ ID NO: 25860 - DNA, 1107 bp, Homo sapiens
gatgttatttctgcttgtgaaaatactcaccagttagcattcattagattaaaacattagtctgagttgggtggatcacgaggtcaggaaatcaagaccatcctggctaacacggtgaaacaccccgtctctactaaaaatataaaaaattagctgggcgtggtggcaggtgcctgtactcccagctactcgataggctgaggcaggagaatggcgtgaacctggaggcggagcttgcagtgagccaagatggcaccactgcactccagcctgggcgacagagcaagactccgtctcaaaaataaaaagacagtattgagggctcgcttgctgccatcttacatatacagtatacgtagaatcctgattctgccacctaagttggagacacccactgaattttgagcctcacttttcttattgtgagagttttgtagctgggcatggtgctatacctatagtcccagctactcaggagactgaggcacaagaattgcttgaacctgggaggtggaggttgcagtgagcagagatttgccactgcactctggtctgagtgacagtgagactgtctcaaaaaaaaaaagtcttgaatgacagtgtgtccatgagacttcccaacccattgtgatttcctgctttcttttgctaaaaactgttttgacgtaggaaaccctaatacaaacacaagattttcctgttttcagtagatgatcatgctacatctcatagacaggaataaccttgttgtttaaaatagtcaccatgtacctaaattaaaacataacttttttttccctccccaacaggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggtgtgtaatatttcagttatgtaagggggaaattctgcaggatagccttaattcttgaaagctaaagtatgtctgtggatataacataattttaatgccatgg

SEQ ID NO: 25861 - DNA, 1250 bp, Homo sapiens
tttataaatctattctggggtggaaatacattttaggaaatgtacttgtagtttctaaatattttctaaatgtattgttactcatcaataaaattctgctcattatttgcatttgaaaccatgtttttctttgtagtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggtatgcaagggataggtatgaattagaattgctaaataagtattatgttgttacaataaataatacaaatttgtcttatttacaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatggtaaatctctttctttactatattttgcttttatttttattgaagaaaataaatgaatgtttttgtcttgttagagacccatgatggagtccaggacaaaataaatgaatatttttgtcttgttagagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggtatgttaagcactgagcatatgttatttttagaaagtaacacttgtatcaatctgtatgtatcaatggaaataggagggcaactattggatccaatagaagtgtttctgattaaattttctttcttttttccttgagacagggtcttactctgttgcccaggcttgagtgcagtggcacaattacggctcactgcagccttgaactcccaggctcaggtgatcctcccaccttggcctcgtgggtagctgggactacaggcatgcactgccatcacactcagctaacctttttcccccccttggtagagatggggttttgccaagtggcccaggctggtcttgaactcctagcttcaagcgatacgcttgcctcagcctcccaaaatgattttatatgt

SEQ ID NO: 25862 - DNA, 1050 bp, Homo sapiens
aaaagggtgttgggatattagggcttaaaaataatagtgttggctgagtgcaatagctcagacctttaatcccagcactttgggaggctaaggtgggaggattgcttgagccaggagtttgagaccagcctggacaacataacaagataccgtctctacaaaaatgttaaaaataagcttagtgcgatggcacatacctgtggttccagctactcgggaggggctgaggaggactgattgggcctaggaggtggaggctgcagtgagctttggtcataccactgcactccagcctggacagagtgataccttgtctcaaaaaaataataataaaatattaagtgtctttagttgttttataaaatgcgaactgatcgtcccttttaaaatttgcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggtaagatatgtggagcttttgctcctaaaattctgctctgcctactaataactcttaaaagtgcctttttctaaaatgtatgtaccttttgagatttcttattacttaatatttgatcagtacattatatatattctcaattctgaattacagttataagcccagttttctgattttatgttctccataaagctaggactaaaaatttataatcaaaattaaattactaattattatatcatttctaaggttaaaatttcaaagaccttattttaaaatttcagttttaattcaaataacatgcatttgttcatttaaagatatacaattcatcgtgtaatcccagcactttgggaggcggaggtgggtggatcacttgaggcaggagttcgagaccagcctggcctacatcgtgaatctctgtctctattaaaaatacaaaaaaattagctgtgcgtggtgtcacatgactgtaatcccagctcctcaggaggc

SEQ ID NO: 25863 - DNA, 1032 bp, Homo sapiens
atcctcctacctcggcctcccaaagtgctgggattacaggcacgagctaccacgcccagcctggccaggctgttctcagactcctggcctcaagtgatctgcccaccctggctccccacaaagtgctgggattacaggcatgagcaaccgcgcaaggcctcctagaataatttctacatatctatcaggcagatactaatacacagacagacccattagacggattggacctttcattaggataattgaaaagggtcctgcggtgattaagataaaagactttgtgttttgttttctacccagtagggtgaagagggtggcacatttcttcctttaataaaggaggagaaaatgaaaagtgatttatccttactcctgcctttatccattacataatttctttgaagtttgttttatttgcctttgagaaatgaagtgcgattaacatttcatgtcttgttttagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacaggcaagtaataattatgttttagaattttaaagtgatttctcaaacaatttcaagcagtttggatgtaaattgtagatattttaaggaactatgatcagtaatatgttaaattgcttgtagtggttttcaactgcagattaagaaatagtcctagacggggcctaataatttacctctgaaggttgaaaaatgaattgttcaagacacacttcaggaattgttttgtatggtaactagtttaataggttctaagcaaatgatttgtgtccaaacatacgtattagttattttattttattttgagacaagtcttgctctattgcctggggtggagtgcagcagcgcaatcttggctcaccacaacccccacctcctggattgaggt

SEQ ID NO: 25864 - DNA, 1051 bp, Homo sapiens
tactatgcagttgcaagtttatattgactatttgatattgctgtgtttttatttgaaatgggactgttagacacatttttctttatattgagcaatagagctggaatattaaagatgtatgcattaacccttgcatttggaacatttacatgtcataagctgcctttcagtaagtggttaggcatttctacgggtgtgtattatattttgaataaattttatatggctttccaagaaacaattagagcatttgacccaccgactttgttgtttatttttatttttttgagatggagcctcccgcagtagagatagagtttcactatgttggccaggctggtcttgaattccgcctcaggtgatccacgtgccttggcctcccaaagtgctgggattacaggtgtgagccaccatgcccaacctgacctaccaactttggatgtgaatttttttcatttatattgagaagaatagggtcttgggccactagattgtaccagtgctaagtcagtatctgaatccattgaagatcctgttggcaacgtcaggacttatcaaagacacacaacttcaatgagaacctttctttggaattaattaattaatgatatggagccttgatctgtcactcaggctggagtgcagtggcactatttcagctcactaggaatgcatctttctcttctctttctccacctcccaggtttaagcacttctcctgcctcagcctcccgagtagctgggactgcaggcacaagccaccatgctgagctaatttttgtatttttagcagagacaaggttttgccatgttggccaggctggtctcgaactcctggcctcacgtgatctgcccacctcagcctcccaaagtactgggattacaggcttgagccactgtgcccggctgccttgtttgatttttttttttaaagagacagagatcccctctgttgcccaggctgaagtgcagtgacacaatcatagctcgttgtaacttcagtctcctgggtgatgggtagaattctgccacagcccaagtagctaggagt

SEQ ID NO: 25865 - DNA, 1037 bp, Homo sapiens
gcttaactctagcctcaacttccggggctctagcaatcctcctgcgtcagtctcctgcataactgggactacgtgcgcatgaatcatacctggctcactgtttctattttttgtagagatggggtctcgctatgttgcctaggctggtcctgaactcctgggctcaagcgatcctctgcctcagcctcccaaagtgtttagattacagtcaagagctactgtgctcgacctgctttcaccttttggctatcatgagtgatgctcctgtcaattttaataaaattttaatcttttagattttttgtccagtgtgtttgaggccataaacatccatttaagaatggcggatgtgcatatagatccatttctcttaacattatcaaagcaggttaaattatagattatctgtgggaaccctaacttaactcctgctttagaattattgttagctgtttgtcttccatgtggcattgttcttattaatatttcattgagagaacagtagtaacaatatcctgtatacccttgtgtaagtaaagagagcagatcactattttattgaccatctttcaaaagatcgattttgtgtgtttttttgttttgttttgagatagtctcacattgtcgcccaggctgcttggattgcagtagtacaatcttggctcactgcaacctctgccttccgggttgaagcgattcttgtgcctcagcctccagagtagctggtactacaggtgtgcaccaccatgcctggctatttttttgtattttaatagacaggtttcaccatgttggcctggctggtctcaaactcctggcctcaagtgatccacccacctcggcctcccacagcgctaggattacaggcttgagccaccacatccagccaattttgatgttttcatggactgatacttgtaataaacatttcaattatatatagcattgatgtagaaatgtaccaaatttacatttttttagcttatggaataaataaatgtttaaactgaaattgattcgaaactagattgaacttg

SEQ ID NO: 25866 - DNA, 1052 bp, Homo sapiens
gttactcagaggtgattgtttcatttatgattttgaaaagaaaatgtaaatattagacttaagtccttgcatctaaaacaaattcatgagaaatcccacagaatacaatgttagagatgggagcaaaaattatcagtctaatctcagagagttgacaggcattccaaatcgttttttgtcagtatttaaaccatggtaggataatgtaagaaatatacttaatgcctggtgcgatgtctcacgcctgtaatcccagcactttgggaggcctaggcaggcaattgtctgaggtcaggagttcgagaccagtctggccaacatggtgaaaccccgtctctactaaaaatacaaaaaaaattagccgggcatggtggcgtgtgcctgtaatcccagaatcccagctactcggtaggttgcagcaggggagttgcttggaccagggaggtggaggctgcagtgagctgtgatcatgccactgcattccagcctgggcgacagagcaaggctccgtctcaaaaagaaaaaaaagaaaagaaaaagaaatatctgtaagctataaattatgtttttcatttctaaaaaaaacaaggcaggccaggcacagtgattgaggcctgcaatcccagcagtttgggaggctctcttgagcccagaaatttgagatcagccaggacaagatagttagacttctctctactaaaaatacagaaaactagcagtgtatggtcgagtgcccctgtagtttcagccactcaggaggctgaggcgggagaatcatttgagtccaggcaggaggtcgagccctgattgattgcaccactgcactccagcctgggcaacagagtgataatatctgaaaagataggctgggcacagtggctcttgcctgtaatcccaggactttgggaggctgaggcaggcagatcacctgaggttgggagttcgagatcagcctgaccaacatggtgaaaccccatctctactaaaaataacaaaaaaattagctgggcgtggtggcgcattcctgtaatccctgctactctgaaggctga

SEQ ID NO: 25867 - DNA, 1396 bp, Homo sapiens
tttgtgtgtgtgtgtgtgtgtgtgtgtgtgtgtgtgtggtttttttttttttttttagtagagatggggtttcaccgtgttagccaggatggtctcgatctcctgacctcgtgatccaccctcctcggcctcccaaagtgctgggattacaggcgtgagccaccgtgcccggccaggttggattttataagtagttgggccactaaaatttctgagttgtacagtttcatgtctttagttggcagaccaaagctgatccactcataaaattttatttagtgctctcctttgacgtgagacacgtggtatatttattggcaccgtaatactggctacattatttgacctcatatttcagtttgtgttgcaaggttttgggcattagagctaatgtataggaagccctgtgcttacatatgctgagtatgagtaagtagtgggttaccaactgtttttgatgaaatatctgcatttcaccaaattgccatataccagtctcaaaatatcctgaaccttctgaaataccttcctaagtgagctcactaacacctacttttctgtgtcctttacaattttttcaccacaaagtctcaaagtttcagaaacggaactaatagggtcacttctgctgaagatctcctgtagtattgaagatatttaacatgtttcctttaattgatattggcctttgagaatttttgtatttgccttatttattaggtttaaagtgtacagttggataagttttatcttgtgcatgctcctgtgaaactacctctgtataatcaagatctgcctctatccgattactttcaccttcactgcccctcttcacatgtgcttgttgtcacttgcttggtaagagtggaatggctggattgtgtggatttttttttttttttttttaagacagtcacactactctgtcgcccaggctggagtgcagtgtcatgatcttggctcattgcaacctctggctctcgggttcaagcgattcttgtgcctcagcctcccaagtaggtgggattacaagcatgcaccaccacaccagcataatttttgtttttgtaatagagtttcgccatattggcctggctggtctcaaactcccgacctcaggtgatctgtccacttcggcctctcacagtgctgagattatactcataagccactgcgcccagcccatatggatgttttggtgtatgtttaagcatccaactgtattccaaagtggtcatgtcagtctcaccagcagtgtataagtatgtttcacatctcggctgacatttggtatagacaatgtttttagtttggctattgtagtgcatatacaatagcatctcatggtggttttaatttctttcttttttttttttttttttaaagacagagtctt

SEQ ID NO: 25868 - DNA, 1028 bp, Homo sapiens
aattagtagaaatagcaactataagggtggggttaaaatataaaataaacccatgggttgtcttgctgctccttaagtaacacaccagtgatgcttgtaaacactttctatagaaagtatctgtgacaatactttaatatttggccaaaagcttataactcctagaggatggtaggaagcttgatagcatccaagctgctaaattcttaggagcctgttcgtgttaaagtacgtgagcctatgagcagtcatttatgctgtgaattcatatctggctgctacttttccttcgacagataagcctatttggctgctaaagggctttttatttggttcttcctcctggtgtgagcatgtataaacagcaggacgttatatagagtagcaaacaataaaatgaggaaaatgcatgaaaactcagtatatgggtgaatagatacttgtttaatatgtgtaattaaacttggtagcataatgtttttgaaactttagatgtaaatgtgtgaatgtctgtccatttgtgaatcctgagagttgccagtcctataagcaatatattcacatgcttctattctccaattttcagtactatggactacaaattttggaaaatgtgataaaaacaaggtggaagattcttccaaggaaccagtgcgaaggtaggaaaataaagaattataaattcagagttttgtttttcctggcatttttattgtagttgactgtttgagggggcatgtaatgaatctttagtatattttgctctaatggagcttattgcttttatcatgaagcaaacaggtctgtttgtattggtgggtacaggaaggccacttacaggttatcttttgggagaaagaggagactggactgttgaaaactctgacaataaatattctagttaaaaatatgggctatggcacagtggcccacgcctgtaatcctaacacttcaggaggccgaggcaagtagatcgcttgagtctgggagttctataccagcctaggcagtatagcaagacctcatct

SEQ ID NO: 25869 - DNA, 1054 bp, Homo sapiens
agtccttttggtctctaaaagtcctatgtcgttagttcagtctacttttcgtttaccacctccttgggggtcttatttcaaaggaaaaggagtagtagtagcagcgagctgctatagtggaaaacatgatttttagtgttagacgtcttaatttgattcttggaagctctctctagtcattgcttaagtcccatgtacaaatatgacctgtcctacaagagattggagggttagttatgaggtttaaaagcacctattacagtgcttgataggtagaaggcactcagcttaaagggtacatttagcagtataatgaaaatgatttagcatatgtgatactcattgcttaaaattaaaaaaattttttttttgctactcataaaatatgcactaatgacaagaaaaatttattatgctaattaagcttttaaagtcaactgggaaaaaaagctgtaggtaggtttttttttttttaaaggaatgtgtaacttgggggaggggaagaaattatttacaagggtgacttttaatctgtagacagaacttctgcatacatggttagtatagtaggatatttagcagtgtaacattaggactaccctctaccctctgttatcagcatttttctatttttagccaagtagacagctagaaaaaagatgcgggaagagttggatgttttctccaatattgtgttctgttaaagatcttgaactctattgcttagcaactaaaatgctttcaccattcagttagtagtacaagggagatgctaggttttctctctttagtttgcttttgtgtcttttttttttaaacccctgctggggttttaagtttataaagaacattatgtaagaatggtgggattagaataaatcagaatgcaaatactagaagtagcatcagagagtaaaattacaactaacaggaaagaatattatttatgtagcgattgatgtgagtggtgatagtgtgggaagtatttgattctgtgtagaatgcttatcacttcaaagcatctgacaaaatggtaacttgaccaagtaacttt

SEQ ID NO: 25870 - DNA, 1059 bp, Homo sapiens
ggtatttaaagtcatggactggttgagaacagcgaggagtgaggatatgtagatagagaagagaaaaggtctatgcaatgtgacccaggtacaccagtttttaaagcttaggaaaataaaggaggcctcaacaaagaatgcagagaacgaatgcaattgagctatgaggagaaccatggagggtggtgtcttggagacaaggtgaagaaagggtctcaggctggacacggtggctcacacctgtaatcccagcactttgggaagccgaggcgggcaggtcacctgaggtcaggagactgagatcatcctgactaacacggtgaaacctcatctctactaaaaatacaaaaaaaccaaaaatacaaaaaaacccacaaaaattagcccggcgtggtggcgggtgcctgtagtctcagctacttgagaggctgaggcaggagaatggcatgaaactgggaggtggagcttgcagtgagtcgagatcatgccactgcactccagcctggacgagagagtgagactctgtctcataaaagaaaaagagaccaaccaataagacaaatgctactgataggcagaacaagacaagaattgagatttgtcctttagatttgaccgcatggaggtcattggtcattttcataagtgcagtttcagtgaaacagtggaaggaagtcttgattagagtgggttcgagagaggagagaaaatagaaattaagtatagacaaggctgggtgcagtggtcacgcctatagttccagcaccttgggaggctgaggcgggcagatcacttaaggctaggagttcaagaccagcctggccaacatggtgaaaccctgtctctactgaaaataaaaaattagctgggcctggtggcaggcacctgtaatcccagctacttgggaggctgaggcaagagaatcacttgaacccaggaggcggaggttgcagtgagccaagatggtgccactgtactccagcctgggcaacagagcaagactctgtctcaaaaaaaaaaaaatctgaatattaaaacaaaagattctcctagtgtccc

SEQ ID NO: 25871 - DNA, 1035 bp, Homo sapiens
cttaatctgcaaaaatttggctttcatctgttgagactaccaaatgtcaatggcttttaaatgtgacattaatcttccaaatgcattccaaaataatgttatccactagatatattttatagttctatgctttgaaattgttctggcgatgattcatatgaggatgacgatgattcatctgatgtaagtgagccacaaggatcccaaagaagtatagaatttcctataacctgatttaaaaagaaagtctaacatatgaataggaacattgaatttccaacacattcaactgatattaaaatagataaaatgaagaaaactactttcaagactgattttcacatacaaaacaataagataacagagggtataatttggataaatatttagagtagactagataacagagattaagagaaattcatatctcattcttagcatagggacataatcctgtatccaaattctttcttgccagatgtgtttcagaactgagagttatcaggattttagacaggaatataatgcatatcccatatattctgtaacagcccagcaggatctggagcagaatcttgtaatcaaaccaaaatatgcatgcaaaaaatgcattagtattaaccataagtaggataaacaaaggctagaaacagatacacatctgttcaggtcagattttgctgctaaatgagtttgccacgaacttatgaaaaacttcaggtttctacagtttttttctttgttttgaaattttagactatgatttgtagacctctacaagcaaatatgttcagatttcaacatctggccagatgtgagtcaaagagttgttttcaaggcttggctgtgttagatagtcttgtggtttggggtgtttagtctgaaggcaaagagtgccctttttttttttgatacagaatattgctccattgcacaggctggagtgcaatggtgcaatctcagctcactgcaacctctgcctccctagtttaagtgattcgcctgcctcagcctcccaagtagctgggattacaa

SEQ ID NO: 25872 - DNA, 1032 bp, Homo sapiens
aatcacactgaatcatcaaggtctcctctctatgcccttgctgttgtttgcagcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacattatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaaatacaaaaaattagccaggcgtggtggtgggcgcctgtagtcccagctacttgggaggcagaggcaggagaatggcatgaacccaggaggcagagcttgcagtgagccgagatcgcgccactgcactccagcttgggcaacagagcgagactccgtctccaaaaaaaaaaaaaaagtatagaaaaaaatggatacttgcaaatttacatttatttttgcactgagagtttactgttaaattgtctacaccatcatccctttttctttttatccttagttctagtccaaattatttttgatttgtaaattattaggaaagtttttatactagtttttttaaccctatgtattattacagatggaagtaattatggcatgtgt

SEQ ID NO: 25873 - DNA, 1624 bp, Homo sapiens
agatcaatctaatgtggccaccacccatgttaacaaatagaccattgccagcaccccaaaaaccctatgtgccattgcagatcacagccctctacctctccccaagaggtaaccaccattctaactttcaggataagtacttccttgtttttctttgcaattttacagtgtgtgtacctatcctcaaacaatatagttgttttgcccatttctgaactttatatagatcatacaatatgtacttgtcagtgctttgcttcttttgctcagtattatatttgtgagatctatccatgttgtggcatgtaactgtagttcattcattttccttgctttgtttcactccattataggaatagaccacaatttatttatccattctgctactaatagatatttgggtgatttcccatttggggttattgaaggacagtactatcctgaacattcttgaacatgtcctcccttgggactcatatgtgggagcttctctggttatattcctaggagtgtaattgttggtcatagggtatgcagattttcaaacaactgtgactgctgaacttaattatcaccagtacttttaatccatattttttttttttttttttttgagacagagtcttgttctgtcacccaggctggagtacagtggcgcgatctcggctcactgcaagctccgcctcccaggttcacgccattctcctgcctcagcctcccgagtagctgggactacaggcggccaccaccacgcccggctaattttttgtatttttagtagagacggggtttcaccgtgttagccaggatggtcttgatctcctgacctcgtgatccacccgtctcggcctcccaaagcactgggattacaggcgtgagccaccgcgcctggcctaatctatacatttttgatgaaaatttaaagtcttctgttctcgtctaaaaaggtttgtctttcctatagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaaggtaacatatataagatgtctgaatggcttacctttgaaaaaattattacctgcagaaaagcacaattttatactatgtatattttttgttctatattgttttaaaaagatcttttacccaatagtaaaagacatatgaactgttgtaaaacacactgatattttaacatgtttgacacattaacgttcacatgaagtattttatttttaaagcagaataacagatttcttaaagacataagtaacaaaaataatagcatgctttcaaatgaagtttaaagaaacaatcactcaaattttgaaataaattagttttcaggaatattaaatttctcaatgggcacttttatagcgttttcttcttttttttgagttgtcttggtaacaaattggaattcatacacttgaggaagactggctacacggtggcatacttgcagagggtttgtttacctttaaaccaactcatttttcctttgaaagattgataaatttcttcccctagc

SEQ ID NO: 25874 - DNA, 1056 bp, Homo sapiens
ctgcaattactaaaagaacttcctttctatacgaaaaacaaactagtcttacggacagtggaccctgattttactaagtttatgcccggttttacaacctttcccttaagggaaatttgtcaattttaggtcatcttctcctttgtcccataggggaggcatctgtatgggtgacatggcttaacaattgacaaaatcactggaggttacaggttctaaattgtgaatttgaagctgttataattggacaatagacagttggagaatttacctgtaacagatgagcatagttacagaactgtacttgccagtgactcattgaggacagtggacatgtattgtgggtgaatctgcacattacagtctctcaaagttacgtaatctttttgctcactgatctagatataattttatataatgcctttcattttaagtgatggatttttttaacatctttatttcaactttagggggaaaaatcattttaagctgttctacattataatcataaagtgattggcttttggctcaaagacattatctccagctctgaactgcaagttttttgtttttgctctttacactgcttctgggtttttcttatttatttatttatttattttttcaacttttattttaaattcaaggagtatatgcgcaggtttgttacaagggtatgccaggcgccgtggctcacacctgtaatcccagccagcattttgggaggccgaagcaggtggatcacctaaggtcagtggttcgagaccagcctggccaacatggtgaaaccttgtctctactaaaaatacaaaaattagccgggcatggttttgcgtgcctgtagtcccaactacttgggaggctgaggcaggagaattgcttgaacttgggaggcggaggttgtagtgagctgagattgcgtcattgcactccagcctgagcaacaagaccaaaattctatctcaaaaaaaaaaaaaagggtatattgtgtgagctggggtttggggtatgattgaactcatcacccaggtaatgagcatagtacccaataggtag

SEQ ID NO: 25875 - DNA, 1043 bp, Homo sapiens
ccattgtttttttaaaagtttttacttttttttttttttttttttttctgagacgaagtcttgctctgttgcccaggctggagtgcagtggcatgatctcggctcattgcaacctccgcctcctgggttcaagcgattctcttgcctcagtctcccacctcccaagtagctgggattacaggcatgtgccaccacacccagctaatttttgtatttttagtagagacggggtttcaccatgttggtcaggctggtctcgaacttcttaccttgtgatccacctgcctcagcctcccaaagtgctgggattacaggcatgagccaccgtgcctggccaagtttttacttttgataaatatttgctagtcatcaaggtgacagcagttcttaatacaggttttccttttattaattgccttaaacattttccagctttaaaattctgtcattacaggttttgaaatctaagtttttctcttatcaggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttct

SEQ ID NO: 25876 - DNA, 1119 bp, Homo sapiens
taaggcagcagtggatcaaagagatccaggagtggggcaataataaatgtgaggctgaatcatattttattggactgatgacttttaatctgttcatctattaaacgtacagatgtccactccctcttaactacccctctttgttttcttttatccttagtgggacaattgatgactgtgagttggtggaagggctggttctcacccaaaaagtgtcaaattctggcataaccagagttgaaaaggccaagattgggcttattcagttttgcttatctgctcccaaaacagacgtaagtagaatccaaatgaaattggttctctgtgtttaactttttaataactcaggcatttctttattaaaaatagaaaatactactagtgatttaaagcagatctcaaaagacttactagaattgagacaaaaatagtaattgttggtgccacaagtgacaagtctgtatcctcagttgggatattgaaattgagagctagccatttgcaacgatgcctgtagtcccagctccttgggaaattgaagcagaaaaattgcttgaacctaggagtttgaggttgcagggtgctattccatgacctgtgaatagtccctgcactccactccagcctgggcaacatagtgggaccccatcttttcactgttgctgttaatttacaaattcacacagattagagagggaccctatcttttgaaaacaactagggtaaccattttatattttttggttataaaaaatttacttgcaaaatgtaagataccagtgtacttagttgaaaataaaagactcaagtttgggatgtgtatcttaatccagactcttttctatgcatgtctatataatttattacttgatatagttttggttgaatttatacaacacatagtattttcgcttaaaattctacttttaaacttaaaatatcttacaatgcaaattatgatgttctttttctgaacagatggataatcaaatagtggtttctgactatgcccagatggaccgagtgctgcgagaagagagagcctatattttaaatttagtgaagcaaattaaaaaaacaggatgtaatgtccttctcatacagaaatctattctaagg

SEQ ID NO: 25877 - DNA, 1026 bp, Homo sapiens
caagaccattctagggaacataatggggccccgtctctaaaaacaaacgaacaaaaaagactttttaaaaaaagtagccagatgtgttagtgtgcacctatagccccagctactcgggagactgagacaggaggatctcttgagcccaggaggtggaggctgcagtgagccatgattgcactgctatactccagtctgggtgacagagtaagaccctgtctcaaaaaaaaaagtttgatactctagtctcatctggaatgccccttttcttagcttccaattctatagagtacttacgatatatttttgctttctaattagaacttttgagtagcagggcagggggagatgacaacccacaatctgaactggagatcatctactagtctttaattttaaatgaaacccaaggtagacaacaaatcagaagaaatcaggaatcatgttgcatcttcaaattctgtttgtgacactggtgcgattatttgaattaggtgttactgggttctgtcatttctcattgagcaacttggcattttctgttcacttagctggtggagctgtctaaggctcaagatatagaagcaggagatggcaccacatcagtagtcatcattgctggctccctcttagattcttgtaccaagcttcttcagaaaggtgggtaggatgtactttattactgaataaagaaaagtttaaaaaacaaactttaggaaaagccaagttattcataagtaatatgggattgaagatttaatttggaataactaatctttttaccaagaatttttaaagttagattttgctatatttataatagagattagaagaaattttccttggcttctgatatttgctgggctcctttttgaatggaactcaattgaattttgctgttcaaaaatgagtggtagaggccgggcgtggtggctcatgcctgtaattccagcactttgagaggccaaggtgggtggatcccctgaggtcaggagttcaagaccagcctgaccaacagtgaaacac

SEQ ID NO: 25878 - DNA, 1023 bp, Homo sapiens
tattttgtttaatgcttcttaaacaatgagaatgcacacccaaatatagatatctattatgtagttaagtggaaactattataaatccaggtgttgggacttcagtttagtgttccttatggatgtaactttgtatcttaatgtgggtctctgtgagataaaacaatatggaggatcatctggatgatactatagattattctccgctctggatattcaaaaatctatctttcccaaaaatgccattgtcctttttgtaggacaaaaaaggaaaaaagttactgtgttgactgtaagaattgtgttcaccgcatggcatggtactgctttaggggcatccatggtggaaatcgtgtttctgattaataagaaatcattaaagatagcaagtgcttctttataatatttttccttttgtgtgtgtgtgtgtgtgtgtgtgtgtgtgtgtgtgtgtgtgtctacatttcttcacttttagattaccctgcaacaaagccacttttttcttttgtaaagttggactgttattgcgtattcttaaactattatgctaatgtaagggaagagaatttaaaattaagtactttgcaaacagaaattaacttctctattttgaaatgtaaaagtttaataaaactattaaggtgtgacattgaaatataactttaaaattttttttctagattcaagatggaaaaggtgatgtaaccattacaaatgatggtgctaccattctgaaacaaatgcaagtattacatccagcagccagaatggtaagtgtaattttaggtgagtctttttttttttttttttttgagacagagtcttgctctgtcatccaggctagagtgccgtggcacaatctcagctcactgcaacctctgcctcccagattcatttctcctgcctcagcctcctgagtagctgggattacaggctcgtgccaccatgcctggttgatttttgtattttcagtagagacgggtttcaccatgttggtcaggctgttctcaaactcctgac

SEQ ID NO: 25879 - DNA, 1019 bp, Homo sapiens
gaacatgtcaaaaaatcatgaatatataaaatatgtgaaccaacttgatctgacattttttgaacctatatccaacaactgcagaatacacattcttttcaaatctacatggcatattccctaaatataaactgtattctggttcataaaataaagctcaacaaattctagaagattgaaatatgacaagaaaggaattaaattacaagtcaattacatccaaatatctatgaagttcccaaatacaaagtaaataatacttctctaaaaagatcacggattaaagaaggaatcacaagagaaaatgagaaatattttgaattgaattttaaaatgagaacataatatatcaaaatgtgtaggatgattataacatgtagcataaaataaggcaccatgacttcataatgatacaagtaaataaatccaactaataaatataaaagtaaagatagaattagaaaatgacaatttggcaaacatcatagtgataattttctaagacaagaatccataatggatgctataactggtgagaaaaagtttcatgaaaaacaggatatttacatagcctcaaaatattttctcatgaaatatctatgatttacaaagggaaaaggaataactttgcagtggagaaggctggcagatgccctgttaatcaagtaatcaaaatttatatttatatcgtcaataatggaagaaataaaagtaatttgtcacctcatatattgcagtaagaacacaacatccgttccttggtattcttgaaaaaaaaatgcataacccaaatctagtcatggggagtatcgattgaacctacattgagagacattctaataaccagcctatactcttcaaaaatgctaagttcatagaaagtaagagcaaagaactattccagattaaaggagactaaagaagcattacaactaaatgcatcaagaaatggatatttgtgataggaaggacattatttgaacaactggtgaaacttcagtgattaagtttgagtaatg

SEQ ID NO: 25880 - DNA, 1019 bp, Homo sapiens
tacttttctcattagtaatcattgaggccagaaggcagtgagaagacatatgcaaactgtttaaagaaaaaaaaaaaatcacctgtaatcccagcactttgggaggccgaggtgggcagatcacttgaggtcaggagtttgagaccagcctggccaacatggcaaaacctcatctctactaaaaatgcaaaaaaagaaaaaaagccagatgtggtggtacaagcccgtaatcccagctactcggaaggctgaggcaggagaatcgaacctgggaggcagagggtgcagtgagctgagatggcaccactgcactccagcctgggtaacagagtaagactctgtctcaaagaaaaaaaccaacaacaaagaattttatatccagcaaaattatctcttaaaaatgagggagaattaagacattctagataaaagatgagggagtttttgctagtagacgtgtcttataagaaatgctaaaaggagttcttcagactgaaatgaaaagacactggacagtaactcaaagccatagaaagaaataaagaacgtgtaaagataactacataggtaaatataaaagacaatactactgtatttttagattgtaagttttcttcatgatttaaaaattaatacatgaaacaataattaaaacctatgtaaatggggatacaatatatatacatgtaatttatgacaataataacagggtagatagagctatagagaagcaaagtatttgtatgttattgaagctacgttggtgtgaattgaaactagattgttataaatttagtacattaattataatccttagggtaaccgctaagaaaataactaaaaatatatacagaaaaggcaatgaagattaaaatggtacactggaaaaaatttgcaaaataaggcagtattggaagaattatataacaaaacacatatgatttatggaagacatagcgaatggtagatgtactttcttatcagtaatcaatttaaatgtaaatagattaaatttgata

SEQ ID NO: 25881 - DNA, 1021 bp, Homo sapiens
gctggagtgtggtggtgcgatctcggcttactgcaaccttggcctcctgggttcaagcgattctcctgcctcagcctcccaagtagctgggactacaggtgcacaccaccacacctagctaatttttgtatttttagtagagatggggtttcaccatgttggccaagatggtcttgatctcttgacctcatgatctgcctgccttggcctcccaaagtgctgggttacaggcgtgagccaccgtattccagtttttagagtaaaagctttcaacctttccttattcagtatgatggatggtctttctatgcctagtttgttgagagtttttatcatgaaggagtgttgaattttattacatgctttttctacatcttttgagatgatcatataatttttgtctttcattctgttgatgtgatgtatcatgtttattgatgtgcatgtgttgaaccatccttgcacccctgggatacattcttcttgatcatgatatattatcatttgatgtgctgttggatttggtttgttagtattttgttgacgatttttgcatctatttttatttagggatattggcctgcagttttacttttttgttgtatccttgtctggtttcggtatcatggtaatgctggactcatagaatgagttagggtgaattcattcctcttcaatagtttgaggaggtttagttcttctttatacatgtggtagaattctgcagggaatccacctggtccttggcttttctttatagggagactttttatactgattcagtcttgttattggtatgctcaggttttctgtttcttcctgattcagtcttggtgggttgtatgcattcagcaatttatccatttcctctagattttttagttcgttagcatataattgtacctcttagtccctgatgatcttttacatttctgtggcatcagttgtaatgtttcctttttcacttatgattttatctgggtcttctcttttgttcttggttattctagcaagtagttta

SEQ ID NO: 25882 - DNA, 1050 bp, Homo sapiens
tttttgttttgtttttttctcttttattgatacataatttacatatttgtggggtacatgtgagtgtttatatgcaaagaatgtgtaatgatcaagtgtgagtaattgggatgtctgttaacttgagtgggtagtatttttacatgttggtattacttcaagttctctcttctaattattttgaaatatacataatattgttgctaagtatagtcatcctattctgctatcaaacattataacttatttcttctatctaactatatgtttggactcataaccgaactctctcccccacccccgattcccagtctttggtatctgtgccttctattctctatgtccatgaggtcaagcttttagctcccatatatgagtaagaacatgtagtacctgtctttctgtgcctggcttatttcatttaacatactgacctccagttccatccatgttgctacaaaatgcatgatttcattattttttatggctgaataatattccattggttatatacaccacattttctttattcatcgatctgttgatgggcatttagattgattccatatctttgctgttatgaatagtgctgtgataaacatgtgagtgcagatatccttttgatataaatatatttctttttctttggatagataccaagtagtaggatttctggattgtatggtagatctccttttgttttgtttttcttctttttttgagacagaatctcactctgttgctcaggctggagtacagtggcgcaatctcacctcactgcaacctccccctcccaagttcaagccattctcttgcctcagcctcctgagtagctgggactacaggcacatgccaccacttctggctaattttttgtatttttattaggcacagggtttcaccatgttggccaagctgttctcaaactcctgagctccggtgatctgcctgcctcagcctcccaaagtgctgggattacaggcgtgagccaccatgccaggcctccttttggtttttgataaatctccatactattttccatagtggttg

SEQ ID NO: 25883 - DNA, 1050 bp, Homo sapiens
ccagtaatgggatggctggatcaaatggtatttctagttctagatccttgaggaattgccacactgtcttccacaatggttgaactttttaaaaaacaaatttgttactcctctgcttaaaacccttctacaactttggaggacaggtgggaaactggaaactgattaaaagggatagagaaacgtgggtaaggggatacagggatgagaagaagacttttaatggtacaccttggtataatctgctgttgtgttcttttggagctacatgaatgtattatatattccaacatgaatcaataatttgaattttaaaaattataacatcaacaaaactggtcccaatctacctgcattttaaatttcatcccttactgcactcttttttaatctcattggccaagctacaccaggtgtattaggccgttcttgcattgctataaagaaatacttgagactggatagtttataaagaaaaggggtttaattggctcgtggttatgcaggctgtacaagaagcatgttgctggcatctgcttggcttctggtgaagcctcagggagctttcaatcatggtggaaggcaaagggggaagccagcatctcacatggcaggagctagagcaagagagagtagggatgggaggtgctacacatttaaacaactaaatttagtgaacactgtctcactattgccaggataacaccaaaccatgaggaatctgcctctgtgacccaaatacctccccgcaggccccacctccaacactggggattacatttcaacatgagatttgggtggggacaaatatccaaactatatcaccaggcttctgtcaatcccttatattctacatactatctcttgctacctggcctttgcatgcaccattcctagctctgcctaaaatgccctttgcttccccttacatggaagtaacacattctcaaccttagatcccagactatcagttgtctcttcctcaaggaagccttcccagagaagctttatcctttattttgtggttttagaacatcatgtatttccttt

SEQ ID NO: 25884 - DNA, 1029 bp, Homo sapiens
tccagtgtatgggtatctacatttttttttctccattcatccataagtggacatctggattgcttccacctcttagagtttgtgaatagtgcatctatgaagatgagtgtgcaaatatctcttcaagaccccgctttcaattcttttggatgtatacccagaattgagatcactagatcatacgctagttctatttttaattttttgaggaaacaccatactgattttcatagtggttgcaccattttacaatctcaccaggagtgcatgaggattctaatttctccacatctttgctaacactagatcttttctgatttgttgttgtttgtttttgtggtagtaatcattctactatcaagctatgaagtagtatttcattgtgattttgatttgcagttatctaatgattagtaatgttgagtatcttttcatatgcttgttgggtatttatatatcatctttgtagaaatgtctatttaagtcctttgcccatttttaagttggattatctgattttttcgttgttgaattgtaggagttttaaaatgtattttgaggattaactctttcatatgttttgcaaatattttctcccattctgtaggttaccttttcattttgttgattgtgtcttttgatacctaaaggtttttaagtttgatgtcccatttgtttgtttttgcttttgtagtatgtgcttttggtgtcatatgcaagaaatcatgaagtccaccccaatgtcataaagcttttcctctcttttcttctggaagttttatagattgggtccgtgatactttgcttttccagggttctctctctacatttctgtctttaatccattttgagttaatttttgtatattatgtaaggtaaggttcaacttcgttcttttgcatatgaatatccagttttctcagcatcgtttgttgaaaagattgttctttctccccatcgaatagtcttggcacccttgtggaagatcatttgaccatttatgtgaggatttattcctgggatctcttt

SEQ ID NO: 25885 - DNA, 1052 bp, Homo sapiens
ataacatttttagtattatagacaattagttatgtaatactcactaataatgctcagcacttttaatcttcaaagcattatacacactagttaatccttacaacaccgttacaaatgtaggtcaatatcattatccctgtttttgcaggtggggaaattgaggcagaggttaaatgatttggagtaagtttgtcatagcaggattagaatgaaggcatttttggcttacagcccagcattcagaacagtagaaccacacctttagcagacttaacctctatgtacttgataaaacattacttctcattaaatcatattgaggtcatctctgcattaaaattcagaaccaacaagtttgatcactgtataaccactttacacacacacacacacacacacacacacccccacaccattttctctttcaaggctttcttgacactatattatcttagtctgtcttttaaattgactctttattggagaattaccagactatctatctttgactttatttttcttctgtgatcttactcaatggctttactctctatttagaaaattccaaagtagtttttatgtagtccaggcctctcttctgtatttctagctaccagctagacatatctacccagagcatttccttgtacctttatctcccactgagtctaaaattcaacttattaacaaaacttgctcttcttctagactaacctgtttctatgtgtgtttcaatccaagtcctgcccttgaaactaggatcaactaggtgggaacaagtctgggtaaggggttcctgggaacttgatgtggccaagaagaacagtattcatgggtcctttgacaggatgaagaagttgaatcacagtttaagaagaagagccagagttacaaactgaggggcaaggcagaagtaaaacaggagaccacgtagccaggttagtagctaggaacattgatgtgtgtgggttcagtagttgaggcagtcattgtgaacagatggaatgcactggtacccatttactgggcacatgatgatgcaggcatgcctg

SEQ ID NO: 25886 - DNA, 1034 bp, Homo sapiens
gtccagatatacagaattgaagtcacctgtgtggtagttcacgggccttgttctgtttattgctagttgcccttgtaaatcaggttaaggagcatattagcactgattgtaagttacttttctcaggtaatataatacactgcaagagaagatgtttggtaaggtgggtatatcagcacatttccaattatactaataagattgtctgtgttctcttccttttgaaccgtctttggtaatagctaatgtcaagtagcacaatatgtcattgcactttcactgtgagtttgaatctccaggtggtttgtgaatgtgttgcagacattcattttttgttaaggcaacaaacagagcattaaactgttatgctatatttggagttatgcttaacattttttttgcccagcctcgcgttatttagtaaggtaatatttaattcaaattgtagaaaatgtttgaaataccattctaacaacatccagcaaagatattaaaggatcattaagtttcaaatctctgaaatagaatgttggctcttgatacccaaggcactttggaactcacaagatcttatgcttttttatagtatacaattatttaaccacagctaggcgtggtggctcacacttgtaatctcagcactttgagaggctaaggccggaggactgcttgagtcgaagagtttgagaccagcctgggcaatatactgagaccttgtctctacaaaaaatttttaaaaaattagctgagtgtggtgttgtgcacctgtagtcccagctcctcaagaggctgaggtgggagggttgcttgagcccagtaagcagaagttgcactggcatcactgcaccccagcctgggcgacaaagggagatcctgtctcaaaaaaaaaaaaaaaaaaagaaaattatttaacctcatattaattttatctctagcatatataaaattgttatagatctagttaaaactcattcatcttaatgttttctttaatgaagttctattacacttttaagctattttataacaatttt

SEQ ID NO: 25887 - DNA, 1052 bp, Homo sapiens
caaatttaaagtaccatgacaggttgagagagagaaagtggaagaaaggaaaaagatttatatattagttcctgtaacaatacatgtttcctgcttcctggacaaaaagcctcacatttttgttttgtaccaagccctgcaattgtgtagctggtcctgtactcaagtcccctttcccagggaaggattaatttcctaatatggagtgtcctctacctgactcccagtgcctgaagctgtgacaagactttccatgccagcttactgcctccatacagaggccgatacaggttgcatggacctgaagctcatataatttagggggcagtcctttaaaaaactacaaatacaagattgctaggtcccctcacaggaccttagaaagggcctgtgcaagtgaggggtcctaaagcttatgccttatgagcttcatggtaactccacccctgccttcccagcatgccttctattcactcctgggtccactttaagaatctggagcttttttttttggccgtgcatggtgcctcacgactgtaatcccagcactttgggaggccaaagcgggtggatcacctgaggtcaggagtttgaggccagcctggccaacatggtgaaaccccgtctctactaaaaaaatacagaaaattagcccagcatggtggtgcacacctgtaatcccaactactcgggaggctgaggcaggagaattgcttgaactcgggagtctgaggttgcagtgagctgagactgggacactgcactccagcctgggcaacaaagtgagactctgtctcaaaaaataaaaataaaaaaaaagaatctggagctttttttaaagactccagaactgggctgtacgcagtggctcatgcctgtaatcccagcactttgggaggccgaggcaggcagatcacttgagcccaggagtttgagactagcctgggcaacacggtgaaagcctatctctacaaaaagatacaaaaattagccagccgtggtggcatgtgcctgtagtcccagctacttgggaggctgaagtgggaggatca

SEQ ID NO: 25888 - DNA, 1032 bp, Homo sapiens
agggctactgtctgtgtggagtttgcacgttctccccacatctgtgtgggttttctccaactattctggtttcttcccacatcccaaagatgtgcatgttaggtgaactggtgtgtctacatggtcccagtatgagtgtggatatgtgtgagtgtgccctgagatgggatggcggcctgtgcagggttggctcctgccttgtgccctgagctgccgggataagctctggtcaccagtgaacctgaactggaataagtgagtcaagaattatcttgtttttattaatcaatgtatgtacagctcacatttatttcagagtttaatattagaagtgttttgtttttaaaatttggtgatatttttgtgaccagaaataaactgtaggaactgaactcttgtttatatcaattagcctatggcaaaatgtgttacacattgttctgcttactgtggcagtttccaagaacatactgatgacactgaggatgtactgtacttgctattccacctgtctagaacactttttgcactagataccgatttgtcagactcaatcaactcaatgaggctgcctgtggccactcaatgtaaaattacaccatcaacaccaccccgccacctccccaggcattccctattctccacccttgctttgtttctccatagcattttccaccacttggtatatcatacatttacttacttatcatcctttccccactagaatgtcaattccgtgaagacaaagatttagtctgttttgtttactgctaaatccctagaacctagaacactgcccagtacatgataggcattcaataagtatttgttaagccagaattaaccttttcccactgatgaaagcagtactggtcttggaagagacagaagataaaatgccccaaaatttaaagattattttctactctccatatggcaatcatgtttcaaatgtgaagtaaaatatttatcttctatggtcaattccctttaaaaggtatcaaagacagaggaatacaacaggtcagtggt

SEQ ID NO: 25889 - DNA, 1050 bp, Homo sapiens
aaaaaggaagaaccagagaggcagggagaaatctagaacatagaagtaaaatgatgagagagttttcatgtggaagagatggctgggaaatatttttgtaccctagttcaggtggagtcatcatgtgataataatgtaaatttatttataatagtcctataagatttacaattatgaaattcttgagtatttctaatagagaaggtagttgaactatttcagattttatgcatttaatcaaagttttaaattgtatacttcacattcgcacaaaatgcaactagactacaagagaaagacttgagtaaaacaccaacagtaaccattagtttgatacatagatcatttgcaatctcagtaattcagtggagtgatagtcaaattgcagttcagtgcttagtaactggaaaagtgaggaagggtagacaagtatagcctactttttcaacagatttggcatgcaggaaaagtgagtgatgaaatagtagctaaagaagttagagagagagggtgatttacagggcaaggtgcatggaatcgaatctagagtttaagagaaaggctactacttctgcccctgtgacaaggggaagagggttaaggacaagtataaaatagatgagttgatatagggcagagaaaaattgaaggaattaagtaaatttttgtcatatgacagtttttaataggtaatagtgttgggtggtagagttttctacttgatggtatgatattggcacaactaaagcattcaagtagcaagagctgatggaaaaataaaactctgaccactccaaatcactagtttaaaattataagacttatcactcatctagtctttcaagctatatttaattgacttccctctatgtgaggtgctgtgctagatgactaggatatgttttctgtccctgaacagctcatggtcttttgattccactgttaagcaaacagaatgatttctgaattaaaatcataaatgtggaataattgaattactcatgtgttttgtttgaaacatgaactacttattttcacttctttggagga

SEQ ID NO: 25890 - DNA, 1076 bp, Homo sapiens
taaccagtaatgggattgctggattgaatggtatttctctctttaggtctttgaggaatcgctacactgtcttccacaatggttgaactaatttacactcccatcagcagtgtataagtgttcccttttctctacaaccttgccagcacctgttattgttgactttttagtaatagccattcttacttgtgtgagatggtatctcattgtggttttgatttgcatttctctaatgatcagttatgttggccacatgtatgtccttttttgaaaagtgtctgttcatatagtaagggcctttttaatgtacaaatggaacatggaatacttaggatttgaaagacaattaatcaaattgtttttgttttttcttaaattttgcagtgtgtgattaataaagtttcacaaacagaagaaatagacacagatgttgttgtgaagtaagtataaatatataggttggtggttatcagtcagagaaaagatgatagatgtaaattagaataattcgaagtagatttcgttaaggaattatttactaaggtgtgagcagggtgtaggaaaatcacaagtgacagtgtggaacgaagacagtgcttaacagaattgaggagaaaggtagttggaaaaaaagctgtgaccttgagtagagggaagcagtcaccctgaggcaacccttgagagagacaggagaaataggtacctttactagagagctagaggagtaggtacctttactccttccagtttttgtaagggctcctcaatggccaggcccacatgttagcttcccagagcagagagcaggatggacagggacagaacatagatatggagaggtgaaattggagataattcattacaggggcatagcaagcattatgtttaaatttgtagctatgtaattaaaatcaacttttaattggctttgagaagtttgagttaatgattttgaattgcccatgtttgtattttttttttgttttcaccctagaaattcctattcttggccaggcgcattgactcacacctgtaatcccagcactttgggaggccgaggtgggagaatcgcttga

SEQ ID NO: 25891 - DNA, 1031 bp, Homo sapiens
gtctgtccaattaagatggccagttggtccagataaacagacaaagtttttgacacagaatgaggaagaaaacaccactccgctaaatcattatgttgaactattagcccagtaggggagtgcaatgaggcgaaaaccagaagctgaaaaggctgaaacggctgtactctagataactggatggtctgaattctttacgaattccagttctagtgaagcctcaggggtcaaagtcctgggactgcggagattggaatctccccgcagcatagaaaacaagttagtgcataggtcggaatgcctaaagtaggtgttaaataattaatgttacccaaaagtttttggaagtcatttaaagttttcaaataatctctcctaatttgaactttttgaggttgaatatgtttatcgaccatgattcctaaatattgaacaggagtggtctgttgaattttgtcctgagcgatgtgtaatccagcctctaacacagcagctcaaaatttgataacagtcaattctttatcagtgggggcagcaattaaaatatcaatataatgaagaatataggcctggggaaactgggctcgaactggtgaaagcacttgcccaacataaagctggcagattgtagggctatttagcattccctgaggaagtactttccattgataatgagctgcaggctcttgattattgatagatggtacaataaaagcaaatttttcacaatctgatttatgtaaagcaatataaaaaaatcaataactatgagaggccaatttttaggtattaaagcaggggcaggcatgccgagttggaaggctcctataggtttaattacagcattaatggcccttaaattggttaccatccaccacttgcctgatttcttttttactagaaacacaggagaattccagcgggaaagaaggttccaaatttctaagttgtaactgttcagaaactaattgagttaaagcctccagtttttctttagagagcagccactgctgaatccaaatgggtgtgtc

SEQ ID NO: 25892 - DNA, 1023 bp, Homo sapiens
caacatggtgaaaccctgtctatactaaaaatacaaagattagccgggtgtggtgctgggtgccagtagtcttagctactcaggaggctgaggcaggagaatcgcttgaacccgggaggcggaggttgttatgaactgagatcttgccactgtactccagtctaggcgacacagcgagactccatctcaaaaaaaaagaaaagaaaatgtatagtatcttttttcttttggaatagtcctggtcttataaaattgtcacaattagatgttaattatttctatcattcaatagaagatgaacataagtaacagttatgagagtaaataattattgattcagtcattgatctgataaggagacaaagacagaagaggaaagcaccaggagcctgaaatgggtgggaaggagtagtgacataatttaaaatttttttattggtgcagagacagaggcatgaaacttagaatcagaaaatctgaattcagattccctcttcacagttaactcactgaatggtctgaaatcaagttactctagaacttgtttcttcattcatataatggagatcgttgattcattgattcattcagaaatatttttcttactaggttattttgaagatgaacaaaaacatctgaaagtaagctattatgaactgtatagtgttcactgtatttgactgtatagtcagatattagtgatgatgcaattcttcttgtctttccatttcattcttccctgtcatccttccttctttcattgatagcgtatttttacatgctcttgatctagcgcttcacagaaccttcagagcctgcagtcccagctgatttccactcctcctcccactcacacattgggcacaggagtagggtgtgaggcaacttttctaggtcagcctgcttattttctcactgttgactgacaaagtcctgtctttctcaaggtgtgacataaacctgaggtgccttttagtccctgggcttgatattctttctttctcactttgcctctccttttcc

SEQ ID NO: 25893 - DNA, 1032 bp, Homo sapiens
gaaacattctaggattgtctaccctgtaaactgaacaagaacatttattgttcaagtcatcagatattccaactccaactctatgccttgtttgtcactatgaagtacataagggagacattacaagctgattacatgcctaggtgctgtactgaccctgtaaatcttaagcacattgattgtgttgaagaaggatggagaaaagactttacactggtgccttttcatgtagatctttttatcaggttaagtaggatttttgccagcaaccggtagaaaagcattctagcaaaagagatggcaaagaagcaaagaagtagtacacagtgtggtgaaagattgacgaataagctgttgtagcttgtatacacaaatagcaggaaattcggctggattggtagatgggaggcaaatcttgagtcagtttctaactattatcagaaataataaactacaaattttggataagctataaggaaccattgagttttctcatgagggtaagggagagtaacaaaagagctgtatttttaatgctaataatagcaggggaagaattattaacaatcatattttggcatctgatcacattcatggtggtttttttctctttatagatacttaagtttcttccttctcattgtcattacaaatattgcttcagtgtcttaaatattctcttccaagacccagttgaaatgtcagctctctggaacagtctctttccaaataagtgctacttctgttgattctgaatattagttcaatccttggcctatatcttttagcttttaaagagcctttttatttgggggaatattttttgtttcaaagatctgaggccatttaaggtatctttatttttaagaataaagaaaaggaatatccaatcttatatttgttaactagtttccctctaaaactatccaatctaaataaaaagactttatacttgacagttggacaaaaacactaaagaggtttatctgaaagtgtgccgatatgaggaacttgaggctaaaatatgtaaag

SEQ ID NO: 25894 - DNA, 1035 bp, Homo sapiens
acaaagcctaaaatagctaaaataattattagctaaggggctgtactttggacttacagcaaggctagcaacattaccaagggctttctccaatacaaagtattttattttttataaagggtcaatgtagtttctatatatggcagtcattgagtaaactctcttctcagctttaaaacattcttccttgccagccacaattacaggccattttataatcacttcctcctccagcctcaaaactgtccctgttccctgcttcctttccccctagattgaccaactacatatggtagatcatcaaacccaagatttgtcagggggcgggggcaggggaggtggacggtgaatgaggaaagattattattaagctactgctcatgcctcaatgaagcagtaaagaatgacataaccacatgacaaacatacttaaattcaaattctggctttgccagtgtcacttcagaatataattcttctgagtctgtttcctaatgtacaaaaatggggacagtgatttcaatctagtagaatttttgcaagggtagatttagtgaggtgatgtgtatgggatagcattcaatagtgcctggtacatagtaaacacccaaatatttttattttgtttttaacttgtttccattggtttagtacttgcttacctttaggatgtatatgtgtgtgtgtgtgtatgtgtacatgttatggagaaatggtcataagatctgaacaacaaaagtatgtttactacttagcaaacatgtctgttggacaggttctgctaacataatgagagtgcatttgtacattcaggtagctaagacttaacaaatctaaaaattccttacttcaaaagttcagctatttaaagtgtttggttcacaattaaaggagattgtgttttaaacaatacatactgtactttttaaaggttgtattagcacatgcaaacagttcaccttaaaaaaacagaatgagtcataaggagtcagacatgccattaatcagctcttaattatcttccataaaagaggg

SEQ ID NO: 25895 - DNA, 1031 bp, Homo sapiens
ctttctgtttatagatttctagccatcttttccagattccctctgaatatattacacaggcaaagtaaatagaagtcattctttcaagggatttgggttcttggagatttttttacacttgtggtagtgggggaggggaagtgcttattatattttcttagttttaagtgtgacctgtgccatagaatatttccctagactaatgtgtgggaacctcaagacaagaattattggtcattgaaagatctggatatgatttcaagttctgcccctaggtttttttttgtttgtttgttttttttttttgcatgttgtcttgagtagatcacttctatttttccttcaaaggctgaaaataactgcctaacatactatgtttagtaggtcctaaatactttttgttgtttaatgaatttacaggtaataaagagaaagcacagtgtttcttgaatggatgtcagggaatttctaatttttttcttttttgatagaaaaaagtaatcaaaacataaacatctgattggagtctttcagttagcttacctaccttcagaaataagcctagagaaagagagcttcatctggtagtttaacagaaatgaattgtaaatgactcttaagaagaattgacaatttttcggaatgttgtactagatgttttagattctttttgccacataaactccacttcagagaaatggggttctacatagtactcttgtatcgcccctgtaatacctttacacctcaaaataccagttgcagaaaaatagaatgtgttgctgatgcctataaatgggaaaatcctgacatctgtcttcatcctccagttaatcttcatgtagtttttaaaaaaattaattcaacacacatgtaatttacttccttttcagaaaatttgttgctaatttttattttataatgagcctcttgggatgttgctaattctaaaaatatgtaatacccgcggtttcccaccatcttctgcagtttctttttctattatttttttggctacagttttctttttc

SEQ ID NO: 25896 - DNA, 1027 bp, Homo sapiens
gcttttctccaaaattctagttaaaagctgaggccgtcaccaaacaattgttgccaagagctcaggatgttgtggttggaggggcctgcgccagaggtccacttctgaaccaatcagcagggcccgggggctgggccatgttctgcttacctcacagcttccacacccacagggttttgggaaccggaggcaggcggacagccccaggagtcataatgagaagaaatgctacctcggtacagtggacgaacgtgcaaaccacacagaaagtttgaaaaaggtctactggaggctctgctttctggtaatggctccaaaatacaaagggcctcacactccggcactgacgaagtccatacggctcttaggctgacacccaccagccagtcaatgggagagctgggaccagagggctgacttgacctcttcagcaggagtgtccaaggcctttgtgggcggtggtgcaggttgtgcgtgtgaataatgaaggcaattcattattactcagaacacaacaccttggcgatctttagaaacatgagaaacagagcttccaaggtacctgctcacacgcctctctggaggtaatcgctgtgccgtggctcttaatgagccactctccacatggcctgaggcctggcaccgtgggaattccctctgtccctgagtcataggcctctgctactgaactgtaaatagggaccgggtcaatgacagcgggacagctggcccagggagcagggttggggtggggactgctgggaggctgccctgttaatctctctctaccatacaaggcactccttgggtgacccccgtgactgtgatgcagaacagggaaggagagtgggtgttaaccttgagcctaaggctcctcctccacctgtgggactgtaagccacctctcctgggctgagggctctggaaggaggcttggctgctcctcagcactcggggagcggtttttcaggcacacacacttgagctccatgacctcccagattcccaccgcccctgcttgactctt

SEQ ID NO: 25897 - DNA, 1070 bp, Homo sapiens
ggggccatagagctagatcttcccaccaaaggggcctttttgacagatgtgcaaactgaggcccagagagggaaaaggattattgtctggggcaaaatagtttatagcatcagagttcagtttggctctgctaccagatctcccaagcttgaatcctggcacctacaatcttgggcaagttcctgagcctctctgtgcctcagctttcttagctataaaacgggggaaataattgagcttgtctcagggcatggtggggatcaaatgagtcaatgtgaagcacgctcgagcatttctagggcactggaaagtccacaaatgtcagtacagctaacatgatggcagacaaggctaaaatccagctctccactctcagcgcggtgttttaggttaagcctcaaagcacaactggggtatcttaatgctggaggcatgtttgctgggcagaaccaagatttcctaataccttgcatgttgtggtggtcggccacttacagagaacactgtgctctgtgcttgcatggcaatatgtggtcccagaatctctattgcctcttccatcttcgttttaatgcccttttgttccccttggagaggaatatttgactgaatcaggagtaatagtttccagggttaccacttactgagcactcacatgtgccagacactgctatatactggtgtgtgtgagctcatgaactctttccagcactttgagctttatcttactacccccactttacagaagtggcagccggctcagagaggttaagcagcttgccaaaggtcacacagctggcaagtgggtagagctgggattgggcctctctgactcttagaacaccttccagcacatgtcttgtcttcagcctcgaagctgagcaaggtgttcgaatccgatcgttacctctataacttccctgaaccttggacctctcttcttcatggggtgtggatttctcctggcacgtgcacagcattgccctgaggaacaagaggaggaagatctcctactggggccagcagtagaccaggagttaggatagctctccagggctgaatgccccgtc

SEQ ID NO: 25898 - DNA, 1068 bp, Homo sapiens
ctcagtagggccagaattatctccatctttcatctctgcctctttctgcatgtttattccattccttctcagagcagacatttctccgtatggctggaaacatggccaccagcaatttatcctatagcttctgttactgaaaagttctgtgactgccaagttaaaaaaaattgtaagcaagtaactcatgaggtgagggtcacatagaaatatggtgacacgtgtgtttgcctatatgactataagtggctgggtggctatttccctggataagagatagttgctgggcagaaaattacccagcatgtatgctcagtacagtgtgcccaactagtgcctttcaaatgtttggacagaaacccacagtaagaaatgtattttacattgagacacacatatagacacaggtttgattgagaaaaattttcttgaaacaatactcatccttactatgtacaaggcattctgctattttctattatattcaaaggtagttcatttttaaaaaattctgactgtaactcatctaaatgatctcatgactcagtgtataatgatctgtagtttgaaaaatactgcacaagacattaaaagtatcaggtaagttcatgtgtcagtagatatttgggtatagatatttgttgagtcttgaaggaataacttacattctagaaagatactagggactcaagggtgacaaatatgtgacgtgaatgtccttcccagttcccacggtggagatggcagcagctttcctactgaggaatgttctggagcctctcctcagccctttataaagtcaagcaagttagaacaagtgccctgtgctatcagcttccctcctctttgttttggatttaccttttgctgagaaatagtgaaattctgtggacctagaaaatgtccgaaagtgctttcagttctctcttaaaacaaaacatcaatacagctttcttgaaagctttattgtggcagtattcgtgatcattgtgatattgtaaaaggatggatgatatctttacctatccaggaatcagttgaaaaactctggccaggcgcagtggctca

SEQ ID NO: 25899 - DNA, 1046 bp, Homo sapiens
tcaaagtctggggctgctgtgagcgtggagtggtgcgtgcagagagcggcccgtgcaatgcattgtgctggccttgctggagctgcccatgcaaggagcagccgtgccgcacgtaagctactcatgcagggagcagccatgcaggagctcaagcagagggcagcccttgcagtgctgtgggcaccttgtggaatgcagtgcagaaatcagccagtgcagcatgcatgccagtccgggtcttccccaacactgcccttggggaaacccacacctattcttacaggaatggcagcagggggtctgcccaaaccaaatttaagttaaaaacaaaacaaagcaaaacaattcctaaagtgccccagcttatcatctaacaggcaatggagtttctcagcactgcctgaggttgtttgtaattgtaaactaatagtagtaagggcagaggccagatgttagataaccgaagtcagtggtagaccagctggagagccacgctgggcttagattttaactcttaagttgtcttgctgtccactccacacctagatataatatgagcagaaaacaaagaatttcaattttagttcttcgggaaaacattagctttttattttaatacttcagagtttgttgaaaaaaccgtttttggcaggttggtacaaggaataataccatctgtatttgtatggtgccttgcagtttgtaagtgctctcatgagcattatcctatttaacacccacagccacaaccaccttgtgaggtattgtctcccattttacaaatgaggaaacagacttctgagagtttacagcttgtccaagggcatacagctagtagtcattagagccatcctgctccagtattccctccaccatgcaaccagcactttgatagcatctagcttcctgtcttccctgtcattctcatatttacacagaaaatcaccgtctaaaaatcttcctcagtggccattccatgttactcacaataagaacatatgtaccgtcaaagggtagcttcttgattgactttgaagtcaataatt

SEQ ID NO: 25900 - DNA, 1108 bp, Homo sapiens
acatcagatacactctttctgcatttgggaactcctagacaataaggtaacccactcctctgcttctgagagagcctttgaaaaatctaacataagcctacactcacaacttaattggaaagatttattaacaagatgatcctgttgctcatttggcttctgaaagctacataaaattgagaggatgaatcgtcgtaattcttttgtgttgttaactggaagagacaaaaccaacatgaaaggactgctctattagttagaaatcagaattttattgggggaggaggagaaagttgaatagccactggtgaaaatataacttatttgttatatgaaatagttgtcttttctcatgtgcccacttctggtttattttcaggcagttacaaaaagtagaaaaagaactattaccttccatgatttatatagttgcatatatgatttgggaatacttcaggctgtaggtagctcttggttttctgtttgtgactaagttagtttttcagggtgacattaagaataggcaggaagagtgcttagatatctgtggattatccatagtgaagtatgtggaccttctctgctgaatgcccggaacttggagcagctcacctgggaggtgtatgtttagggaatacaaatttatgttgattttagtttaccctagactgaaaatgtattaacatcctatacattaaagcaaatgtagttttaaaaaataaacggctttttaaaatgtactttggcagatagcaagcactcaaaaaaaagagttttaaataaagctgtgataatcagaagttaattatttagcaacctcagtaagctagcatctatacaatagttgactaaaatatacccaagagaaaaagtacatttgggctgggcgcggtggctcacgcctgtaatcctagcactttggggggccgaagcaggaggatcacctgaggtcaggagttcgacaccagcctggccaacatggtgaaaccccgcttctactaaaaatacaaaaattagctgggcctggtggcgtgtgtctgtagtcccagctactcgggaggctgaggcaggagaatcacttgaacctgggaggcggaggttgcagtga

SEQ ID NO: 25901 - DNA, 1026 bp, Homo sapiens
ataatgaattatctcaaggccctccaatgtcttgcatgacatacgtgtagataaaaaccttatctataattactcaagactaaactaattccaaaacaaggttctgtttttcacaatttgaacatacgctgaattttccagaagtgtaactccttgtaaattatggggtggtttttgttttgctttgttcagaatgtttccaaatattatttgtcttcctggaaaatcacaccaccagtgcaaattgtagaatctgagtccctaattccacacccagtgtcaagtaacagtctgcatttataactatttcattagcagtgattctgagttcaggagtaagcattcaaccactttattttagagcatgtatatattgagacacattgtttttgttataattattttccttttgtatattacagttacatcatattgatattttgaaattatgtgggcagggacattttatttatggatttcatcttagaattaaggatattataaacatttgttataaaagtagggcaatcgagctgatggagcccaaaatctgttcatgcaaatagttttactgagggctctgtgtaggatgctggtcttgatatacaagaaattctattccagctgacagtccatttgttctcacttcctgcaagaagagtaagtctagaagagcaaaagactctggatcattcttaacaatttgtgtcaaacttatccactaattcttacttctgtaagaagctgggttgctcaccaggatctccaggcaactatttgcagtgcattgggtttcagaggtaggcaggtctggctgcaacccagctgtggcaggcagagtctaagatggcctcctggtattcacacctttgggtaatccctttagtctgggtggacctatgacttgcttctaatgaacaaatgcagcaaaggtgatgggatgtcacatccacgatttggttacataaggttgtagcttccattgtgctagctgactcttcttattgtcttctgcttgcatacttt

SEQ ID NO: 25902 - DNA, 1049 bp, Homo sapiens
ctatgagagggtttgatgtattcgctcattcacaaagcctgcctttgtcatgtaataggcacttaggggaatccagagcttgtctggaatagggggatgcgtcctgcaaacagaagcagttccagaccctgcaggttggctagccaaagcccagctaactcccatcaggtgtaccttcctgagctgcacagacggaaaaccacaaactgctttttcagacttccttgcaggtctgccaagcagagcacctgtgtgaaactcagaagctgcagctgggaaggtgggcatgggccgtatggggtagagcttgctgggagatctgattggggtagctctgagggaggctccactgcccggttcctaatgtcacaggtgtgggcaagcacctgctgcggaaactcagcactcttaactacattgttcctggctattagccacccacctgtttccctatccgtcccagaaattctgtacattctttaattcttccctgtaatcagtgcttttctgctttgttgtctgtacttggaacacttaccaagaaattaaccaaatcagagatactcagcatgggcttgaggaagatgtgttttgacatcattttctccaaatctctcgaagtttgtgacaagtctttttctgctacactttcttctagttcctgttcacagttttgacctcttcctccattttctctgatgtttagctgatttttaccgtctgttccatcatccagttctccaaggtgttcattttgacatccagcctgacacttccttcgcacttttgtggcacctctagcactgccacttgcttggtttttgacagctggtaccatcaacaaacaaatgccttggggaagaaaacatgtcaattcgcatggcttgaaatgcaggaacaaaacagaagtgcacaccgacccggagcttacagtacagcgtgccatgagagcttgcattggccaaaagcatgcaagaatactcactgtagctgatgcatgttgtaaaagtctgcatgaactctgttcttcagtgctgcaatttctgatg

SEQ ID NO: 25903 - DNA, 1013 bp, Homo sapiens
aagcggagtgaaattgttgttttgtggtgaataaattgggtgggtgggtcgcaagagttttgctgattagtgattagaaaaattattcataatcattgaaaatataaaatatttttctatatgatgtatgtaaagaatttggcaagagatgatgtttggaaaaaataaagaatggctattgtagagatcttaaggaaagaaactacagttaagtagtgctttgtaatcagaatatgaagtaagtactgaaagtggatggagtggctgttgtcagcatgttatactttatacatttcattcataaatttggactgtagataaaagtaaactttttttttatttactcttgaacaacagtttttttttttccacttagacttgcatctgctccactgaacaatacatttaattgttaattatttcccccttcaggatgatacatatacagaaagctacatcagcacaattggtgtggatttcaaaataagaactatagagttagacgggaaaacaatcaagcttcaaatagtaagtgacttggctagtaatttttttgaaatttattttggtaaatttgtaatgtattgttattttgtatatatttactatgctaacaaaattgaatgtaaaatgtcttaagattcatgtacttaagatagaatggtagaataagaattacttagattaaaaataatattttcaagattacttaagcctcattgaattttctattcatgaagcagagaaactcatgttttaagtcaaacttggtcctcatctttttcttttatcagtggaaatctaagttcaagtttaccttgtcctacactgcaaatgttatagaccatttttgtttgtcttttactgtgctaagtgcatggaacattaaaggaaccctaggaagagattcttcatatgtggctcagttgaagagaagtacttatgtagttctaagtatttttattagatagtgtgcaccaactctgtagaaacacagaattttgttggaaaaa

SEQ ID NO: 25904 - DNA, 1050 bp, Homo sapiens
gtgtgagccaccgcgcccagccaaatttttattggtttctaaactagcataatttagtttttttcacttaagtcaaaattatattattgtaggataaaaacttagtgatccaaattcatgaggaatgaagaataaatacatttaaagtcttaccatttgctaaattagtcttggctctttgtaccaaaattctgtccttgtgctctgtaattttatatttgtatattttctatcaacatttttactgtgtggtgttttgtaaattataaaaacgttttaaagcaaactcagaacaatgaattctcacgaatattcagtatatttacagttgagaaataaactacttctgtagtaggtaatttaaaatgtcccaatgcaagttaacgtgtcactgatcacgctattcaagtgtgtgtctttgataaggggaggtggggaagtttgtgggtttgattttatttgcctttctcatgtgactgttgtcatgttagtaaacaaatggtttgcgagagaaccagtagtcttttgcaaagattgtcttatacagagcactcaattcttcatattatttataatggctttaatttaagccttaaattattagaaactcataaataatttttttatttgtttttttgagatggagtttcgcccttattgtccaggctgaagtacaatgatgtgatcttgactcactgcaacctccgcctctcgggttcaagtgattctcctgcctttgcctcccaagtagctgggattacaggcatgcgctaccatgcctggctaattttgtatttttagtaaagacgggattgcaccatgttggccaggctggtctcgaactcccaacctcaggtgatccacctgcttcggcctcccagagtgctgggattacaggctcactgagccactgtgcccagccataatgcgttaaaataagagtgttatatttgtaaaacttaaaaaaatgtagtggttgaaaaaggtaatttaaaaagaattgactattaatttcttgaaaccataatgtaacttgtagtgcaattagga

SEQ ID NO: 25905 - DNA, 1074 bp, Homo sapiens
tttagtagagatggggtttcactgtgttagccaggatgatctcctgaccttgtgatccacctgcctctgcctctcaaagtgctgagattacaggcgtgagccaccacgtctggccagaatagctttcttttgtggcaagctatatactttcctaatatatgaacatgtttagggtaaaataagatgcttcttaacgttttgagatttaaaaaaaatttgctaatcaactttgagtgtctgttttttgagatatagggtcttactctgtcacgcaggctacagtgcagtgatgcaatcataacttactatagcctccaactcctagccgggtttcagtgatcctcccacctcagcctcctgagtagctgagaatacaagcgcgtgccaccacacctggctaattttttttttttttttgtattttttgtagggatgggatttcaatatgttgccccaggctagtctcaaattcctggtctcgagatccacctgcctcagcttcccaaagtgctgggattataggcatgagccccacgcttggctgagtgtcttaagatgaagaaaaactgaaaatgggtgtagtgtgccagtgcatgaggtattttaaatgtgtagcttaccagcttttttttttttttttttttttttttttttgagatagagtcttgctctgtcacccaggctggagtgcagtggcacaatcttggcttactgcaacgtctgtctcccgggttccagcatttcttctgcctcagcctcctgagtaactgggactacaggcgtccaccaccacggccagctaatttttatattagtagagatggggtttcaccatgttggccaggctggtctccaactcctgacctcaggtgatccgcctgccttggtctcccaaagtgctaggattacaggcgtgagccactacgtttggctgcttatcagctttttaccactttgtcgccactacattttggaattttcctttgagaattaggcaaaatgcccagactcccccccggcccccgctttagagggagaggggagcaattagactattcctttgtttccctatag

SEQ ID NO: 25906 - DNA, 1105 bp, Homo sapiens
gaggccaaggcaggtgggtcacctgaggtcaggagtacgagaccagcctggtcaacatggtgaaactctatctctgctaaaaatacaaaaattagcttggtgtggtggcacgtgcctgtaatcctagctactccagaggctgaggcaggagaatcgcttgaaccaggagacagatgttgtagtgagctgagatggtgccactgcactccagtctgggtgacagagtgagactctgtctccaaaaaaaaaagagataataaaacaattacaatgcctttattataactaacaaaatttacagtaatttcttattggctaatagcccatatccagtttttcctaattgtctcaaaaatgttctaaacaatgtccaaaaattacatttgtttgatatgtctattttattttatcttattttattttatttttgagatagagtcttgctctgtcacccaggctggagtgcagtggcgctatctcggctcactacaatctccacctcgcaggttcaagcaattctgctgcgtcagcctcctcaatagctgagagtacaggcgcatgccaccacactcagctaatttctgtagttttagtagaaatgggttttcaccacattggccaggctcttgacctcaggtgatccacccgccttggcctcccaaagtgctgggattataggcatgagccactgctcccagccgatatgtctattttagtttacaaaatggtgcggccactttggaaagcagtcttgcagttccccaaaaggtttaatatagagttaccatatgactcagtaattttactcctaggtatacacccaagataaatgaaaaaagttttttttaaatcatattctaaacaagattcacaaattgcatttgcttgatatttgtattttagtttataacactttcttctctctctctctgtctcttcctgagacagggtctctctctgttgcttaggcaggagtgcagtggcatgatcataactcactgtaacgttgaactagactcaagcaatcctcccgcctcagcctcctgaatactaggactaccggcatgtaccaccatacccagctaatctttaaaaattattttgg

SEQ ID NO: 25907 - DNA, 1027 bp, Homo sapiens
tttattagatgaatgacattaaaattcacctttaaaatgccatcctttatgagaggtgagaaatagaacttttccttcgacatggctgtacatgttcaacaactagaataaaacagtcatcatgaaccctcaatccagtattctttttataatatagctgcctgtcagttttcactgttcttttattagaccagtgattttcaaacctttttaaaggcatacagtgctttattcaaatctaatcttatatggaaccctcaacacataaatattaagataaaaataaagctgccattgttgcaattagaagtttgagaggttagaataggtaggaagtctcggaggaacatttcttcgttttacctgctttaacagtcagagaagtacctcagccagcagaaaaatttatttgttcataaattccttgagtatagagtccgtatcttatttttgtggcctccaatgctagtgctgtgcagttttcttgaaagtgcattttattggtctcagcaaattgaactcaagcatttctgtgttcttttacttttcctctttgtggaattaaggggattgctaatttgtatttttaaagaaagaacattattccgggcgcggtggctcacgcctgtaatcccagcacttggggaggccaaggagggcaaatcacctgagatcaggagttcaagacaaggctgaccaacatggcaaaaccccgtctctactaaaaatacaaaaattagctgggcgtgttggcacgcgcctgtaatcccagccactcaggaagctgaggcaggagaatcgcttgaacccgggaagcagaggttgcagtgacagagatcgtgccactgcactccagcctggtgagagcaagactctgtctcaaaaaaaaaaaaaaaaaattggcaagtttggccctaaaatttatatgaaatgaaaaggaaccagaataaaaggatttcgaaacagaaaaagatggagaacttccactacctgaattcaaaacttattataaagctacagtaatgaa

SEQ ID NO: 25908 - DNA, 1034 bp, Homo sapiens
tccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaacttttttttatggtttctaatatgtatgaccaatgtagccattgctttaaaatgtaccgtgtaaatataaacacatcctatcagatcgctggct

SEQ ID NO: 25909 - DNA, 1041 bp, Homo sapiens
ggtcttgatccaccaacagtgcccagctttctttccactcccctcttctttatggggtacttttattgttaggcagttttctcatttcgctgtgttggagcttcaggtactaaactagtttaaaccctgcattttctagacaaggaatttgaagcacaaagaagttaagtgactctacctcaggttgtataactagtggcaaagctaggccaaagctactgcctctcaatagaataaatttgcaagatttctaactccattaattatgggctgtttacctaggagaatgattaaaaagtattgttgaaagttcttagaagacatttccatgtccacagctgtataggcatctgacaaacagatagcttccatgtgaaaggtttacttagctaggaagctgtcttggataagttttttgtggccagcatcaaggtgagtaatagatttctctgcttaagactattcttagaattttacagagcagcttcaggtctaattctggcttagaggtagggaaacagcagaatgggttgagttggcctgagtggcagatttgggtctagcatgcttagtccggttaatgatcctcttggtgcaagtgctccttaaggaataggtcattcaactttaagctgatttcaagctcagacctcattgttcagcctgtcagttgctaaatacattaaatggtcactccttaactccctttatctcatttccaggacttgagttaacccaatcccttgaacttcaaattccacttctagatctagacttggtctgtttgcaaccaggtctgaagccaggccttgtcctggttggtcctcaacactcttttgccaggctttaaggggaaactggtctcctctcatagacacctggcctcccatcagccacataatcagcaccctgaatgccgcaaccattcccttttcattgctaatcaagcccccggctcttcccatactttcccagagtgactttcccatatttctaatgtattttggattcttcctctctcatcaggcctgctgcatttgt

SEQ ID NO: 25910 - DNA, 1010 bp, Homo sapiens
ttgtctacttgaatgccatgtttggcatttcattttatttttccagccaaggaataaagtggacgatggagtgggaatacagacatagtgctagactagaggtttaatttatcaacatcccagtaattttactcatttttatagatcttttaaagcagcgtaagtgtgactatagtcttaatatagttattacatttctcccttttgcttaaaggttaagtcaagtttgatttttttctcaggctcagactcgcaaagcaaatctgccttgctagaatgatgtgcctgggctcaacagctcacctctggccctgaaggcctaataattggttgccttctcattgatctgtgtgtgagcacacttcagaacagtactctgctgtttgttaaaataaaaaacaacaacaaaaaacctttgaagaccttaccgtccattctaagatgtcttttgtactaaggaaaattggggatactagattataggtgttgatttggagtgtgatatactgtgaatcggaataacttgaatttagaatgtacttaggccccagttgcaaaattatgtgtaaattattgtattggataaaataaatgagtggaagtacagccagaggagagggagccactagccattgaatgcctaccatgtgccattcacttactgcaaatatagagcacctagcctgccatacaataccagagctgtggctcaggaagtccctgctctcggggcacttacattctaggatgctagacagtttcatctgctttaaggtgtgaggacagccctcttgatgactgactaactgattactaactagagttgttttcctttttcttcccctccttcctgctgggttcctcctagagctgcaaactagaaatgtgatgtgttggggttctcatatttggggtaggggaactcttcatgcacagcattgaaggacctacaggcccttgccagaatcttcaaacaagcaagcttttcaagtcgtttttaggtatgagag

SEQ ID NO: 25911 - DNA, 1046 bp, Homo sapiens
tgaacagaatgcctgaaggtcatgattttcacgtttttagaggcctggcaggtgacatgtaatgtgtcatgcggctaagtctaggacaataggaaatgatgaggctcgctgtaaactggagagggcacttcccacctaaaggccctccaattcttaccttttaaacacagtgcctgtcacacagaatgaacctgtgggctggattgcactcacaggcagcaagtttgcgacccaatatgatctccagaattacagtaaataccttttttgaagcagccaacttgtctgtcactgacctagaaaatttttttttaggagctttaggtcagtgagttccatttcaatcagatgtttcctatggcatctaaaagcagagagacaaagaggatagaattcacaggaaggagcttaaaaacttacagcccatctgaatcacctctaggtgcagcattaatttcaaagtttgttgtgctgctaaattgaaaaccttgtctgcagccaaaatgatctccaactgccttccaaacaatgtagtctctgggagctggggagagtctcataggactgtggcttttcagatgagagaatagtaggcaagaaaggagacttcttgctaagccccattaacgtcttaatagagcttaaagcaatagtcctctttgaaaatactttattcacaattgaccaattgtcattagatgtagttacactccatggcatcttattagaaggagcttttttgaaccacctcctcatgcattcatagtaaattcctaacagatgatgtcataacaggccgttacgatccataacatgtagataccattaaagcaatgtgtgtgactttttgatactgaaacatctgactttattgtgaagtttgctataaaacctgctatgatgtatttaacaatattaaagcgtttattctttaatattggagtcatactgcccctgtaaagcctgttactgctgccacaaatgaaaattgccaaatctatcagttcaacttttaaacgcttccttaagagattttttccttcttc

SEQ ID NO: 25912 - DNA, 1018 bp, Homo sapiens
gcagtctaagctactgagtaactcacagacatcactgacactgattatgtccaaagaaatcttatggagaatacactactgcacccattcagaatcaaaaccaaaataccccatccaatcaattctataaatacatgtataggaaaaaatcttttcctgtgaaagccaatctgtgaaattagaagaagtaactattacaccagatgttcagatatcaacatgagaacacaagaaacatgaaaaaaaaagacaaggaaacatgatatctccaaaggaacacaataattgtctgtctggtaatagaacccaaaggaaaggaaatttataaagtgtccaaaataatgatattaaagaactcagtaagatacaggagaactcagataaacaatataaatgaatcaggaaaacaatttgtgatctgaatgcgaaattcaacaaaaagataaatatcataaaaaagaaccaaatagaaatgttggaactgaagaattcaattaatgaaataagaaatacaaccaagagaatctgcaatagaatagatcaagcagaagaaaaaaatgtctgaacttgaggacaggtcttttaaaataacagaaaaccaaatactgcatgttctcactaataagtgggaactaaatgatgagaactcaggaacacaaagaagggaacaacagacattgggatatacttgagggtgaagggtggatggagggagaggaccagaagaaataactattgagtattaggcttaataccagagtgatgaaataatctgtacaacagacccctgtgacacaagtttacctgtataacaaaccttcttatgtacccccaaacctaaaataaaaattttttaaaaacctagttagaacacaaaggagaaaagaatgaaaaagaatgaagaatgcctgcacgacatatgggacattataaagtgacaaggattcaaattttggtgtcccagaagatgaagagtaaaccaaaggcttagaaaagctatgtaatgaaataatagctg

SEQ ID NO: 25913 - DNA, 1503 bp, Homo sapiens
cattcccatttgaagccgtatgcttacttgctggttggtatgtttaacactgtcattcttccatctagatggaaaactcatagggcaaagatcatgttggttttattgattgctggtattgcctggcacattctgggtgctcaataaggatttgagaaataaaagaataaatgaaaaagagaacattctggatatttttgaatagagagtggttagattggtcagcgctgtgtagggtagagtgaagagtaacaggaatgaagaggaacttcaggaagctcttgcttctatgtgaggcaaaagtgttacagaataactgtgatgaagggaggatggaaggaagaggcaactttatcactcttttctaattatatttttttgaccaggaaaacagcacaagaaacaaacctccaaggatgagtaagaagtttaacaagttggccattttcagaaatatgtgtactaaaatcatagcgttccaacacactaacaacagctagtttaaaaaatgcaagaaaaaaagcaatccattcaaagtagcaaacaaaatttttaaaatcataaactaataagaattatatgaaagaccttaagcatcagcaagattataaaaaagacttccacaaatcttaaaattaccatatttttaaatgagaaacctcatcttattaaaggtgagttatacctatattaatccgtaaatggaatgcaattctttttaaactgctgtatggatttttgtgaaatttgacaaacatgatatttaagatcacctgaataaataaatgtttcagtttgagacaagcctgggcaacacagtgagaccccaaatctaccaaaaatgctttaaacaaaaattaaccagtcatggtaatgtgtgcctgtagtatgatgtattcaggaggctgaggtgggaggattgtgtgagcccaggactctgaggttatagggagctaccattgcaccactgcactccagcctgggtgacagaatgacaccgtgtctcttaaaaaaacaaaaaagaaaaaagaaaagaaaatggcaaaaaagtgaagcaatgaggagaaaggtgtcatcccatatattaacaattttaagctatattaagtacggcagtatggtaaacagtgccagagaagccaaagaaactcattgagccaaatgaaacattcagaattagagccatttagaaaagattttaatatggtaaacaagctattttaaattactgaggcaaggatgaattattcaataaacaattttgatagttgaaaaaactgaaattaaatctacctcataaaacaccattttgtatttaaatataaaatgttatataagtatataatatgtataaataaaaacattaaaatattaagaggaaatcctcatatgatctttggatgggaaagtgctttccatgagactaaaagtagaaatcccaaaggaaaactgatttcttcaactacataaacatttaaaatttctttgttagacaactgtaac

SEQ ID NO: 25914 - DNA, 1056 bp, Homo sapiens
gatcctgggtaaaggatgcctgtacattacttatgcatatgttatccagcagagctatttccatagaacttaatcagaagcaaccaggctgggagagggaaggttctgcacaaaactgaaaacgagtgttaggtgtgtgggcttgcttctttaaaaaaaaaaaaaaaagtaataattgttttaaaacgccaggcccataatcattacaattacaaaaatatctagctctcagttccttaacctataaccttagtattttttccctcagtcacactggcccgggtggtttggtccattatgagaaaacgatccctctcacccccaccctcaagactgcatatgtgcttttacagccaaaaggcagggttggaggtggaggaggcttttagtgctgctgcctgaaagactgacttggagagaggctgtgtgcaaactgctacggcatagagggtgtctcaagtgaaagataggagagaaacagcatcacttatgtgaactgatacacggggacctacctctgccatattctaccagctcttctctctcactctgtcatacaaattgcttttcaaatagacttttattaattaatttttatggaggtaaaaattgcatagaagagaattaaccattttgaagtgaacaattcaatgacattcacaatgttgtgcaaccaccacctctgtctagttccaaaacatttccgtccccgccaaagagaagaaaatcttgtaaccattaagcagttaatctctatttttctcctcctgcccagcccatggcaaactgccattcctctttctgttcatgcatgttttcctattttgatatttcattttaatggaatcatacagtttgtaaccttttatgtctttcacctaacacgtttttgaggttcatctacattgtagcatatatcagtacttcatgcaattttatggctgaatactattccattgtatacttataccctagtttgtttatccaattatcccttgacagatattttggttggctactgtgaataatgttgctatgaacatccttggacaagta

SEQ ID NO: 25915 - DNA, 1049 bp, Homo sapiens
cagtgggtgcaagacagtgggtgcagcccaccaagcgtgagctgaagcagggcaaggcatcgcctcacctgggaagtgctagcaattaggaaattccctttcctagccaagggaagctgtgacagacggcacctggaaaatcaggtcactcccaccctaatactgcgcttttccaatggtcttagcaaacagcacaccaggagattatatcccgtgcatggctcggaaggtcccacgcccatggagcctcgcttattgctagcacagcagtctgagatggaactgcaaggcggcagcgaagctgagggaggagcgcctgccattgctgaggcttgagtaggtaaacaaagcagccaggaagctcgaactaggtggagcccaccgcagctcaaggaggcctgcctgcctctgtagactccacctctgagggcagggcatagctgaacaaaaggcagcagaaaactctgcagactcaaatgtacctgtctgacagctttgaagagagtagtggttctctcagcatggagtttgagatctgagaatggacaaactgctgctcaagtgggtccctgacccctgagtagcctaactgggaggtaccccccagtaggggcagactgaaaccttacatggccgggtagccctctgagatgaagcttccagaggaacaattaggcagcaacatttgctgttcagcaatatttgctgttcggcagcctccgctgctgatacccaggcaaacagggtctggagtgggcctccagcaaactccaacagacttgcagctgagggtcctgactgttagaaggaaaactaacaagcagaaaggacatccacaccaaaactccatctgtaggtcaccatcatcaaagacctaaggtagttaaaaccacaaagacggggaaaaaacagagcagaaaagcggaaaattctaaaaatcagagcgcctctccccctccaaagaaccagctcctcaccagcaatggaacaaagctggaaggagaatgactttgatgagttgagagaagaaggcttcagatgatcaaact

SEQ ID NO: 25916 - DNA, 1060 bp, Homo sapiens
ttcttcctgttttcactcacaaactgttctcaatatctatctatgttgtatatttgtcccatttgttaatcctatctgttgggcaaattctcacctcattttcttttagagttgaacttctagattgccttccgctcaccacctcaatgagcaatacagtggtgaatggtatgtgccctttaacgggcatgtgtgagaatttctctgggagacacatgggttttcagggtcataggacataaatactggcaggttgcttttctgaatggttcatcaacttacactcagtgtatgaggggtctcattcaccaatcagtagtatcctcccttccaactttttctcgtcctgatgggtacagaataaaatttcatgtttgctttaattcatatatatgttattaacaaccagtgtgtgagcatctcttaagtaagatcttagccattcaactttcccttctgtgaattgcctttgtttcaaagacaaaaaaagcagatcattcaattttcccataagctatatgggaaatcctgtaggaactgtgaaaaaaatgtatctcacctctttctgttgtccaacttacacttctctttaaataatgttacaggctgtcgataagctgatagatttgttcattccttttagaaatatgttcaggcaatatataatatgttcaggatgtagaggggggtataagtcacatgatacctgccctcatggttttcctgaattgatggaagagatgggccagtgttttgttgtcttactttctggaggagtaaacgtcaaggcgtgagctattcatacttcgataaatgatgaacttcctctgccacatttccttttctcagttgaatttgcagtgtccctggtaactttgaagtatgaattgctggtaacaactaacaaaaggacacatttactgcttccaatgtttattaactcaaaaactcactgaggcatcctttcttaaaaaaaaaggaagaacaacttaagtaccaaaatactttgccagtatatgccctccttagaaagaaagaagagagagagagctgtaatcta

SEQ ID NO: 25917 - DNA, 1239 bp, Homo sapiens
ctatattctaaggaatagatcccaagtgaataatcaaaatttagaaaattcctactactacaatagttcagttaaaggacactgatctacaagcattgaaattagggagccagacaaactaaaagttagcagaagaatgacaaaggaagatctattgctgtttaagatttactgaacttgtcagcataatactgctctgaagaaaacactgtaaaatacacagtatctgccttgaggggttaagatttaaattggacagatgagacaagctggacaggaaatcaccataagaaagcatatgttaacagagtaaaatatttttaaggtctatacaatttctgaattcgacaaacttaaagtggaatttggctgaaaggaaataaaaataaatggcttcattctccttacataaattttcttctatacaagcatcttagaaaatatcttttggtgtcaacaaatatgtgtctctgttccactccttatggtgagtttgagaaaataaaatttctgttttaatatacaggatcaagaatatatttcttcaaaatgcctctctgaaagcataaaccttggatccccaattggggtgatcattctctttgtggaaagaggttagtaggtaaaacaactgagttgtatgcatttgctcaggaaagattggcaattatgccaaattatgtctaatagttttagaatgtggaatagtgtttattaatgtctgaagggaggcccttaaatctccctttccccccaaacttcagcttttactttacctgtcattttaaaagatgaaagaactagcttcattaagcaaaggagccttgaatttcatttttaaatttaaaacacacacacacacacacacacacaccacccatttctatttgacaagactagttatctttttaagttttcatatcattttttcatgatattttattcgatgtgaaacatgaatatcattctatagttgaaatcagtttttctctttcttctttgctaacttgcacttcttggctactgtggagtttttcagtcttcttgggcttatacattaacatcaaatatgtctgaaattcgttattaattttaggtgttgaatttattctcacgaatagtgaacattaaactctggaaggagagaaggaagcacaaatacatcaatcaacaaagtaaaaagaattcatgcccttctggctttcttgtctgtggttttttgaatttgaaagtatttat

SEQ ID NO: 25918 - DNA, 1003 bp, Homo sapiens
gatatacacgtctctaaatgtttatcaactacctgatccatcagtcctcagtgacaaatgctgatatccccacaatagtgacaaacaggattaaataacatctctccaaggactgatcagaagagtcaaaactgcatgatattaatattttttctttacctataattttattgaatataagcactgaaaagtgatacaagtaatggtaatttttagtatttaatatggcatttttccatccgtaaaatgttttatcaccatcgggtagttaaccttctaacatcatcatgaattaattagttcagttaggttcatatctcatattactcagaaggaattttccttttgtatctatggctggaaaatgtactgaaatgttgcttttaatacaaaggtaatacttaactcttcagctttcatgtgatcttcttcattgaatagcctgggaaacggaagattgtgtactatttggggcagaaagcctcattttgagggcttaatatttctctcagaatttgtaactgtgtgacttttagtgaactgcctgagccttctgatcctcagtttccccatctgtaaagtggtgataataatacatcatatctactttgatattgccataaagagatcaaattaaaaatttactataaaattctgtaattataaaaatctagctgaaagggagagtggtcactttctccccacaatcgctttagcgttctttgattcagtgtggtctcatcttcagctattcacaaatcattttcatgattattgccatgtctttgcttccttatgctattagttgcataactttagttgcatagaagacttctctaaatcttctttaaagtataaataaatctattttaaaagggaattttatgtcattattgtaaatagaattgcaatattacagctatgaatagaaggtaacagcaaaaataaataaaataaaaacaaagtaataaccactgctctgaataacacggtgttgtggtgt

SEQ ID NO: 25919 - DNA, 1032 bp, Homo sapiens
ggtctctactaaaaatacaagaactagccgggcgtggtggcacacgtcccagctacttaggaggctgaggcacgagaattgcctgaatctgggaggtggaggtctcagtgagtcgagatcgcaccactgcactccaacctgggtgacagagtgagacagagcgacagagactttttctgtctcaacaaacaaacaaacaaacaaacaaccaatatggtttctgagtgaaaagcagaggaaaagtttgagtcgttctgggagaatgtggggtagagagatcacttgctactttcccttcttctagcacctctgcctgttgttcttccctgattcttccatcccggtctcctccccacgttagactctgccagtccccttagtgaagccatgtggtggcacatcactattttacttggtgaccaaactctttaggctgctcgcttgaagaactagtcccagttttctttgtaatctacacatggatttgtattccatgaggcacacgaacactttcgcagctggaattttttactacagcggatttagttccgtcagtaaagttaggtctgtatgcaaatttgaagtttagcgcaatgtaaactttacacctaaccagaacagatgtccagtctaatcttcaaatcggtttggagttttactgtcaagtattgtaccagcaaagggaattggtttaagtacaatgatatttagctttattttcatttgccagtctgtcttggtagtaatgcaattaaattgtaaatatttattgaccactgaacgaacagcttctacaagaaatcatctagttattcacgacttgttttttgaatgaaaaacttcaacatgctgattttttttccaagtatttgaatcatatacacatattcttttaaaacttcaacagataatatggagggttttaaaaattttttatgttatcttttgaatactaaataactgcagcctttgccaagagatatgtgaaaggtgtctgtatttaaaccatttattcatctgaatgttttattt

SEQ ID NO: 25920 - DNA, 1054 bp, Homo sapiens
aaaaaaaaatgttttttttttgagacagagtctcactctgtcgcccaggatggagtgcagtggcatgatcttagctcactgcaacctctgcctcccgggttcaagcaattctcctgcctcagcctcccaagtagctgggactacaggcgcacgccaccacgcctggctaatttttgtatttttagtagagacagggtttcaccatgtaggtcaggctggtcttgatctcctgacttcgtgatccacctgccttggcctcccaaagtgctgggattacaggcataagccaccgcgcctggctggaaaaaaatttttatgggaaaagttaaaagataaatgattgttggagtgctttcacattatctgaccattttaaagctgttttacttagtataaaagagcctcctgagtaatactggtgagactaccaataataagtattctctgttttcaggtgtgtagcttggagtttgacagaaaagacataagtatgaataagttagtagccacatctctggaaggaaagttccatgtttttgacatgagaacacagcatccaaccaaaggttttgcctctgtttcagaaaaggtaaatatgagggaaatgtctttctatgaagaagaatgatagcttggtttagactgataagtagaattagtcaccaaggtttcttccaggtctttatgtgaagggagctatttttgatatattcctgtgagatcttgacaagtttttctgtgcaaagagtacttccccaaagtttatcaactttagacttcttgattataataaagatctcaggtaggaatcttattttgtagtttaggagcaattagaagaaacctagctgatattaggaatttgatcaacaaaacccagcctggtgtttcctaataagtatataatatttgtgctaatacctggttatatatttttcaaaataaactatatgtacatgatgtcatttcattacactttgttttatattccagtttgctatattaaatgaaattatttgaatcactgagtactgtgattatagtaaatgttcaa

SEQ ID NO: 25921 - DNA, 1014 bp, Homo sapiens
gcttggtgtccttgcatgacatggagttttgcatgtagatcaatttaaaatgtacctcttgtttacataatttgcataattttaaaagataatgttgccaaactttggaaatgttaatgttcagactgaaaatctccactacatgtaactttcttcctctggatcagtggcatggcttataatcccagccagtggtttgaactgttccagtgtcaactgccatgtgctctgcttcaagggggaactagccttttgtgaattttttgtacataagtatttgttacaaatattttagcaaatgctttctatttctcttgcttgtgcatatcttggctggcgttacagaaaaatagtgtaaacattatttccttaccggggaatgagggttttttctttttctttttttttttttttttttttagtttgtgtgtgggggtgggtaagggaggggatggtttatgttgaatgtttagtttttcttctgcatgatacgtcatgttgtgggatctttagaaaacttcatactgtatgaataagaaaataaaatatttgaaacttgcttgaatgtattcagtggtctttgatggtttccatagctatgagaattttttttcctctcaggcttttaaattcttaaaaacagtctggtaaagtgacatttaatctctataaaaacctacaaattcctgtagtactctcccatcacctcctgccatgacttcccttactgctacccctctctctactccagccatgttagcctccggtggtacctggagtcttgggtttgtgtctcttaggcccttgcgctatcagtccctttttgcccctttcctttcccagtatctcatagctaatgccttcaggtgtttgttcagttacagcctagctcaaaaggaactgtcctggctaccctattaaaaaatacagatacgcctggctcttctttcctcctctatatttttccttctacaatggcatttattcttttctgacacagtttacttacgtatt

SEQ ID NO: 25922 - DNA, 1034 bp, Homo sapiens
aagtaattttttttttttttttttgagatggagtctcgctctgttgcccagtctggagtgcagtggcgcgatataggctcactgcagcctccaactcccgggttcaagcgattctcctgcatcagcctgcccagtagctgggactagaggcacacgccaccacacccggctaagtttttgtatttttttagtagagacaaggtttcaccgtgtgttagccaggatggtctcgatctcctgaccttgtgatccacctgccttggccttccaaagtgctgggattacaggtgtgagccaccacgcccagccccctagtaatattttttaaaatttgatgaagtagttagaccacgaatgaggagtttctcagacactgtgaagcttgatttgttcctgtctgttgcaggttgtaggtggcctagatatccacaaaaagatggtggtagatgtgtgactcttatcagagagtaccacccaacacttttgctttcttctccatctctgaagatctgctcaagacgtccagcaatgctctctgtgtatttaaatggaagtatttttctctgtgaagccacattttccaacatgagcctcatgaagccaactaagtgttattgaactgtaattctctcaataactcagtgtagcactttaaagtctgaaggacagcaacatgaaaagagcatatcaatgtggtggagaaagggaaggggttggctttttaatttatttttcttcatcttttataacaagaaagtatctatatatacatatgtaaatatttatatatagatatatgtagctttctatatatgtagtaggttggctttaatttaatatacttgattcagaaacaaaacaatagagtacaaaagtgccaagcagaacataaaacatccttacttttatttcacacagttttatatatagatagaagactgtacaatttgagccgggtgttaggccagctattttccttttcctgtgctttctcctttgagagattgacaaagcatttgttaacgtcctattat

SEQ ID NO: 25923 - DNA, 1071 bp, Homo sapiens
tcaagcgcttgtaactggcttcattgagttctttttatgttgacttctcaagctataacagtgaaagattggaagttattttaaaagattgcatactatatatgtactttaaaattttcagagtacttaatgtatacaaataattcttacagatgattagtgacaggcttaaagttggtgtattgaacccatgtataatttatttttacctcctccccaaactccaataaaatgcaatgaattagaaagggttatgtactcacaaggacaaaaatgaagagcagagaagagacagcatctaaatttggtaatttagaacgtttagaaagttgaatggttaactaacctagcagaatgattctaagctttatcagcttggaaatctgagaaacaagctgggttataatggagaatccgtgaaaggctcagaaattgatggcacaagcaactggaagtgaggatgaaagtgaggctaaaaacagaaagactggttaaagtctgttttaagaaggaactggaacacacaagatcgccttccctactctgttcccctggacagctctctctcctgcaccctatcaagagattggggagagtctctaggctgggaaacatgaggcagagatgaggtatatgtgttggggagctaagtggcagtaagcatatttgcatattggcatctgtgcccttgttctgtacctgacttcctgactccctagcagctggacttacactgtctaggtaagagatgggaaagagccctctttaggaaatcttatctccccaaagaaatggtgctaccagatcattcaaagtatagctctcacttaacagccccatcattcacccagagttccagtgccctttctacagaagcaaagccaaggatctcaccaaacactgaaggaaacctctgtgtatggaatataaagatgaaaccaggtccaaaaaaataagttcaaaacaaacagattagacaagaccagtaaaaattttaaaaggaaaactgaaacctgtcattatccttggggatattgtatattgaatttttgaaacaaaagttggataata

SEQ ID NO: 25924 - DNA, 1035 bp, Homo sapiens
aaatcttcatgatcaaggatgggtaaagacttttagtacacacaaaacaggaatcataaagggaaaaaattctatttcattaatattgaaaggttttggttttaaaaatacacctatgaaaaggcaagctcacagactgggagaaaatactattagaaaatacctaacaaaggacttggatcagtatatagagaatttcacaaatcttttacataacgctttttttttaaaagcacaattcactaataaaaatatatgaaaaaataggcaataccacttgttagcaaggatgtggagctactgaaataatcatatattgctgatgggagagtaaaatggtacattactttggaaaactgacagtttctgaaaacttaaccctgtgacccagcaattccaggaaaacgtttgtttacagaaatacacattaatatttatagtagctttacaggaatgtctgtcaacagatgaatgcataaacaaattgtggtatatccatataatggactatactgctctgcagtataaaggaacaaactgacacatgcaacaacatggattagtgtcaaaaacttggtgagtaaaagaagatagacgcgagtacctactgtatgatcctgtagacatgaaattctagatagaatttagttatagaaagaacagtggttgcctagggtggtaagaaaagggtgattgactgcaaaagggctcaagggagtgtttaggggtcatggaatgttcttttatcttgatggtagtgatgcttccataggtatatgcatttgtcaaaacttatataaccatatacttaataatgcatcatttgaaggtagttattcctcaaagttggcttaaattattttagcatttttaggccaggcgttgtgcctcacacctgtaattccagcactttgggaggccaaggtgggcagatcacctgaggtcagaagttcaagaccagactggccaacatggtgaaattccgtctctaccaaaaatacaaaaatcagcagggcgtggtggcgcacgcctgta

SEQ ID NO: 25925 - DNA, 1038 bp, Homo sapiens
tttcatagtcaatatttttaatcatagtattatatagtctgtcttcagtaaatcttacaaaattaatgttataattgtctacatgaataattctaggcaagactagatttgtctaagacataggtattctgatatatatatatcagaatatatatatatagtgtgtgtgtgtatatatatgtatatgtcattcaattcagtgttggatttttattgaatttattctaggccgttgtgactttatttctgtctgttggctaacctctctggactaggaaatgtatactctgttgaggtgatttgctcaaagtggaagccttagttctaacttggcatgataactttggaaaagtgactgagtgcaagatactaccttagataatttaagcagaagactagattggggcacaattgaaagtaagagtggaaaatcagattcagctaatttttgataaagccagtgtaattctgagtggtttagataaaattagtaaacacaagggctgttttgtagactaaatgtaggtgaaagattaaatcttttatctaaaaagatgtctcatctctcttttgttagaaggtcccctaagaagagcttggcagactctgaaggaacctctccttttgcataatgaactgccagtagaaacccttctagccgttagaacgctgtttctgtttttagtaaacagtttcacattcaggcagttttgtttctggtttgagtatttacaggtgatgtgaaagtttaaggataataactttgctgttaatgtctgctcttaatcacattcgtctcagggaggtttgctgttttgaaaacagtgttttcagagaaaaaggttatctgtagttaatttgatttcctctttcatttcagcatttttttttttttgagacagagtttctttcttgttgcccaggctggagtgcaatggcgcgatctcggcacactgcaacctctgcctcctgggttcaagctattcacctgcctcagcctcccgagtagctgggattacaagcatgtgccaccacacc

SEQ ID NO: 25926 - DNA, 1026 bp, Homo sapiens
acaacaaacatctatttctcagagttctggaagctgggaagaccaaacatcaaggcagtagtctggtgaggaccctctttttggtccatagacactttcttgatgtatcctcatacggcagaagaagagatcatctttctcatgtaccttatgagggcactgaacccattcatgtgggctccaccctcatgaccctcatacttcccaaaggccctacctccaaataccattacagttaggatttaggcttcaccacatgaattggggttggaggagggcataaacattcagtccatagcaatgccctaaagcattctacctgtgacaactcatgtaatttctcattcagggagaaaaaaaaactgtccactataaccatttatatcagcagttttgtacagtgataaatagctcctaagctaggaattaggagacctaggttcttgtcctgctcctatcattggctggctttggagtctagactgagggcaaatcatctaacctctctgaatcttagtttttttgtccataaactggagataataaaaccaggcacaagactaaagtggaatgatgtatgtgaaagtatcacataaaatagggtgctatacaaatatacagaattatacctgtgcataaattgtaccacccaggagcctgcctgggtacattctccttagaagggacagatgggcggggagggagtgaagagcctgtataattgttcctgttctttaagaagaatgtcagctttcaagaccccatctgtttctagccagacaagaagaaattatgagctaggtagtaagaggcccaggaaatagagctccaaaagaaagaataggaagacggctaatgagaagtataaacagctaaggcatcggggagaggaagacatatgcatagttaccagcagttacatttacttcaacgtgaccttaggtcccacattaataaaccaaatttgaaatattaatatgaacacttaaatatatctttagctatgactgttgctattggcagatt

SEQ ID NO: 25927 - DNA, 1033 bp, Homo sapiens
tcgattttttttgtatattgatattgaatcctgagacttagctaatctcactaatcctaatagctgtttttggaggatccctaggattttctaaatatgctatcatgtcatctgtaaatagtttctcttttctttccaatctgtattcattttatttatggcctaattgcaatggctaggaccttcgcagtatgctgctaaatagaaatggtgagagtggacattcttgtccctcagtctgagagagaaagcattctgtttttcaatacaaagtatagtagctgtaaggttctttattgtaaatctttttatcaggttaaaggagttctcttctattcctggtttactgaatgtttttttaatcatgaacgtattataacatgttttcaaatagtttttctgtatcttttgaaatgatcataaggtgttttattctgtttatggtagattaccttgctttttcaaagttaaaataaccttgaattcccaggttaaataccactggtcatggtttattctcggtatgtaaaactggatttgattcattaatattttgttaaggatttttgacatctatgttccgggggggatatttgtctatggtttgcttttcttataatgcctttgtctagttttgggtatcagagtaatgctggctacataaaatgattcggaaagtgttcattcttctattttctggaagagtttatatagaaatgatatttttcttaatgtcagaattcaccaatgaaggcatagattatactttatttgaagattttttattacaaattcaatttcgttaatagatatcgggctattcaggttttatttcctgagtttttgtaatttatcttagaagtcatttatttcaattaaattttcaactttattcccataaagttgtttataatctccgccattcttcagtgtcttaggatctctaataatgtctactcttttactctttgatccttttctttttttttttttttttttttttccccggagatggagtctcactctgtctctc

SEQ ID NO: 25928 - DNA, 1045 bp, Homo sapiens
tgtctaatgttttcttgatttctagaagaaatgtgcacgttaaggcattttataagactgcctcactgacctccagaaaagctaggcaatttacacgcctatcatctgtatttaagtatccatttctctctgcactaggtatagtttgtcatgtttacatatttttaatctgactgaaatacttcaatttttacttactgttaatttgaaatcctgacatattcatttactatttgtatttgcttcatggattatatgttcatagttttcacccatttttctgcttaagtgtatcttattgattttttgaaaaatctttataaatttaaaatcgtcatttttatcacatcttgagtgttcatttaatattttaatttttattttgtttacaatataaaatataaattttgtagtcaaacatgttagccttttcctttattattttgcagttaagatccagcttagaaagtcttccttgactcccagattaattaattatatatagacatatacacagtggcatttgtgtattttcatctgaactcttatggtctcatttgttaaattttagatgaattacagatttagatattatttcagttcttacttttatattggaaagtatttgcccacagtgtcctaatacaattatttaaataatctatgcttctccaaaggtcagtttcatagaaatttcttatattgcaaaaattttatctcctcctatactccctaatctattccattgatctatctattgttacaccaatactgcattgttttagatacactgtttttataatatgtattcatatactttgtaactgaccaccttactgaacttgcttactaaaatttttcagcaaatcatcttgggtttttcatatagatggtcagaatctgaatataactgtctttttttttcctggtcatattgcattgtctaatgtttctagaataatgttgactgctgctagcagtcaactacagctagtagcagtagttggagataatttatcttatttgatatatttgatgaattaca

SEQ ID NO: 25929 - DNA, 1020 bp, Homo sapiens
tcctttcaattctttcagtgtttattttgtatacttaggagctctgatgttggtgcatatatatttataattgttatatcctcttggtaaattaatctttttatcattaacaatgttctttttctctcttgtaacagtctttgacttaaagtctattctgtgtgatagtagtagtatgctattccatcacttttggttacaatttgcaaggaatattttttccgtgtgtttaatttcaacctatgcatgtccttaaatctaaaatgagtcttttttgtctctaaagtgagagagcatatagtagaatcatggtttgttattcattcagccaatctatgtattttggttggagagtttaaccacttacatttaatataattacggatagggaagaatttactactgctattttgttaattgttttctgtatgtcttatagctttttggttcctgagaaaagaattttctgatggagctcctacttataattagataattgtataccctgtgctggaatgaaatgaaattgaatgggcctatgatttatatatatatatatatatttttaaattatactttaagttctagtgtacatgtgcacaatgtgcaggtttgttacatatgtatacatgtgctatgttggtgtgctgcacccattaactcgtcatttacattaggtatatctcctaatgctatccctccccactcccccaaccctacaacaggtcccagtgtgtgatgttccccttcctgcatccaagtattctcactgttcaattcccacctatgagtgagaacatgtggtgtttggttttttgtccttgcggtagtttgctgagaatgatggtttccagcttcatccatgtccctgcaaaggacatgaactcatccttttttatggctgcatagtattccatggtgtatatgtgccacattttcttaatccagtctatcattgttggacatttgggttagttccaagtctttggtattgtgagtagtgctgcaataaacatacat

SEQ ID NO: 25930 - DNA, 1034 bp, Homo sapiens
aaatttccaaatggtaaacatgacaccttaaatgaccttccttttgtgccagctcacccagttttatcagaaacagtgggaaacacagtaggaatacaactgctgctgaaatgacagtgtgaggagctaattataacttccttccagttctggagtacaagaacttcaagtgtagagcagttggcaagttgcacacttgattccaattagttccttcctggcatccttgcttacatagcacattgtgaactgtggaagttggaggccaactgagtgggaccacagaaagactgtgctcaggcacagggtgcattttccagagaggagctaaattagacagggccaaatgggtccatattcttaattaaacagaggctaatctgcaaaaatatttaattagaaactttaaaaaagagtctatattgggagcagaattactgaaatacaagtaatgtcaaagttgctacaaagggtttccacatagcaggtgacttcctgcatgttttggaacagggactgtaaatacagtgacataagcaccatgctaaatggcagccacatgcttggcctgggtactggggtgacaatggagagtggtgaggagtatggtgaactggaaagtgtatacgtttcttttaaaggaagttattcagtcctcaataatcattaacttgtaataaatacaggttcagtgttgtcagttctgatttttcaagtcaagatgaaaatctgtatttttaggtgaaatccgattttctaaatgttagcaataaatttaagttaaaaaatgcagtatgaatcaagaagaatatatatgcagatcagataggacttgtaggctgccagtttataacctctgagagtggaggagttctgggaaggttctctctccctatatatgttcaccagtgcagtgattggattccttccttcctctctcccttcctccctccctccctccctccctctttctctctctctttctttctttcctgatggagtgtcactctgtttaccaatgcagtgattggaat

SEQ ID NO: 25931 - DNA, 1348 bp, Homo sapiens
ctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttgacaatttggattaaaatatttaaagtagaatgttattatttgatacccccaaaattgtgagtaataatttcttaatggagcttttctggccagatcttcagggctataggagagtgtgtttgtttttggtgaagtccttctttttcaaaggtttttacttttaaattgtgaagataagctatttagcacaattatttaagtaagctgttttttcctttcttttctttcttttcttgttttaacttctgggtgaggttaagattttctaatagttattgttgttgccagagaagcatagaattctgcttgtgtcttagggttagagaaagatttgttatattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaacagcctgggcaacatggtgagacctggtctttacaaaaatttttttggccggacgcagtggctcacacctgtaatcccagcactttgggaggccgaggcaggttgatcatgaggtcaagagatcgagaccatcctggccaacatggtgaaaccccgtctttactaaaaatacaaaaattagctgggagtggtggcgtgcgcctgtagtcccaactacttgggaggctgaggcaggagaatcgcttgaacccaggaggcggaggttgcagtgaggcgagatcacgccactacactccag

SEQ ID NO: 25932 - DNA, 1075 bp, Homo sapiens
tcccaagtactggttcagttcactgttactaagatagtttatttttgttttttggagacagggtctcactctgtcccaggctgcagtgctgtggtgcgatcctggttcactgcaacctctgcctcccgggctcaagtgatcctcctgagtagctgggaccacaggtgcacaccaccacacccagctaatttttgtattttttttagagacagggtttcgctatgttgcccaggctggtctcgaactcctaagctcaagcgatccccctgccctggccttccaaagtgctgagattacaggcatgagccaccatgcttggccctaacgtagttttaagagatagagaatatatactgtaaaaccaatgggaattttattttcagctttttaaaattaaaagttctaaattcttcagatgcagctgcaactaattgtcctgcttttttgtgatgtttcaggcttataccagccagtttgtatcccttgtgatgtttgcccttatgatgtgtgatgatcggatctccatgcaagaaagacgcaaagagatcatgcttggattgaaacggctgcctggtacaaagacactcatatattacacttttgttgtctaagggagtgggtaataggtaaaattctcttatccttgaagctgtggcttgtagctatttagtcaataagatctttctacgtttgctccgatgtattaaaaaaatacccatactgattgatagcacagaggaatagaaacactggtcttttgttatttgctgccaatatattgttattttatttgtttggtttattgtccttttttgctaatattacttcttagatttgattaaggaagtactgagcatggatgacgaaattcagaaactagcaacagaactttatcatcagaagtcagttctgataatgggacgaggctatcattatgctacttgtcttgaaggggcactggtaagttttctcagttctaattagtatcagtccattgacctgcagacctgacacatagtcatacttttacattaaatgaatgaaataggtagaacttttgaaagtgcttctgtat

SEQ ID NO: 25933 - DNA, 1027 bp, Homo sapiens
agtgcaattttactttgtgggcacattactgcaaagaaaggtagtctgcttttttttttaaatcagattttattctttaaattgttcttttagaagctgaaattcagtatcaaaaatgtgtattgtcagtgcagaagcataggtgtatgagggtcttttattccaataaaagaccaatatttgcccacgtagtttccttagaaagagacagtttatgtgttgctgatgtcaactgttatgaacagaagacctttacattcaatttctgcttttaggattgacttccaaagttcctgacataacttatttatttgctgaggcataaatatttattaggagccatttatttaagcagtgagtgaaactatctggtcacctgcccttgcatctcaacaagctttgctcttttctaagactacaccaaatacctcctcccctcctcccccaaaattatatggtcctaaacagaaagtctatgtaatgttgaagggtagaggtctaaaaaagtgattgttttgtctgggtgttgtggctcacacctgtaatcccagcactttgggagggcaaagtgggaggatcagttgaccctaggagtttgagcctgggcaacatagcgagaccccgtctctaccaaaaaaaaaaaattatcggggtgtggtggcaactccctgtagtcctagctacttgggaggctgaggcaggaggatcgcttgagtccagaaggtgaggctgcagtgagcctagattgcaccgctgaactccaacctgggcgacaaaaccaggccctgtctcaaaaaaaaaaaaaaattttgaacacgggaagaagaaagatgtaaacacgttagtggtggcttagatctattactgaatgagccctgtattcagaaatagaaaatttgattaaacgcttcatctaacgctaagacaatttgggggcagaaattatatactctgttagaattctctaatgtaagattttttgttgttttgtggatgccaagactactgtagtaaacaaacattagaa

SEQ ID NO: 25934 - DNA, 1047 bp, Homo sapiens
ctttctgatctaatctgtttggtttagattgctatgcagagttccttttattttttgtccacaatgaccaccttccccatactttcctgtaggggttggcattagtaaccagaaaattctctgagatactgcagagtgatagagtttatattgaaatttggttcttgtatccaaatgatagtttcatttgtaataatgatccttggttatcgattgtaatatctccttgaaaactttatagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggtgaaagtttttgtcatgttatagcttgctgtccttactggaaagaatatattctacttcctttcctagcatattaaatctagtaatgaatgatgagtggaatcttccacatgattagtgaagggacaacgctaggaaaagggatgattctttagagaaattatctgctgtttttacaatcgtcttcaaactaattaatgatttgttatttgtaacattataaaaaggttattaacacttgatactttaaagatactttataaacataaaaatagttaatgttctgttcctttttattctctttgtgctttagttttcttatatataacatgaggataatatagcctgcctcattaaggttgttttgaggattaagaagctactatatggctgggtgcggtggctcacacctgtaatcttagcactttgggaggccgaggtgggcagatcacctaaggtggggagtttgagaccagtctggccttgccaacgtggagaaaccccgactgtactaaaaaatacaaaattagctgggtgtggtggcgcatgcctgtaatcccagctactcgggaggctgaggcaggagaatggcttgaacccgggaggcagaggtttcagtgagccgagattgcgccattgcac

SEQ ID NO: 25935 - DNA, 1068 bp, Homo sapiens
gatcataacattattcttacacattttatttttttcacaagaaacttgaaaacaaagcaaactttgaagtagattgattgaaaaaatatttttaaaattctccacaaaacccaggaaaccgcaagtattttatgtacctactcatatgaatgccatcataatcattgtaaaagagtacaggtagaggaaaatgatggattttgtcttttttttttcccacataagccatacgtttagctctgtagtacttgtttaacgaattaaatcaatacttattttgcctgtattgtagtgtaagattagctaggggtaaagcagacacccaaataactatacttcaaaaacagtagtataaatatctactatgtgttctgcatcctgtataccaggctgattgtagcaggttctgtaggagagaacagacattgctgtgagattcaggggagagttcccacaagttgacgagactgggaatacatagggaatgggtgctgattatatttggtcagtgaagatgtgaagggaggaccttctgagtagatagcatagcaagataagaagagtaatggcaggcgtgttgatggaatgatagtagtcctttttatttacagtattggtagacaaataagggaggctagaaaggcagattgtgaacagaatcaccatttttcaatgtcagcatattgaaacatgcctcttcgtggtcaacttttttttttttttcttcccttcccagatggagtctcgctgtaacgcccaggctggagtgcaatggtgcaatcttggttcactgcaacttctgcctcccagattcaagcgattctcctgtttcagactcccgagtggctgggattaccaggcgtgtgccatcatgcccggctaatttttgtatttttggtagagatggggtttcaccatattggccaggctggtcttgaactcctgacctcaagtgattcgcctgcctcggcctctcaaagtagtgggattacaggcattagccactgagcctggccaactggtttgtttttgaagtgtagttatctgagtgtctactttactcacagc

SEQ ID NO: 25936 - DNA, 1032 bp, Homo sapiens
tgttgcccaggctagagtgcagtggcacgatctcagctcactgcaacctctgcctcccaggttcaagcaattctcctgcttcagccgcctgagtagctgcgattgcaggcacctgccatcatgcctggctaattttggtatttttgtggagacggagtttcagcgtgttgcccaggctggtcttgaactccttacctcatgtgatccactcgccttggcctccaagttgctgggattacaggcgtgagccacccagccctgccgcattaatctttaaaaaaaagtagagtctataaattgtcttaaaaacaattttatatcattagcatttaaatagttttaacacattcatatacatctttaatctttaaatcatttaccatccggcttacatttttatgtttttaccaactttcatttttatcatctggcttacatttttacttttactatcagacttagatttcttaaaaaagagagagtttaggagtgagtttttctggatgtgcttagaatttggcagctctggacaatctgcaaacaatcctcgacaggcttctgttttcaaataagctagattgtatcctcctttagtggactctagctgatgcagtcacagtggtgggaactagttcagattcagtttttttcacacttttttttttttcttttgagatggagtctcgctctgtctcccaggctggagtgcagcagtgcgatctcggctcactgcaacctccgcctcctgggttcaagggttcaagtgattctccccgtctcagcctaccaagtagctggagtacaggtgcacgccaccatgcccggccaatttttgtatttttagtagtaactatgggtttcgccatgttggccaggctggtcttgatttcctggcttcaggtgatgcgcctgccttagcttcccaaagttgggattacaggcgtgagccactgcacctggcccacatttgtattaaagtattgttttagaaaagatttgtgtgctgtgtattgtcttttaatgacctggtta

SEQ ID NO: 25937 - DNA, 1028 bp, Homo sapiens
tggtcggcaaagacaaaaatatttaccctatggccctttacagaaaactgatttgactcccgctgtaattcttgcaacctgctcctcttacctcctgcccctgataagtacattttactcagcaagctggggtccccttccctgctagcgcccctcattagcagaatccctccaggaaggctcaccctggcttgcttctgcagtgcccacttggcccatggaaagttttggcatccttgtcccaccaaatatgagagtgcaagcctgtctcctgtcccttctctctttgctgtgcctcttgtgggctacttggacccacctctcttctctggaattcatccccaaactcctgaggacactccaaggaccgtcttaccatattttaccccagtaattggggagactgacccaaaagtttctgcagggcaggaagcccgcagtcagggagtgagacctcacactcctctaatcataggcaacctagggcctttaaggatgattctcagttggcttgtcttacgtaacatggatgggttgggtggaggtgtcaccaatttttttttttaacatctttcaggaagcctaaccactttaaaatgttagaggcctttgatatcacccagtgtccttgacttggaggcttaagccaaaactccaagacagcaggaaagtcccattccatatcctgttccacagggctaccatgctggttaactccagggaacgattcacattgcatcttgttttattgtggcctctagagttaaacagggcacacccttcatagccagaagaggtagccttccagctacatatacatatacatagctacaaacccgaatgaccaggtgttcccaggtattctcttagatctcaaatctaggaacacctggctttggaggtaaaaggggagaagtagtttgatgaaggaaatcaaggttttgttggtttttggggtaatcattaggtaaaaaatagaagagcgccaggcgtgatggctcacgcctgtaatcccagcactttgggag

SEQ ID NO: 25938 - DNA, 1050 bp, Homo sapiens
aatgtcccacatttgatggcccaggccaaggggattagtagaggggatgctgagccccatgatttccaaattcaacccagcaccactcaggctgagaaggagggattcaggggtcattgagaaagacagggatgtccagggagcgagatgaaaagaggcagagagacatgagtggggtggggtggggtggggtggagggagaacagagcagagggtgtgggtggggtcccagagccagaggtatgggtgacatcggcactgaggggagaagaaaagaacagtagacacatgcacaaatagggccacgtaacaactggtgagcactgaggagcctagggccgcggtactgtgctggagtcggtgatctcaggctacagtttatataagacatcaccactgggggaagctggttgaagggttcacaggactgtatgtgcaggaacttcttgtggttctgtattacttcaaaataaaacgttttttaaaaacccactttatagaaacaaaatgaggcttttttttttctagaaagacagctgacaaacaaaatgagattttaattaacgaacaaactgaatactgaaatgcaaagtaaagaatgattatgtatggctgggcacggtggctcacgcctgtaatcccagcactttgggaggccgaggcagttggatcacaaggtcaggagttcaagagcagcctggccaacatggtaaaaccccgtctctactaaaaatacaaaaattagccaggtgtggtggtaggtgcctgtaatcccagctactcgggaggctgaggcagagaattgcttgaacctgggaggcagagcttgcagtgagccaaaattgcaccactgtactccagcctgggcaacagagcaagactccatctcaaaaaaaaaaaaaaaaaaaaaaaaagaatgataatgtaaagctgcatgtggtggtgcatgcctgtaatcctagctactaggctactaggctgaggtgggaggatcgcttgagcccaggagtttaagtccagcctagttaacatagcaagacctcagtctct

SEQ ID NO: 25939 - DNA, 1015 bp, Homo sapiens
atgcttgcatctcatcttccttgacaagatgcctgtcttaaagtgggccattggactgagggaggtgatgggcctcatgagacctcaaattacccacttacactgaattttcctggtctccagatctagagcttaggccatttcacatggctaaactgctttgttaaaatgctgctttcccctaaggacactgatatgtctaaaggtccagaagcctagtcagcacttctccaggtaatactttaactttgaccaaaacataaagttgacatcatagtagagtggaagacacagagcctttgaaggctttgactaactgggagattgtcattgacttgctttctgtaaactggctcatgtcttccatcttggtatgaatgtaccagtttttcattttccaaggattggcttgcctccttagacaacactgagacttccttggtaaaacttatacagcacatggtttagagttgaatggtgaaggaggcaaggaccatagagaagatgctagaaagaacctttatcataaaatatcaaacaatgtgaaaacattcttccctagataatgactccaaaatacaactgttgtcgttttctggtgaaacgtctagagccagctgtgccattctcatagcatcttcataataataagagctgacttttagtgcttatgtagcaagtgcctgttggaattatcttatttatctccacagccctactgttacctcattttacttccgagaaagtttaagcaacttgccacaaagttgtctgctaataggtagaaggactgctgactctaaacccaagcccttttttaaaagttgtggttacatacataatataacatttaccattttaatccttttttagtatacagttctatggcattaagtacattcacattattttttttctctctaacagatgaaatactttaatccatatattaataaatccccagttggataactttttttattatactttaagttctagggtacatgtgcacaac

SEQ ID NO: 25940 - DNA, 1033 bp, Homo sapiens
ctgcgagctctgcctcccgggttcacaccattctcctgcctcagcctcccgagtagctgggactacaggtgcccaccaccatgcccggctaattttttgcatttttagtagagacggggtttcaccgtgatagccaggacggtctcgatctcccgacctcgtgatccactcgcctcggcctcccaaagtgctgggattacaggcgtaagccaccgtgcccggcttttttttttgtatttttagtagagacggggtttcaccatgttagccaggatggtctcgatctcctgacctcgtgatctgcctgccttggtctcccaaagtgttgggattacaggcgtgagccatcgcgcctggcgctagttcattgattctaagaaaacaaatttgaaaattaggtgatttgcctaaagtcacaccgccaattaggcccttctgagcaactcccaactactgtctcttcccacattggtcaacagtcatttgtgctaccttggcactactaacattttggtctgggtaactctttgttgtggagggctgtcttgtgcactatgggatctttagcagtatccatggcctctacccactagttgccagaattatataatacatacacagcctactgtggcaatgaaaaatgtctcaacattgctaaatgtcacctgtggggcaaaattgcctgttttagagaacatgtctagttcagcatgtttgtatatgttctggtcttctgttggtaaagttgaagtaagtattgcaatatttttggtcttttttgaggaagaaaatggtctacataaataattcagatgttctgtgtttatacccaaagcaaaaaagccttttatttgctgtgaatttaatcactcaggaatgataaactattagcttgtaaggtgatactggctgtagcattttatacctcctttctcccttttttgtttttattattattgatctattatttttattatttagcctattatgtatactttatttatttttgagacagggtctcactttgtcaccc

SEQ ID NO: 25941 - DNA, 1033 bp, Homo sapiens
ttctggatctgttctttactagctgtggaactgtaggcaagacattccaaaccactcttgaatctctgtttccctgtggcagtggttctcaaagtggggcatacttatcacctgcgagcttgttggaaatggagattctcaggcctcactctgtaggctgtgggtgtggggcttaataagttcctggagagattctgacgcaaggtcaagtttgagaaccactgcttaatgggctggtcatgaagattaaatgaggcaatatatataattaacattttcaggtgttcaataaatggtagccattacttaccagcaacgttatacatcatatgtatatatgtggggggggagagagagagagagagagagagagagtgtgtgtgtgtgtgtgtgtgtgtgtgtgtgtgtgtgtgttaaaggggagtgggagcaatgtgaaagctagttgagctgcagcaatctgaagcaattcctttcccccattgttaggggacagagccagatgttctttgcagagtcctcaccagctccttaaaggcttaacagacgttttgggtagccatgctccttccctggactctcttctctgtgagtccccgagtgctgacttatctacagttctagccagagttgtttaaggaccacaggagttgtaccctgtgtgcccagagcggtggctaggcagtttagggaggagtggtgtgagaggcttcaaaacacagaccagattaccaccacattccgctgatgatctctttttctctagcgtgggtattggtctgtgctttttcataaggaattgcaagaaccccaaggagcaggtgctgggtaagacaaaaagatgtcgcactgccatacctcccctggtagcatcagccttcctggcctggtttcactaactagtccagcaggggctgtttgggggaagtgaaggctttaagttatgagtttagaggaatatggctatttctaggctgggtgccagggagaatattttctttctagctttctcagcaaagatgccatgatgaga

SEQ ID NO: 25942 - DNA, 1034 bp, Homo sapiens
catatcctcatgggggtcactgggcttggccagtctgcttatcaactcttgctcttctctcccctttgcctccctctgcaggggccttaatctgcccctggtaggggaggcttccactgaacaggcacaggtgagggagagcaggctggcttagagggacagggtccccatggtcatcaagctgctgttgatgacaaagactcaaaggctggaagagctcccaaggaagctagaaatgcttgtctttgaaagaactgtgggaccccttcagattccctgaggtatggcttggtcactctcaggtcctcaaagcctgtcttagttgggctgggtcctagctgcagggtctttgtgagggtcacagttgctctgggacacctccctgaagagcctttccacctgtacaatcgtattttctttctgtcatttgctttgaagcccattgtgccttatgccaataattcaattgctgcaaacaccaataaagattgattcatggaaaaaccatgtaatgtgttgattgaggatgagaggaatgtgagagggagtcagcatcaaagacaagggagattcacatgtctactgagtgcctagctggaggtataagaacatatacacagggatgacaggtcttggattttctaagacagtctcagcataaaatattttgacttattccctccagaattgctctcattattttgaatcgtcataattcctctacttatttcaatctgtagtattttagcatacaaattgcctctatacccaaaagtgaccctaaagttttatgtgagatgtcttgattggggattgggaaattatggttatgataaacaaacaggaaagtgtctgctgggcaaataggttcttacagctgtccaggagcgagaacttggaggcagaaagcagggccaggagacaagtgttgacctgtgtggggcagcccaagggcatgctggaggacgggggaggctgtggcaaggcagggtcccggcggtgggaggtcagcttcttcttggagggacttggaa

SEQ ID NO: 25943 - DNA, 1018 bp, Homo sapiens
gttggtcatgctgtaaaatggccatggccacagatgctgtgtcaggaggttgaagtctatagaacacactagacacgtaagagaaggatgccaggtcagggccagggacacaggctgcacatctcacctctcttgatctcatccctcttaatgggacctctcaggtctaggggtctcaccaacgctgctcatctagcagggccacacataacaaatagaagcagagcaagccctggaactcctgcctgacagtgacacgacgacagaaacatcttaccagtcagaggaccatgagaaatagattcaaggagcattccacgtgcaagtgagtcttggccccatctgcctttggattttagccgtgaactggaaggtattggaaagaagaccctcagaaatagcttaatcaaaatccctgcgtctgaaccaagtgccttatttctctgtgggcctcaagcttcgctgacatctgtggagcacactgtcctaacaggagtgctgtctgatttcccaacgctctgcaaaacaaacagcctggaagggtggctggtggaaggtggtttttagagagagacttgtagataacaggaaagtgaaggctgtaaggaaggttgtaattaaacagcacatggaaacacaatcacattattgtcccattccatagggataatgatgaccacttcagtgggaaaaggagaggttttaagtcattagggactatgggccaccttttaggaagatttattttcaaaggttaaaatagtgttttggcaattcaagtttcattttcagaaaatgtaattgatgggaacctcagtgactctggatgaataagatgctgttgagtggctctgacttgggccagccgtgcttctcacaggaccttggagaccaaggtcactgtgatctcaggttcagggggcaagtcctctccacacagccctagttggcctcacagctgaaaatgtctcccttactgttggactcctttgttcacccacatgagtttgtgaataaa

SEQ ID NO: 25944 - DNA, 1028 bp, Homo sapiens
agccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagactggagtttgcatctattttaaccaaatcttgaaaacagagcaaagggaggggaagggtggagagggagagaccagaggaggagggagaaaaagagatcatgtgactggataagacagctcacaattcactgtgcctttctcccaccatttgtggcccaaggacctgtactccctcctcagcctcctctagggaggggtccttgatgagaattctgaggacacaagaccccttgtggatatttcttagctcagccttggtgtgcttacctgcttctgacaagcaaagtggccaagtaggggagggagttgaatctgatgtcctccactaagtccaggactcctattttgttttgttttgtttttgagacggagtcttgctctgtcaccagggtggagtgcagtggcacaatctcggctcactgcaacttctgctgcctgggttcaagtgattcccctgccttagcctcctgagtagctgggac

SEQ ID NO: 25945 - DNA, 1049 bp, Homo sapiens
gcagtggcgcgatctcggctcactgcaacctctgcctcccggatttaagcaattctcctgcctcagcctcctgagtagctgggattacaggcacacgccaccacgcccagctaatttttgtgcttttagtagagacggcatttcaccatgttggccaggatggtctcgatctcttgaccttgtgatccacctgccttagcctcccaaagtgctgggattacaggcatgagtcaccacgcctggcctatgacttgtttttctaacacaccaggccatagcctttcttaatgttttgcctgcttcatactgtaaatcagaaactcctctcgggaggcttctgactgtagcctgaccatctcacctgatctcttctccaatccctcttcccctctcccctttattttccctttgctatttttacttttcatgcagtgtcagagaagtgtagtgactatgtcgggggaggatcccccagctgcctctggtagttggttttatacttcccacttttggcgtgctgtaccttctagaatttctgtcagtagacaattttgtgtttttctttggagctttcaagatcttgcacatagcttatatagttacatggctgtgaacagagaacgggcagtttcatggtggcattggctgtgagggcacttacattgatgaattcaacccaccacagtggctgtctcccctgtcaaagtgagtgaggggatgagagcattttctgaaccagctcatcttcctgaatagcttcttgcatgcccctgggcttttctgttggcatttaattgctggctgtggaatcttgcctgttttccaatatagacctttggctttagatcctgttcttgttcttacccactctcactaaactgaactccaggaaccacatctcttttgtttgctgctgtatcccaggactgagcaaaggcctgatgcttactaacacctcaagaaatatttattgaatgaagaaatgaatattgacctggaaagttcaaactcttggttttccttgcttcttcctgaagtcaggggccaga

SEQ ID NO: 25946 - DNA, 1017 bp, Homo sapiens
tgggcatggtggcatgcgcctgtagtcccagctactcgggaggctgaggcaggagaatcgcttgaacctgggaggcagaggttgcagtgagctgagattgtgccactgcatttcagcctagccacagagcgagactctgtctaaaaaaaaaaaacaaaacaaaaaaatcgttttactggctgggcgcagtggctcatgcctataatcccagcactttgggaggccgaggcgggtgaatcacttgaggtcaggagttcaagaccagcctggctaaaatgatgaaaccccatctttactaaaactacaataattagctgggcgtggtggtgcatgcctgtaatcccagctacttgggaggctgaagcaagagaattgctggaacctgggaggcggaggttgcagtgagccgagatcacaccactgcactccagcccgggcaacagagcaagatcctgtttcaaaaaaaaaaagatacataatggatggttggttgcaggaaaaagaaaaatgacacagatatacataaacaagctgatgtggaacaatctccaagatctgtcattaagagaaaactaaagaaaagtgcaaaattgtatttatggttagtgtgctagtgttagcatttatatgtaaaaagaggagaaactctgtatacttgttatatacccatactgtttctgaaaattttctttttctttctttctttctttttttttaatagagatgggttttccctgtgttgcccaggctggtctagaacacgtggactcaagcaatccacctaccttggcctcccaaagtgctgggattacaggcatgagccaccatgcctggcctttttgttttttaatatccttctctgttgctgaatttttttttttcacatatgaacattacctttttaaaaagagtagttgtgagctgggcgcggtggctcacgcctataatcctagcactttgggaggctgaggcgggcagatcacctgaggtcaggagtttgagaccagcttgcctaac

SEQ ID NO: 25947 - DNA, 1047 bp, Homo sapiens
tcaccagaaagctgcccatgatctctgcctttggtttactgacgaaggaaaggctttttttttttttttttttttttgagacaagagttttgctcttgttgcccaggctggagtgcaatggcacaatctctgctcactgcaacctccgcctcctgggttcaagtgattctcctgcctcaacctcctgagtagctgggattataggcatgtgccaccacgactggctaattttgttattttttttttttttttagtagagacgcgttttctccatgttggtcaggctggtctcgaactcccgacctgagtcaggtgatccgcccgccttggcctcccaaagtgttgggattacaggcatgagccactgtgcctggctgaaggaaaggctttaacttgccttcatctttcctcatttgtagatcttccttacctcctttctattcacatctctagcttcctgctgctgctctagctactaaacctttacataatgtgccttttggaattggtgctttggaagtgactcctctagatacccctagaaacccccgttctccagccagactcacagaatgcagcttgccgcctcctttttctgtaaacctggtttccataagattgcagcacttcatttggaatctttacaagtgaaactagctctttcttcaacccactccttaccacttcacccctgactttgcctgactgtacttcagccccattcctcagcactccagagctgcctccaaatggccagatactttcagataccttttgctctttgaaatttctgctggccaggaggccagcaaggccacttgatcactgtccttgaagctggcatctatacccatttcccctgtgtgtgttgcgattttggtgtctgatctctcctcctggggctatagcccaggctcagagattggtgaccagggcttgcctggagccaaggatttgggatagagtgtggacttagggggcttggtgttaacatttcagaggtagacagatgagaagccagaatacgtgaacctcaaggccagtgga

SEQ ID NO: 25948 - DNA, 1113 bp, Homo sapiens
aaaaatacaaaaaatcccagctgctcaggcggctgaggtgggagaattgcttgaacctgggagacagaggttgcaatgagccaagatagcgccactgcactccagcctgggcaacagagcgagactctgtctcaaaaaaaaaaaaaaaaaaattagccaagcatggtggtgcatgtctgtaatcccaactactcaggaggctgaggcaggagaatcacttgaacctgggaggcggatgttgcagggagccaagatcgcaccactgcactccagcctgggtaacaagagggaaactctgtctccaacaaacaacagaaaattcactgggcgtggtggcacaagcctgtaatcccagctactcaagaggctgaggcaggagaatcgcttgaacctaggaggcagtggttgtagtgagccaagatggcactactgcactccagcctgggcaaagcgagactgtctcaaaaaacaaaccaacaaacaaaaagaaattaggaagccagacacagtgactcaggcctgtaatcccagcaatttgggaggccaaggtgggaggattgcttgagcccaggagtttgaaaccagcctgggcaacatagcaagacctcatgcctacaaaaaatgaaattagggcctggctgcggtggctcaaacctgtaatcccagcattttgggagagcgaggcaggtagatcacctgacgtcagaagatcgagaccaacctggtgaacatggcaaaactccgtctctactaaaaatacaaaaattatctgggcatggtggcacattcctgtaatcccagctacacaagaatcactttaactcaggaggctgagggtgccaagagcagagatcatcccattgcattctagcctgggcaacagagtgagactctgtctcaaaaaataaataaataaataaataaataaaatatggcagggcactgtggctcactcctgtaatctcagcactttggaaggctgaggcgggtggatcacccacttgaggccaggagtccaagaccagcctgaccaacgtggggaaatcctgtctctactaaaaatacaaaaattagccaggtgtggtggcacgtgcctgtaatcccaactattca

SEQ ID NO: 25949 - DNA, 1030 bp, Homo sapiens
gggagactaaggcaggcagattacttgagcctaggaatttgagagcagcctgggcaaaatggcaaaaccccttctctacaaaaaatgagccaggcatggtggcacacacctgtagtcccagttacttgagaggcagaggtgggggaatcacctgagcccaggaagttgaggatccagtgagctgagattgcaccactgcactccagcctggacgacagagaccctgtctcaaaaaaaaaaattttttttttaaagtatacaattcagtggtttctaggtaattcacagaattgtgcaactattaccaaaataaattttagaatatttttaccaccccaaaaagaagctacatgactcattagcagtcactatcctcctttcatgcccctcctgccagccctgaacaattgtcaatctactttctgtctctgtagatttccctgttctcaacatttcctataaatggaatcataatgtgctgttcttgttattactgctattctgtgtcatcactctattccttctctactggatcattctcatcaacctaggatctctcttttttttttggagagagggtctcactctgtcactcaggctggagtgcagtggtgtgatcatagctcactgcagcctcgaactcctggcctcaatccatcctcctgcctcagcctccagagtagctgggaccacaggtgtacaccaccatgcccacctaatttttttttaaaaaaaggccaggcatggtggctcacacttgtaatcccagcactttgggtggccgaggcaagcagatcatgaggtcagaagttcgagaccagcctgaccaacatggtgaaaccccgtctctactaaaaatagaaaaattagccaggcatggtggcacacgcctgtaatcacggctactcaggaggctgaggcaggagaatcgcttgaacctgggaggcaaaggttgcagtgagctgagattatgccactgcactccagcctgggcaacagagtgagactccgtctcaaaaatatatatata

SEQ ID NO: 25950 - DNA, 1033 bp, Homo sapiens
gttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaagatttcttctgttttgtctgtttaacatttattggcacctgaggcatgcagagtactgataagatgttttcagaatgtagaaagtaaagttgtttaaattatcagccaaaggtagatgttgaaaatctcatttatggatttaattcattatctccctagtttatattcccatggtagtttaaaagtagctaataaaatactgtgaggaggccggacgcagtggctcacacctgtaatcccaacactttgggaggctgaggcgggtggatcacctgaggtcaggactttgagaacagccaggtcaacctggtgaaaccctgtttctactaaaaatacaaaaattatccgggcgtggtggcaggcgcctgtagtcccagctactcgggaagctgaggcaggaggatcacttgaacccaggaggcacaggttgcagtgagccgagatcatgccacagcacagcctgggcgacagagtg

SEQ ID NO: 25951 - DNA, 1508 bp, Homo sapiens
catacattttaggcccttatgaataaataccttacttgagatagcattcatcatagaagaactttaaaattttgaaaagcatgccatattagagtaagaataacaagttgtttacagtactttctgtagagtaattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccacca

SEQ ID NO: 25952 - DNA, 1027 bp, Homo sapiens
ctttcttgaggtcaccatttgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaatatggttaaaccaagtatatatcatgtagctagcttcagtaaattgtgttaactgaggcaaatctagtctacataattcacagtaccactattttattttaatttgtaaagccttaatatagtggtaaactgaataaaagtaaataattattattagaatggtaactaagtcattaaatttttttgcagaactgaaacttgtatgttattagtttattttcttagaccagtgtaataattgactgtaaatagaaatataaatgtcactttacagttagatgtatcacagtcgtttcaggagaatttttcctatattgttaccttgattcattgtttaaaattggtaggatttgtatagatataggatagtgttttatttatactttatcataagccataatcattttaagaatactttattggatagattttagtactttttaaattctaaagttctatttttcttttcacttccccttccttccccttataagatcatttccatgtctttgttggtgatctcagcccagaaattacaactgaagatata

SEQ ID NO: 25953 - DNA, 1038 bp, Homo sapiens
acattctaaaacttattctaaaattttacttaccagagaatctcttcagttttcagagcctatttacctatattttaaaacaggtttaagaaggttggctaagattttctgctactcagcaagctagtagcagcaaggagcaatgtacatttgtagcagtaaaaagtaacttataacagggaggggatagaaaaatcataaaaagccgaagtgagacttcagaacttaggagttcagtcaaacttaatctgtgtagcttgaacaaatggttatatgatgatggggtatgtgtagctatatatccagttaggatacctagtcattaatattaaattatagtactatagtataacctgttgaagaaaatagctatgtataaaagcagtgtgattttaagtgtttgcttttttttttttactttttaattattttagagacaggatcttgctgtgttgcccaggctggattcaaactcctgggctcaagcattcctcccacctcagcctcctaaagtagctgggactacaggagctggctgtttacttttttgtttgtttgtttttgagacggagtcttgctctgtcgcccaggctggagtgcagtggcgcagtctcagcttactgcaacctccacctcccgggttcaagcaattctcctgcctcagcctcccgagtaggtgggattacaggagcctgccaccatgcctggttaatttttgtatttttttttaatagagacagggtttcaccacgttggccaagttggtctcaaactgctgacctcatgatccacctgccttggcctcccaaagtgctgggattacaggtgtgagccacctcacccagcctacttttttaaatctaaaatttacttgtggaatagaccattcattctccatggcctgataacttagatgtataaaacttggtttaagatttttttttttacataattttaaggtaatgggtgaataaagcttaaaattggcttttgtgtttcttctcccacagacagctggaaatgatccctattgttttg

SEQ ID NO: 25954 - DNA, 1096 bp, Homo sapiens
aaccccgtctctactaaaaataccaaaattagccggacatggtggcaagcgcctgtaatcccagctactcaggaggctaaggcagtagaattgtttgaacccaggaggcgaaggttgcagtgagccgagattgcaccattgcactccagcctgggcgacagagggagactgtctcaaaaatatatatttatccaattggctttgatttgttgtcttagatcttaaaatgttgtcagacctttgttctgatgctgcaaaatcatctgcatattatatagatgaaatcaacaaagagttatgttcttttattctatcacatttaatatcggtatgcctttggataaaggagaaaaaatccatgtacccatagagaaagacaggagggaaagatggggaaagatgaagagaaatttaaaaccagtctttccttaatctagatctccttacttatcccaatggtagcatttatggaaaatttgctgcctgtcagttactttaatacattgtcataaatgctcaatagaaacataaagaaggtgttattttcatttcatgtatgaggaaatgaggcaaagcaaggctgtaaaccctaattgatttatccgaatataaatcttctctgttggtttgcctgctgctactctctctctggctggtcatatgtttccctggggaaagatcattagacaaaacgttaatgattgccttggctacagaaaaaaccaggttagcctttgccactttttatcatttgtggattctgatcgctcaaaagcttagatttttattattcaaatctaaattccagtctgttcacattctgagactaatgttcacatttataaattttatgctccctggactgataatatgtatatatgcttcgattcttatttaaaaagttagttttttctgcatataaattaagtaaagcatattctttttcatttatttactcttaaatgcaagtgactttttctttttttttttttagacagagtctcactctgttgcccaggctggagtgcaatggcatgatctcagctcactgcaaactctgcctcccaggttcaagctattctcctgcctcagcctc

SEQ ID NO: 25955 - DNA, 1080 bp, Homo sapiens
gcaatatagccagactatttctcttaaaaaaaaaaaccgggtgcagtggctcacacctgtaatttcagcactttgggaggctgaagcaggcgggtcacctgaggtcaggagttggagaccagcctgaccaacatggagaaaccccgtctctactaaaaatacaaaattagctgggtgtggtcacgcatgcctgtaatcccagctactcggggaggctgaggcaggggaatcacttgaaccctggaggcggaggttgtggtgagccgagatcgtgccattgcactctatcctgggcaacaagagtgaaactctgtctcaaaaaaaaaaaaaggtaaattgtttctctttgtgtttcagatacgtcggtaacctttccagagatgtgacagaagctctaattctgcaactctttagccagattggaccttgtaaaaactgcaaaatgattatggatgtaagggtattttacttagttaactttattctttttttttttacacattacttaaagccattgcttggaaggaattcttagtttaccatggtctaaatatagtataaattattagtttactgtagtctaaatatagtcttagtttaccatattctaagttaatagggattttagtgaatttgtaatgaacctgttttgacagctgaatttaatttgttttattacatgatggaagatgacaatagaactagttatttctagatcagatgggaacatatatatgggctctttcaggtgcattgaggcatcagaaatgtttatatgtggtgtcaactggttggctaataaattcagctcttacaattaaattggaaaacaggtttaaaaataataggcatttggtacagtgaaagtatttttaactttatttttaaaggtcatcattcaagtttttcttgtatttaggcaattcctatttatgagacaatgtattaaacacacacacatacacacacacacacacacacacacacacactcattcatctaattggtgttaaccctgaatcataataggtataaaaagacatttagggaacatttaccccatttccctggagtctttgt

SEQ ID NO: 25956 - DNA, 1037 bp, Homo sapiens
tatacctatttacttgtttatgcttaaatttttttaattggttatataatctttacccttttcctttttcagatttatggacaagaagttatcatgtaagtttgttgttgttttggggttttttttaattatttaattgctttttacatgtgtcttagcaatgtttggagcaactttataaaaatttaaagcagccaggcgcgatggctcacggctgtaatcccagcactttgggaggccgaggcaggcggatcgtgagatcaggagatcaagaccatcctggctaacacggtgaaaccccgtctctactaaaaatacaaaaaaaaattagccgggtgcagtggcgggcgcctgtagtcccagttactcgggaggctgagtcaggagaatggcatgaacccaggaggcggagtttgcagtgagccaagatggcggtactgcactccagcctgggctatagagctagactccgtctcaaaaaaaaaaaatttaaagcacacaggacctctaattcacatccgttagttaagcagattacttaatcctaactagacaattttatttacctaatttctgataattaatttaacagcacttcagactttatcttatgtaagcccttcctcactttggcaaaattaacaggatttatcaaccttttttctttaaacaagctacaaaggacttagacaaggaacagttatcttgtttcttgggaatatgtaggaataacatttgttcaatttatctaaaaatctgacccacacagtacttgaaatatatgtaggggaaaaaaccatgagcgttagaggtaagcagccttcagcttgaatctcacttctgtcgtacagtagctgtataaccatgaacccagttacttaaaagctcgggcacggtggtttacacctataatcccccagcactttgggaggccaaagcgggaggatcccttgagcccaggagttcgagaccagcctgggcaacatagggagcccccatctttataaaaattttaaaaaagctctgaagtttagttc

SEQ ID NO: 25957 - DNA, 1070 bp, Homo sapiens
ctggccttgaacattcccgcgatcccgacagattcccaggtggaataaagacctgggggccccagtggctgctagaaagggctgaccaggggtcttccccttttgactaacatgtcttggaaatatggggtctgtgttatataaggaattccactctccctctgcctactgggaagatattctccatatttcttggagttcctcactggtgtagaaaatgaaatgggtttgaggacatgtaatttccatgtttttattggtgaaactaaactggttacagcaatgcttagatgtctccaccaagctgtacacctcacgccttctcctttctctgtgtctgtttcttctttcttgcctagaaaaactctgagctggaccccagccgggcctcctgccacttcagacattaatatccatctaaattcatagacaagagcccagagctgccagcctgcaagggggtgttcccaggacaggccacatggaaggtgcagatcagaacccagtccttccatctgtctctggtagccatccctcaacatcaggctggccctcccctcgctctggattgattttatagaattccctagaaatggttctgttagccccaggtggaagctgtcacctgaatgaaatcttacaggtcatatcttttgatctttttctagaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagg

SEQ ID NO: 25958 - DNA, 1063 bp, Homo sapiens
cactgaggctattcttgtcaagatcattgaagatgacctccatattgccaaatctaatggcctcttctctgttcttatcttacttgacctgtcagcagcactcaacactgttgaccacttcttgaaacatttggattatctggcctggaatactgcccttttctggttttcccttacctcacttgctgttcctccttttcttctgtgcagttccttttcctccaccagacctctaagtgtgagagagctttgccctgcaccactttgtcttccttatacactctttctggtgaactcttttgggccttggctttagacttcatttttgtgctgatgaatccaaagttcctatctccccagaactctacttcattgcttctggaactttactgtacacactgatcacctggggatcctgttaaaatgtagattccagtctcatttgtctggagtggggcctgagagtttgcatttccaataagctcccagcgatgctgatgttgctggtctccggatcttactttgggtagtgaggctgaaaacctgtatatccaactgcttccctgacatttctacatgcatgtcttacaggcgtctcagaccaaccctaaatgaccctcttagagctcttgatttctttactcaaacccatttctctctgcattttccttgtgtcatcatcccagttgcacaagccaaagattttggagttgtccttggtttctctttccttcactttttcatccagtctatcagcaaattctgctggctcagtcctccaaaacatatcccaaatctttctacttggctccattataatagtagtagctgatatttattcagtacttcctgcatgtcaggctgtgttaatgacatatatttatatttataagtatttaaagtctaatcatcacaataaccctgtgaggtaggtggtattattattctcatttcttggataagaaaagtggacacataaaaggcaataaataattatttgcagatggaatacatgaataaactttataacttataactaggtaaccctacatagacctgcagt

SEQ ID NO: 25959 - DNA, 1042 bp, Homo sapiens
tttctttttcttttttcttttttctttttttttttttttgagacggagtctcactcttattgcccaagctggagtgcaatggtgcaatcttggcacaccgcaacctctgcctcccaggttcaagcgattctcctgcctcagcctcccatgtagctgggattacagggatgtgccaccacagccggctaatttttttttttttttttttgtatttttagtagagatgcggtttctccatatcggtcaggctggtctcgaactctcgacctcaagtgatccgcccgcctcggcctcccaaagtgctgggattaacagatgtgagccaccgctcctggcccaagctatttcttaaggaagataattatctccctaagaaaaattttattgtcaactgttaagacattaatgcagctttttaaaaattaattaattaattaattaatatgagatggagttttactctgtcgcccaggctggagtgcagtggcgcgatctcagctcactgcaacctctgccccccgcgttcaagtgattctcctttctcaacctccctagtagctgggattacaggcgtgcgatatcacacccaactaattttttttgtattagtagagacgggggtttcgccatgttgaccaggctggtctcgaactccggacctcaagtgacccccgcctcggcctcccaaagtacttggattacaggcgtgagccaccgcgccgggcttaaatttaatttttatttttttttttaagagacagagtctcgctatgttgcccaggctgaagtgcagtggctattcccaggaacggttctgctattgatcagcactggagttatgacctgtttggtttcagacctggacttgttcacccctccttagggaacctaatggcccccgtctccgggaggtcaccatattgatgcccaacttagtgtggacaccatatcagcatagcgcacgacagaccagaactcctgagctcaagcgatcctcccgtctcagcctccagagtagctgggacaacagtctcagcatccg

SEQ ID NO: 25960 - DNA, 1019 bp, Homo sapiens
atcacgtttctccctttccagggtactgtcttctgagagcgcacttgtctgccaaccccagtagccaggactcagcatacctggcaaacaccttcaaaactagcaaatcatgctggctatctgccccaggtagggccttagcaactggcttcaagttgagataaagtgacagtgcttttcagggatacagtttgaagatttcctgggctattgttgcttctggggtgttaggattctaataattacaacaggaccctgtgtatgtggtggggttggagagagcatctcagtacctctccaagttcatcctcactatcttgaactggggtatcttacatctctataccagtgttttgcaaccctggctgtacaaacaccaatgcaggggtcttacccctacagattctgattaattcatctggtttggggcctgggcattggtatttgtaaagttctccaggtgattctcgtgtgtagccagggttgagaaccactttaaggcctttctgcctcagtcagggaggcaagaggctgcaggtgattttgagggagaagggtcaatagagtaagggaggaagaaacaggaaactagcagagtccccggggggagagaatgtgttatcctaaagacccttggtcacagccatgcagctgggcaaacagataacgcctggtggaacaacagaagctggaccatgagaagggcagacagcagaaaatgcccagagaagggttcaatttcttctttggaaggtgatggtaagggtgtggctccagattaactggttctacagctccaggcaagggagatggaaggctgaggggagcaggtccatcagggagcagttgggggagaacctagagaggcactgtctgtacactccagggccagtgcccaaggccagatgctcctcatctattctctaaaccaccccaggatcctcttgaagcttaagctagtttagattgagcttctgtcactttcaactgaagcttgactagtaaaaactcctgaggtt

SEQ ID NO: 25961 - DNA, 1047 bp, Homo sapiens
cttataatagtttgatacatttatcacaattagtgaaccaataccaattcattgttattagctaaagtctgtactttattctgattcctttagttcttacccagtgtcccttttctattccaggatcccatctaggatttcacatcacattttttttttttaattttattttaagttccaggatacaagtgtaggacatgcaggtttgctacataggtaaacgtatgccatggtggtttgctgcacctgacaatgcattacctagatattaagccttgtatgcattagctatttatcctgatgctctcccttcccccactcctccacccctagcacatcacatttagtcatcgtatctgctgaggctcctcttgcatgtggcagtttctcaaactttccttgtttttttgttttgttttgttttctaacctttttctaggatctcctttccttgtttctgatgaccttaacacttttgaagattactgttcagttattttgtaaactgtccctcagttgagatttgtgtgatatttttcttattagactcatgttattgattttgggaagaccatagaggtaaagtgtcattttcatcacatcatatcaaggattcatactatcaacatgacttactactgttgatattaaccttgatctcccaggtgaggaggtgttgtcaggtttctccactggaaagctgttctttttttctcctccatactatcctcttttggaaggaagtcattatgcaaggcccacacttaaggaatagagagttatatcagtatggacttgtggatatttattttatgacttgcattacaatctaatactactttttttcccctcagattgttccagctttggccattaggagctctttcagttgattcttatgtccctttgacataccccgatcatttttggttttgtgttttgtgtttgttttttaagcacttcctttctttttctggcactgtaagatactccaaattcatcttctatatgagatgctccaaattcatcttctttactctttgccct

SEQ ID NO: 25962 - DNA, 1048 bp, Homo sapiens
ccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaag

SEQ ID NO: 25963 - DNA, 1032 bp, Homo sapiens
ctcctgcctcagactccaagtagctgggattataggctcacaccaccacacccaacgaatttttgtatttttagtagaaacagggtttcaccatgttggccaggctggtctcgatattctgacctcagggaatccacccatcttggcctccccgagtgctgggattacaggcgtgagcctctgcatccagcctcaaactctgctttaatctgtggtgaacaagctggagattaaggtcctgccctgtggattttatatttgcctaagaaagacagataagagctaagtcaggagctctggggaaaggcccaggttggaattatagattcacttgaccaaggtaaacctggtgtgcctgctcctacttcacatccccagacatacttccagaacatttccttttgtatttttgtgtacaaacttccttttgagcctctctccattgtcacatgtcaacctctacttgtcttttgttgattttgaggccacttgcccatgtaagtggcaggatattatagaagaatcatgctgacctgggtctttgaattctggttctgctacctaccaactgagttcctttggtcaagctcttggacttctgagcctgtttcctaattccaaaagtggtatatgatgtgttagtccctggtgggttgcaagaaagaggcacacacatatcagctttggtgatgagggctgaatgtaaacttggatggaaagtcatctaagcagccatattgtctcttggccctagtactttcaaaacttcacagaacattaatttagcagtatttagtatttgagctctgaagacctgccctcttttgctttgttcactcaacatttgtattttccaagagagaatatctgattggattagtctgtcaccttctaaaaacagaaggcccctactagagagaattttgagctgtgccatcatgtccttggtgattgatctccctgaagttcagcctatatgccgtcctcagctgaagcactgagccctggtccagtcacttgtggccacagaag

SEQ ID NO: 25964 - DNA, 1032 bp, Homo sapiens
aatacatcaagagctttttgttagtctctgtggagtttagtcacagtatgttgaggttctactgtgtgtcccttgctcaaagagttgacattctattctgggagatataagcataaaacacttgggtttctctgtatatcaacatctggtttactgacataatcaacagttcaactgtgaggcacaaacactggaagaatagaaaaatatgtgatatagtgcttcctgtgcaccatgaacaataggtacaaatggagttcagagaagggataaatctaaggaactgatagtagtgttcaaggaggtttcctaaaggagatgggtacttaagaagggtcttgaaggatggtgggaaaaggaggaggacactttattcagtctgcctagcatgaactttggtagatttccttgattctatgtttctaagattttactctcatatttaaagatgcattgaatcagatagacctggtttccgattctgacttccttgcttaatagcagtgtgattctgagcagttgcttaaattgtcctgtgcctcaattaccttatcggtaaaataggcctgagaaatagtatcttcctcttagaatcacactaattgagactgtaccaataatgcatttaatatatacctggcccatctggcttgcaatgaatgtacattttattatcctttttcccctgtgtttctacccaatagtctcgtctctcacagaactcacactgagaggcaggaatccattctgtttcttctccaagtccaggccagagttttgaacacaggttgcccctggggaccagagattgacttcagaactcccacgcaaaacttcaatatccccaatattgccctgacactggccatttcacttcctggctcatctctgtgtgtcagaggcaatgcctgagaatttccacaggcctgttttttgactcctggctgattcttaaaagcagcaagagatcttgctgagagtcagagctaagctaagccatcaaccgccttcctcatgtggatggaccctgga

SEQ ID NO: 25965 - DNA, 1058 bp, Homo sapiens
ccttgctccctcttgccactgtctgagccaagctttagaaagtgagaccagtaacggttatcagtgttcacacatggctaggcacttgatgattgcaatcgatgttcccttcagccttctcttctctggtcttaggaatcccagaccaatcctttatttcagtattatcactatggaatgccagtgcctcttgtcgcccatagaaagcaaggccccctgatacaaacaaccacaggtacaattaagttactaagacattggttgttattttcattctctccattttttttcctttgttcctttttttttttttaagaaatagcatattggccaggggtggtggctcatgcctgtaatcccagcactttgggaggccaaggtgggcagatcacgagtttcatcatggccaatgtgatgaaaccctgtctctactaaaaatacaaaaattagttgggcatggtggcacgtgcctgtaatcccagctactcaggaggctgaggcaggagaattgcttgaaccagggagtcggaggttgcagtgagcctagatcgccactgcactccagcctggtgacagaacgagactccatctcaaaaaacaaacaaaaaaagaaatggcatattaagagtagagctgacggatcaaggcaatataaaaactggagcaagcaatgagggataaatgcaaagaagaggttctgggaacaaatgaaaacttatcaatgtaaggaacagtgtcagaagacagtgaagaaataaatcattactaatcaggttaagttggttaattaaagtgattagtaattgttataaatacatacatatacatatgcacacatgcacacacacacatattatgttctgggacccttattgagtggcctctttattctaggttgagtccctagaaattaagacaggatcaaagaattcatgaatatgcataaatgctaaactgtaaatgactttatgcttaggattaaagttttgtagctactagaataggaagcaacctgaaacattcaccttgctgatgacttgaacgctaagttgccactt

SEQ ID NO: 25966 - DNA, 1208 bp, Homo sapiens
atttacactattcatgagattggaatgatctaattgttcacgtctctgcttagtttaagtatttatgtgtataagtgacgctgaagttttcctatttcaaaagaagtttcagttaggacacacatataaacctgctttgtcttcccaaactcctcccttaatagcagcctgtgttaaatactcttgtctttcctgtagaatacttaaatgaaaaagaaactttacaaggtactcactggtaacccaggctccttatctcaagtaaatgtcatttcacttggttggtgattaaggttcgacattgcaaaatactttgtatttgtccagtgtattttatctcaatcaaatgcacaagcttagaaatggactagaatctttacaccaattataggcatgatcatgtcagcttagtattttaaaaaattgactttacagtcccatttcaggatcctgtttagattttgttggacttctgtgttatatttctgtgtaacttggagtatttgtctaaatgtgtaggacctcaggtaattttatttctctgatttcaatgtctggtacatgttctccaacttacagacacattcagatagttagaagcatcatagtttatttgttctatttctatactctgggattaatttgtttctcagtacctgccttcctgtgaagccttccctcatcatttcattccaaacgctgaactcttattatattgtctatagcatgtgtaatggtggcagatatattataaaacttacatagatatccacattaacatcagcatgtatcataaactttatcatagttattttacatatttttctcagtgttcccactgctttcgcatagtagacccgtccccacccccattactgctaaagtggcctttctgaaagacaaattaaattgatcattcctctgcttaaaactcttcaaggtctatcacctccaaggaaggtcctaagcccttgcatataagtaccttctcaggccagcccctgcctgcctttccagtttaattttctaccattctcttggtatatccacatcaaatgtgttgctgttccccaagcatgacatagcaaagtttcttccctttaggcacttatttctctggcaaacatttactcaacttttaagattcaggtcagatgcttcctcccctgtgaacctttccctgactctcccagggagggactggccca

SEQ ID NO: 25967 - DNA, 1032 bp, Homo sapiens
caaggtactatttcagcgaggtcatactatatcacattagaaacttactgttttatattagaaactgccagaatgaagaaatattatcctatattcagcacttcaggattatatgctaatttattcaggaacaaatttattttaatatattattatttaatattattcaaaattgagacatacatgttcaggattctgttataacacttgctgggtatccttggacaaatccatagccactctagtccttgaattcttcatctttaaggggatgtccttgtatttatttcacagagaaattatgaagtagtacttactggaaacgctccttacaaaatgtttaacttcctcttttgtatgatctctttttctacattcggaaaaaaatacgtattttaagtctgtttttctcttcttaattttatgtacaataatctaatctgttataaaataaatatattagaaaggagtttaaaatgtgatatagtctaatggtcagcctttaggtagacagatgcttcaagaactcagcagagtcaccttttctctgcttgcaaaccttcaatcatacagcatgcagttcctgatattcagaaagtagttctttaagccttgttccacttcttactgtcttagtaaacactaactgtggtgttccttgaccatagacaacagctcagcatctattcatataaacactcattaaacttaagggacaattttaacttacctgttcagtacttgcaacagaaaaagaaagtgtggcatgcaaagcctaaaacagtcactctctggccctttacaggaaaagtttaccactccctgctctacagcattacatgcaagaaagtgaaaactcttataaaacttttaaaggagaaaagtctccataatcaacttgttcatgtttttaggcattagaaatatatgtatatagtttaaaagaaaaggatgtagttgtatagaagtactggtagatatcattaaaattttttaaaacatcttgaggtctgagtattttttttttttttt

SEQ ID NO: 25968 - DNA, 1719 bp, Homo sapiens
ccaagattggagaatggagaaaagcaaggcaggataaacgcccacctgggagtgacacagagacagagaaacctcccccacccagggaagcagctctgcagagttggcaggatcaggggctagtctgaacccctagcacagaacactcacctcacggaagagtggccagaatgttttccacataggtcctggtcctcacttctcctcactgagcagggctgcccaacgtgggacttctgcacaaccatcctgcccctgcctgaccacttcaatcagaggcagcctggcagttaaaggaacacccacacacagaggtgaaaaagaaccaattcaagaactccagcaacacaaatgaccagaatgtcttatgtccttcaaatgattacactacttctccaacaaggttcttaatcaagttgagttggctaaaatgacagaaatagaattcagaatatggataggaacacagatgaccaagattcaggagaatggcaaaacccaatccaaggaaactaagaataataataaaatgatacagaagcagaaagacaaaatagcctatataaaaaataatataactgatctgatagagatgaaaaaccaagctgaggaaagaatcttggaactggaagactggctctgtgaaataagacaggaaaaaaataaagagaaaataataaaaagaaatgaacaaaacctccatgaaatatgggattatgtaaagaggccaaatctacaaattattggcatccctgaattggatgggaagaaacgaaacaacttggaaaatacattttaggatatcatccttgaaaactccccaaacctcactatggaggccaacagtcaagtttaggaaacacagagagcccctgaaagacagagagaaagggcaggtcatctacaaagggaaccccatcaggctaacagcaaatctctcagcagaaaccctataagccagaagagattggaggcctatattcaacattcttaaagaaaaaaacttcaaccaagaatttcatatccagccaaaccaagcttccttagtaaaggagaaataagattcttttcagataagcaaatgctgagggggtctggtatcaccagacccactttataagagatcttgaaagaagcactaaatatggaaaggaaagactgttaccaaccaatacaaaaacagacttaagtacacagactaatgacactataaagcaatcacacaaataagctggcataacaaccggctaacaacacaatgacaagatcaaatccacacatataaaaaatgtaaatgggctaaatgccccattttaaaggcacggagtggcaagctgaaaaaaaaagaaagaagactcagtggtatgctgtctacctaagacccatctcacacacagtgacacccataggctcaaaataaaaggatggaggcaaatctaccaagcaaatggaaatcagaaaaaacaggcaccgcaatcctaattttagacaaaacagactttaaaccaacaaagatcaagaaagacaaagaaggacattacacaatggtaaagggttcaattcaacaagaagacctaattatcttaagtatatatgcacccaacacaggagcacctagattcataaagcaatttcttagagatctacaaagagacctagactcctgtgcaataacaacactccactgacagtaagtaacagatcattgcagcagaaaat

SEQ ID NO: 25969 - DNA, 1034 bp, Homo sapiens
ttctttgaggtctctgcggaagagatttctttacctattcaattatataatgctttcaaatgagtcaaatgctttaactcagaaattctaatgaattttcaacaatgaactctgaaagtcagtataactatgtctttgcgatggacggttatttcttctattttatattacaaacaaagagtatttgtctgatacagattttattaagtttactctttgtgttattcctctggagtactagaggaatccattaacctttattgaatgcaaggtatactaaactttgagtggaagagatgtataagaactggcctttaaccttggtttatagtctcatagggaaacattatatacagtatcatgttctaaaactcctgaggcaaagaatgcctgcttgctaatagcctgaaaaaaagggaacctttgctgtagaaaatggagttttatatagtttatcagagacagtagacattgaataagtaattttgaataaactgaactgggtagtgagagagctttagcctggtgacagatgttaatggcattcaagagtagatcagtaaaatgcagctggagtgaggggagtggaaatcttacggtgagtgcatttgaagacaccaaagagggaaagggcatgcgtggccagatgatctagaaccatatggatcaagttagaattttggactatacccatgcctgtaatcccagcactttgggaggccaaggcaggtggatcacaaggtcaggagatcgagaccatcctggccaacatggtgaaaacctgtctccattaaaatacaaaagaaaaaaaaaatagccggacgtggtagtgcacgcctgtagtcccggcaactcgggaggccgaggcaggggaatcgcttgaacctgggaggccgagattgcgccactgcactccagcctggcgacagagcaagactccgtctcaaaaaaaaaaaaactggactataccattgcagtcatggaaagccactgaagattttaagaaatgaatgtgatgagacttgagtatttaa

SEQ ID NO: 25970 - DNA, 1050 bp, Homo sapiens
aataaaaattaaagccaacattgacatatcttaggtatcaaaggaagcatcatacttaaatatgacatcaaaaaagcaagtaataaaagaaaaataaattggacttcatcaaattaaaaactttttgtttcttttgtttgctttttttttattaaaaacttttttatttcaaaggccatgatcaagaaagtgaaagacaatccatataatgggaaataatctttgtacatcataaaactggtaagagacttctgtccagaatatataaagaactcttacaatttaataataagaagacaacccaatttaaataaaggcaagggatttgaatagacatttcttcaaggaaagcatgcaaatgtacaataagcacatgataagatgcttaccatcattagtcattagggaaatgcatatcaaagccacaatgagataccactttatacccaccaggttggctataattttttgaaaaatggaaaataacaagttgacaaaggtgtagagaaattggatgcctcattcgttgttggtgggaatgtaatatggtgctgccactgtggaaaacagtttagtgtttcctcaaaaagttaaacagaattaccatatgacccaggaatgtccttcctggacatatactgaaaattattgaaaacaagtgttcaaacaaaaacttgcacatgaacgtttatagcagcgctgttcaccatagccaaaaggtagaaaccagccagatgtctatcaactgatgaatggataaacataatgtggaacatctctacaatggaatattattcagccatcaaaagaaatgaaatactgatacatggatgaaccttgaaaaaattatgctaagtgaaagaagtcaaacacaaaaagtcatatatgattccatttatatgaaatattcagaataggcaaatccatagagacagaaagtagattagtggatgtcagggacaggggaatgaggactgactgcttaatatgggtatggatttccttttaggctgatgaaaaagttgtgaaactagatgggtaatggtggtt

SEQ ID NO: 25971 - DNA, 1078 bp, Homo sapiens
ggcatccttcctttttcccctctggtaacttcattataatgtgaagattattagaaatataaaattatagcatatttttgaaaaattaatagtttttaaaaataattaccatatctcatatatatttgtgtgtatgagaatatgaagagttagatatttggcaagtaaagtatattagtgattttctttctcctctgatacatttactgacaatataccttctttcctgctattttgtatacctccttttaatttttttaagtgaagatgtttccttcataaatttcaaatgaattggcagtttcctcattgaaagattttgcacatttgcaaatggtatcttggagtcaggtcctgataccagctttgattctgtgagtttctaccatgcgtgcttggacaggggcagggcagaactgctgggaagagccaagctttctggagaatgggttggtacctgtcagaggctctcctatcctgaacaagtttcccaagaagaagccaccttgctagtctcactgaactttgattcagtctcccagtaacaggaattggtcaaaggtggggtttggttctgcattgagtggagcaagtaccttgctttccttgccaatgcttcagaatctctggtgctggcttggatcacttagatactgaaaacctactaaaaattctggattgcaaagataagtccacaaagcgaatttccattgtgacctatgtatccattggttctgcttggccaaaattgcatgtatttcccctttttattatgtcaaagaaggacaattttaattaacagctctaaagagaggcttcttgtgtgtacatataatcaatttgtggatgcatcagcatattacaagagtctgggagcctcttgcccctctctcatgtggtagttttcctcttttctttctatcaagcagcatctgagaatttgggtttacagaccaatcctagttgccaataatgctaaatcttgaacaaattatatctcttgttactagggaaagtactgcaatatgagcttcactacataatgtgtatgtgtatgtgtatgtatgtgtatgtgtat

SEQ ID NO: 25972 - DNA, 1025 bp, Homo sapiens
acacaggtctacaagaagttcccataacattttaatccatctactgcctttatgtagataacgccttacacatctcaaaaaaaaaaaaatgattacagtcctaacttttatctttttttttttaagtaagacatttttaaaaatatgcctttccatcattactcactccagcatgccaacatttaacagattctgatttggattctgctgttttaattaaatcatatatttaatctacttctagtattacagtattaaaatttgtcctctttctttctctttaatctatttgcatttatgtgcatgaaagaaagaaaaggagagagagaaaaaaacccaaatatcaccttagcattctcaatagcatatttctaagattgaaatttagaaaaattgaaggaaatatcattgccaacacttccatttagaaaacctgacgttccaaaagctagtaagtcaatgtataggctttttaaagccttgcctttaatgttctgtgctggtagttgactctattttccttctactctattttctactccttttctggaaggagcaggtggtatggtagggtcactagtgggataatgtacatttggatgggtgaattgaggcccatgtttttgtttttgtttaaccactaatagctatgaatttgtgcaactcagctaatcccttttagaattttttcagtaatttgttatatgtaaatgggttgcactaaaatccccaattggactagatgactaggtgttacccatcaagtgtggtgaagtaggtgaggaagtgtgttctgaaaggcaatagtatgtacaaattgtgagagaaaataaagagcatactgaagaggtctcttaaattagaggactaaaactagttcattttgactaaagaatagggtgaaatgaagtggggtggtcataaggaattcatggaaagataagttattgttagatcttgcaagatgtattaagaagcatatactttattctaagaacactgagagctgtttatgttatgagagt

SEQ ID NO: 25973 - DNA, 1031 bp, Homo sapiens
tgagatgaagtgaagagaattccagaagtcaacaattcacacattttaaattgtgcaccattctgagtggtgtgatgaaatcttgactgtcccacttagggaaatgaatcatccttttgtccagtgtattcatggtctatatgctacctacctgttaatcgttggtcacttagtggccgtctcacttctcagttctgctctcttagtatggcagtacttgtgttcaagtgactcttattttacaccaataatggccccacaatgcaagggcagcgatataatattttcagtcagtggttgaccatagatgactgaaaccatggaaagtgaaatggcagataaggggaagactactatatttagagtatatgcaagcagaaagcaagcgttgggtgtttgctatcaggggctcttgtaaagtcaatggctatgtaataaggtcaataattttttactaaaagaaactttatatgtgattctttaagttgggactctctcatatagtctgccttatactgtttactttggggtaatgttagttagttagtttgtttttttgtttgagatacaggatcttgctatgttgcccagactggagtatggtggctattcacaagggcaatcatagcacactacagccttgaattcctgggtttaagcaatcctcctgccttagcctcctgagtagctaggactacaggcatctaccaccatgcctggctggataatgttggtttcacaggaaaatcaaactgtctagttaagatctgaagcactgtggtattctggtagagacattagtgtggttatgagatcagagttgccatagtacaacatgttagctaggcagtcctgaacgtcagaagaaactaaagaatatgaataaatttattttggaaacctgggtatctgaacctgaacatactagtagaaatgtattttaaaaataaaagttggctttacgtgaaattaaataaatcttggaaatgtttaatcattgtagcaaacagcaccatttcatactaaggaat

SEQ ID NO: 25974 - DNA, 1057 bp, Homo sapiens
tggatttcatcttagatctcagtatgtttatatgttttatatttggttttaaacattagagcactggatcctggcagagaaactgagatttaaacaccagcaggtgttgattgcctaataacttctagatctaacttaggctattgtatccctcatgcactaggaatattcagtctgtgtctgggtttggaatttcctaagctttctctttgcatattcaaaatgaggaagtctagattcatattccagctcaaccacttgttaccagcattaattcagtaatctgctcattcagtcagcagatatatgtgggccctactctatgcaaaataccatggttggaggctggagttaagatgagaaatcatggattttaaataggagggtgactgtattagatttgtatttttggaaggaacttgcattttgcaggagcctcagagactagttagaaggctattgcagtaatctatggtagagttgatttggtagcctcagcatatatttgtatgataattcaagccacgagggtgaatgaatcaattcatttaacctctctgagcccatcaataaactagaaatactaattcctgctatatttgtctcacattattgttataaagtcaaatgagataatatatataaaatcatttgaaacagccatggaaatgttatttattataattaattataattatttctttatgtatatgcctttatgtgttttctttcatatttctactgatttatggtctacaatgttaaacattttcagttttcagttatctgcatagttccctaaattattcaaaagattggtacattaaaaatataattaaaccaaatccaggacacatttctttgcaaggaaatgtagcaacaattgcatctttttaaatgtaatgtaatccatcatttcccaggatccatgaatctttttcacagtatgaactggatccatgaaaaggagggatagaatgcatcttatcagattctctcagatcttgatggtcaattaaatatgctttggtttaattcttttgaaagggaacacggg

SEQ ID NO: 25975 - DNA, 1055 bp, Homo sapiens
tctgagtattgtgccctcataatattatgctcaatttagcacttaattgtctgttctccttgatttgcttcagaacaggaaatacattttccacttttttgcacatacagaattattagaataaaaaaacaaaatcatatgactataaaagatatactttgtaaaatatgatgcattcataaaatacttacattttaagcaaatatacctaatgtcattttcaattatttactatataggatcataggaataaaagttgtaataaatcagaagatattgactaagtacttaacatataatccaggtactgtattaaaaatgctacataagatttatttttatttagctattataataattctgtttggcagataaggaaattgagacaaaggttaaagtcagtgttctagagcatcacatttaaagtgtatattggtttttattaaaccacacatctgtaatttttctatttatctttatatatattttttctttgcttttgctctgacactattattagtccttgccagtagaacacattaggtgtttgttggtggtgttattgttgttttgaattgggcatgcactgattaatggctacaccctttatcctttactgtaaatttgggttcaaaagacacacatatataagcattttgtaaataaagcaaaaatgtttgcctagatgacaatggaaatcaagactaaagcttagaagattcttgaccagaaagaaattctttaaatatctattatagttttcttctggtttcatataaatttagtaaattaaaaagattcattttggtttctaattgtgataccatggtatcagttttatcctctaatcataaacaaccataaaaacctggagaaaatataaaattacactattgctaagtgaaagaagggatcaatgttttggatgtctgtaagtataggatttagataagcaggataccaaagaggagagaaaagatggagaagaaactcccctaaaaaaatctttggccagacatggtgactcacgcctgtaatcccagcactttgagagg

SEQ ID NO: 25976 - DNA, 1042 bp, Homo sapiens
ctccaaacaaataacacacaatgttggaaatcacagtacgtacttgcccccgggacctccctgtctttgaattagccgttgcaggcttcttggtctttagctccttggtgatagatgaagtccactctcttcctaaggaaaaactaccttcttaaaaagtgattagggatacacacacacacacacacacacacacacacacacaggcacaaagacaaaaagtgaattttctaccctgcaatacatccctgaatgcattatgttacatattttttaaagtgtttctgttaaggacatccacttgttatttttatgtcatgtaggattatcttattgcctttatagatttctgcaattgaatgatttaccgtctttaactgttctaagatggtaacaaaacaaggaagttttatttcatgtttttgtctatgtgttttgttttattggcctactattttttgtttttacttaagttgcctttaatcttcatcttgataactactttgaaaaataatcttaggattaggaggtgacagagatctgaaaatgggaagcagtctttcaacagacaaacaggccctaactctatactctcaagaagtttgacatgaaccttttgtaaggctaattttcttttgtgcctatttttcctagttgtgagcacgcattccatctggaagtatgtaaaatctaaggattcttcattgaaacaatattctttgtgccatattgacaatatctatatttttgctattgtaaaacagatacagtgagattattaaaagaatcacattgatatgctacgttgcaggtggtaaaggaaataggaggtatcggttccctagggtacaagtaattgtgatctttccttagggtttcccttcccttcagcagttgtccatggggatccttccagtgttttttgtttatctttttaccttcctggtggaacctggctcccttgagtagcgcagggaatgagtctaatgagcataaggtttatggcttcaatagtaatgcttaaaaattctagtcctagtct

SEQ ID NO: 25977 - DNA, 1013 bp, Homo sapiens
agaatacacattcttctcatcagcacaaggaacattctccaagatagaccatatattaagccacaaaacaaatctcaacaaatttttgaaattcaaaatcacatcaagtatattcccagatcacaatggtgtaaaactagaaatcaataccaagagaaacattggaaatgatacaaatacatggaaattaaacaacatgctcctgaacaaccattggttcaatgaagaaattaatatggaaataaatgttttttggaacaaatgaaatggaaacacaacatatcacaacctgtgggacacaacaaaagcagtactaaaagggaagttcatagcaataagcacctacatcaaaaagcagaaatatttcaaataaacaatctaacaatatacctcaaggaacaggaaagcagcaacaaaccaaatccacaatatcagaaggaaataatgcagatcatagtagaactgaaaagaaaaatatgaaaagatgaatgaaacaaaaagtcggttccttgaaaaggtaaaattgataacaaccactagctagactaaccaagaagagtacagtgaagactcaaataaaattataaatgaaaacagagacattataactgataccacagaaacagaaaagatcatcagggactgttatgaacaaatatatggtaaccagtggaaaatctgtaggaaatggatgaatacttggaaatgtacaacctactaagattgaatcaggaagaaatggaaaacctgaacagaccaataacgggcagtgattgaagcagtaataaatagtatctgaacaaagaaaagcccagaaccaggtggattcaccaccaaattccaccaaacatataagaataactcataccaatcctgaaactgttccaaaaaattagggagagaattctccgtaacttattctgtaagcctagcattaccctgataccaaaaccagaaaaaggaacaacaacaaaagaaaactacagaccaatattcttgatgaaaatagatgc

SEQ ID NO: 25978 - DNA, 1007 bp, Homo sapiens
tgccattggatttagcaatttggaataagttggtgaccttggtaagagcgcttttaataaaatggtggaaggaaactcctgattgagtaggttttaaagagaatggctcctgcagagaggaatttcaaataactaatatagatactattgccactacaaggtgattgtgaagtgtgcttagtgacttgtttccaaaaagtatagggtagaatgaggaaaaaagtaaccttacagtgaagaaaactggcagacgctgccttgctcaagtgttccaggttaacatcatcagtgatgttatgttgatagtatgtacctttcatatgatttgatgagagggcactttgcctctgtgttctccctccctaaacccatgagcccagtctaagcatgggaaaacattaaacaaacaaaaattgaaagacatgctataacatagttgaccagtactccttaaaactgtcagtgtaggattcggcacagtggctcacgcctgtgatcccaacactttgggaggctgaggcgggtgaatcacgagctcaggagttcgagaccatcctggccaacatggcgaaaccccgtctctactaaaaatataaaaattagctgggcatggtggcacgtgcctgtgatcctagctactcgggaggctgagccgggagaatcgcttgaaatagggagttggaggttgcagtgagccgagattgtgccactgcactgcagcctggtggcagagcgagactccatctcaaaaacaaaaacaaaaacaaaacaaaacaaaacaaaaaactgtcagtgtaatcaaaaagaaggaaaatctgataaactgtcacagaccagagactaagaagacgtgacaactaaatgtaatgtggtatcttagatggaatccagaaatagataaagaacgttaaggaaaaactagtgacatctgaataaagtatggcgttcaattagtagtaatgcgtttatgttggttccatagttgtggcaaatgtaccatagtaatg

SEQ ID NO: 25979 - DNA, 1043 bp, Homo sapiens
gttatttgtattttctattgttatcatcaatgttaaaatagcagattttgagaaatgtgatactacctcaaattccagacctgggaccttctcttttcccttgaaataaaagagtaattggtccaattgtgtcaacccattttcttttctttatttacagggtgcccgggaaacatttgagaattactaccgaaaacagaggcgaaaacaggctcgtttggtacttcaacctccatctaacatggtaggattaccatcttcacttttctcacatttttacttttcctccttgatgtcttttgatgcgtgtgtgtgtgtgtgtgtgtgtgtgtctgtgtgtgtgtgtttactgtcattctgagaccacttttggtggatgtgacttgcagtaagaaaacatttattgattgctgtgtgtctggcactgttctaagtactagatatgtgctgtcatatttcctcttcattggtagataatattattatttttaccttatcagatatcatctagggagctgagccttaagagattaagtgactgattttaacttagtcttaatgtaacaaaacagaaacaataactttttcttctttgctttgttgcagcatgaaactttagatggctacaggaagtattttaatcaaattgtagggtaggtatatatatatatatatatatatttatttatttatttatttatttatttattgaaatttatactctttccatacatagagttgtgaatgttggaaaaataaatcaggttttccttaggaaattcttttcattttcttttttttaatccttaagacaagatttgtttttgattttctaatgatttaaaaggaacaccctgctggtttcaactttatattgctggagggcatttttgtggataaagtgagaaaaacattgaattgtaatcttattacacttgatgttttgtttctttgtttttggtaaatggaaccaaataatcagcaaaagttggcaaactttttccaaaagggccagatagtaaaatattttaggcttagtaggc

SEQ ID NO: 25980 - DNA, 1028 bp, Homo sapiens
ccattcagcctctttgtctcctccaggaacacttttttccctttctctctttctggcttattcttctgactcattcgtcaattagaagtataaacatcatttttcgaagaagctttcgttgacacttcccccacccaccacacacacacacacacacacacacacacacacacaccctactttaatccataggattctgtagttcattttaatataattgcttgtttgtcagtcttccatagtctataaattcagtaagtacaggtactgttctcagtgtgccaatcacatggtaaccacttagtatatattaagtgacttggtttttggtgagattgtgtgtattaacacaaaacttttggagcagtgtaatactaatgatataaagtaggaaaaaatccaagttttacttgcctgcttattgttttatatctatttgcttatgtcttcagcagctttttaaaaaatgttaatgattgaaagagcttggagcttaagtgaaacctctgtagctcatctagtgacctctctgtgaatagacaggcactgcaccaattactcaactggactggtcaaacatctacgtctcaaattccacctttaagtattgagttgacaaaattggcagagggaatagaataatgaaaggtgaatttagcagccactaaggaaactccagctcatttttgtaaatgggaagccagacctattagataaattggtcttgtcttttgtttttatcctattgaggaatacttgaaaagcaaagctacacccagtttagaattaagtagaagttcatgatttggtttttatatagaattccatcttatgtattttctatcatttataacaaaaaattaaatgagtatagtgtggtataattagaggaatgctttctctaaattctcaagtaagtgtgtcttggctccaaagcatattgaatatgtaatgtcacactacaataataaaggtcctttagggctgttaaccttaaaataaaaagccctttagtgtatacagaatgt

SEQ ID NO: 25981 - DNA, 1021 bp, Homo sapiens
tattccctactgttgaagtattttatattcataaattttctatagcaattaataaggcattgattatatggcagaaacaggtctcttctcccattcacagtagttcctagttttgaaaaggtacagttagtggtagaaactcagttctattttctggagaatgtatgtttattttctggacattgattttctaggtctatagggactttaaataaatactcagatatctccattagaaaaggaaggaccaaagcatgtataacttctagtgctgactcttcatagcctttttggggctgtaatttgttacctctctttctttgttatcccattctcaagtcacaaattggcattactgcatggtaaaggatagttcctcataatattaattacaaagacttttaaaaaatggattacttaatataaatgtttgtaatttttttttcttattttgtaatataattaatattactgttggaacttaagaaaaaggatttaggaatagagaaacggggattgaggagaaaataaaccatatctctcgcattcctttacattctaatgcttgtctctacttcttcccttttcattctctcatcaaccctgtatatttatcttctgttcttagcactatcctgaaactgtattttcctggaccttttggctccaactttgttgatcatttttgccttataattcttaatctctgtcttcttttacagtatgtttttctaattctctaccagcctttctgatacttgttgcctgttttggtctttgtgagcttttcttcttcttagtgtccttcattgttcccagggttttacccttgtcccacttttctttgtgtcttgcctttcttgaatgatatactctattctcatgatttggaaccctaatgacttccaaacctatatctttagtcctcagctttcccttgagctttggacttatatgtattgcctagtgaacagaacctttcggatattcacaggcagcataaactctgtatctccctgtg

SEQ ID NO: 25982 - DNA, 1044 bp, Homo sapiens
attgctgatattgaggaaaactattgatttttataggttgatctcacatctagaaaccttgctcaactcttttattggttctaatagtcatttgggttcctaagttttctgtgtagtcaatcatattgtctgtagatagtgacttttttttcctatatctcattattctttttattgtcttactgtattgactggaatcatcattgctttgttgttcagtaaggtgatagtaagactctttgtctgatttctaatcttaaagagaatatatctgacttttttcattgattaatcattatatagctttttggtaaataatttttatttagttattcctagactcttgataatcttttaagaaaacataaatgtctgttgaattttattgaattagttttctatacatattaatatatttattctttagtttatgaatatggtgaatttcattgatagattttttttgatattaatatccttgtgtttattagataaactcaatttgatgagcatgtgttactacttttataacatcctgtagaatttaactcctttttgttgttgctttattttttatttttgtgtttgtggtttggccatatgtaatacagccctgaaattttcatttttggtgtgttgtccttagatgatttgtaagtcagtgttgttttagcctcattaaaattagttggacatctcccccttttttctattttatgaaacaacttatataagagttatctgttccttgaaagttgtgtagaactcacacatgcaataatatgcatttttcctttgccacacactgactcctttcttccttaacattttgtttctgtgcttcattattttgtttactctcttcaatcgtatgtttggataagggagttcacagttgtaattaagccaatagtctatagaaaaataatcatgtttattcacatcaagttttaaggttaagagtaagcctcataattaaaaatttaatgaatttttttccctcaaataacataaggtctgtgaaatggctagtttattttgttt

SEQ ID NO: 25983 - DNA, 1106 bp, Homo sapiens
tcttactgcaacctccgcctcctgaaattaagtgatcctcccaccccagcctccagaatagctgggatcacagccacaggtgcccagcctttttttatttttttgtttttttatggttagagatggagtttctccatgttgcccaggctggtctggaactcctgagctcaagcagtcagcccatcttggcctcccaaagtgctgggattacagccaggcataagccactgctcctggcctgtaatcatttttgtgtggatagaatttttaaatttttattttttgcccatatatatatatttccccttctctttcaccttccctaaggcctataactaccgagaatgttgggcagggtcttttggcttttcttctatggcctatgaacttctgtccgcagattttatattgagtttgtgattgaacttggaagccagtaggtggtgcatatgggtcagtgctgattgtgcccaatgtggttgggtatatatctgacccttgtttattgggagaagctctctgttgcctcaggcaatggtctgatctgtggagtgcaccctggtctcagctcccagctttgccctgggggttaggggagtgatgggtaagatgggaggggtcagacccagcaggcccacctacaggtctgccagtggaaggcacaagcactagtgctgaaggagaatccagtggggggccaccaagtgcccagaggtatgcctaggtgtggagcagggaaatcttggtcccaagttctctgccttggccagcaggggcagggtgcgggaggtggaggcaacccaaactccttgtccaggagatgagtgcttgaggaacttggagatctgcttgggcctcgggtaactatgagaactttaaagatggtatagtgaccaccttcctcgatttaaataaaaaaggtcctaagtataataaccttattgatggaaatcctttgggtcatgatgaaggtgtaagaaaactatttgtctatttatttgttttaaaatatcacatgaaacacacatgcatgtgttcacataaacacattcctacggacaataacatacaaataacttttttgagattatctgaagatggtcttt

SEQ ID NO: 25984 - DNA, 1036 bp, Homo sapiens
taatatttctattatgtattgattgggtctcttgatagcttttcttaaaatactcttggagtgtgaacatagattttcatttttataacttttctacttatgtttataaactacaatgttattcatattatttttctagatttgctttgttaccagtagcttatactactggtataatatgaatggatcataatcaaaatttctttgtatggagtttttgtctatgataagttgtcttatatgcgtttgaatcacccatccttcatctcattagcaacttatatagccagtgacttctatccacaacattaccaaaatcctaagattatgcccaattgtcaaggtaatttacaggataggagacgttatgtcctggcttttctagtaaaccacactaaaggtacatgtttcctctgctaaaaattggcttccttcatcattctcccctctttggagggcagcttggagtactgcccttcactttgatgtggtctttgaatttcttcttttcattgaacttcttacagaagcctttatttgaaacagaatgtttaaatccaaatgtggctttctaacacatcattttttttttccattcaatgccatgtcaactaagttatatcagatctgttatatcatttttttttggtgcaaacatatgaggagaaaaaaagagagtaagtagacatggggagataattttagtgacccactgtgcacactcacaacaaccttttagattccccttagttttgctaggtgaaaactaattttcatgtagacactacctcacagcagatcacttggagccaaattaccagatagacctgcatatcccgttcattgccaaaatttaaaacattactcttttaacaaaaaatacttttttttttcctggaatgtgttcttaatttaagtattctgaatactcagtacatactactgactgttttgcattttgataatgtttcagaaattcagagcacttcgtaatactttgttgaagatggtagaaggaaatgaaataaattaattt

SEQ ID NO: 25985 - DNA, 1067 bp, Homo sapiens
ttgctgctattgtgtggtagggtcctttgtgctgaatactggcttttccatcagaatcaaaatgttaaagagtatgctcactatatttccattcatagcaaatgaatatgataaataacagaaacaagattctgagggatctttacagaattttgaatctggcttcatctaatagaattaaattttatcttgagttattgtgaaatttctattcttatatcttaaataactaattgtaagtagaggttggaacagtttacaagcagtgcatgtggggaggtggaggaggcactgcaatgtggttattcaaaaaagccaaggctgtatgaatagtactgctctagtttctggatgagcgaggtgataggcctgttctgttctgtttggaatacatctggaatgttatatttagctttgtgtgtcacagttcaagggaatataagtgaagcagaatatctttggggacagaaaatagaatagcattctaacaagatactactgcatatgaaggactaaagatgtttttaacctagaacacagaaaacttttgtggccatcaaaatggcttcatattttaaaagggttaaacatggaaaattgattagacttgtattgttttgacaccaagagggtaatattatattacatggatagaggaagctttgccattggagaaagattagggcacaggcagaaagtaaagggattagatttttgagtgccttaagtatatatatgtactttatatacatttctgccttagtcatttctggctcttgtaacaacgtactgtatgtagtctcaatggcttataaacaacagaaatgtattgctcacagttctggaggcttaaagtccaagatcagagtgccagcatggttgggttctggtgagggccctcttctgggttgcagactaccatcttctcatatcctcatgtggctgaaagacagagagagaggtctctggggtttcttttataaaggcattaatcctattcatgaaagctccaccctcctaaacctcatcgctgccacagactccacctcctaataccatcatattgt

SEQ ID NO: 25986 - DNA, 1095 bp, Homo sapiens
atgatgggactgcaggtgtgagccaccatgcgtggtcctaatttttccttttttctttgtgattatatattatatataaaatatatgcctattatatattatcttatataattatattacgtatattatatattactacatattttatatattagatatagagtataattatatataatttcatagaaaaaagtaaaaatctcataatgtatacaatcatttatatatacatatatttatataagatgctttatatatatatattattgatggtgaatagttttctgactagtctttaagtagcctcactaatttcctctcaagatttcagaaatgttattcttcatctattgagaaataactaatgtcagaatctgagatgttaataatcaatatacagagagctatttttggtgtaacatgagcctagcaatgttgacttgaatgatcgatatgtatcctatataatcagcagaatgtaaggtttagctttctgtgcagctgcaggagacatatttaattaatactgaagcaattatcttgacaagtaaatcaaactcaattagatttcaattagaacactaacattttctcaaatactgcatggttgccagatggttacacatttttttggcctcctttctctttcaaaggttgacgttcctgctactgtgtttattaggtataattactcaggcttttttttttttcttatttgtggggaggagggtggaatttgaaatttaatacattatatgtcgtaattcttttacctggctctgtatggttttattttatagaaatttaggaaagtaaaaatattgactaatttgtaaaattaataaatttgaaactagagatcacagattatttagaaagagaattttagaaggcatttaattcttacccctaacagaggcaggccaaattattatactggatctgtgtatcattgtgtcatatatatatcttctctttcaatcgaatggatgtctaaatctttttaggctcagtaaaaaacgtaggtattccagccgaggtgggcggatcacaaggtcaggagatcgagaccaccctggataatgagaccaccct

SEQ ID NO: 25987 - DNA, 1045 bp, Homo sapiens
agtcaaaagactgtattgttttcatattgtggatattccagtttattaattcattgtatgtttctacctacttccaaaaataatttgagatactgtctgggaaaagacagactataaatactggagttaaatgaacagtaatatggtaatgaaaatgatggtggataggaggtacgactaagcggaagaggaaataaataccaggaaactgatttaagaaatgtactatatttcgtgctttactctgaattttctgtaaaaagacatcatggtttgtataatttttatcattatctgataaaaacaagtgtgtctttttcatctggccattttaagagaatgcagaggatttttgtttatttgtttttatctaaaagtaactcctgattatggagtggggtccattataattatggtataaaataataaaactatatttgtgaaaaatgaaaatactaactctcaatagaagtatatacgcttactagaaagtgtttttgtagctctcttctctttctcagtttcttgtcaattagaatgataacattcaaatggccagttgtgtagggaaggcaagtggaagctctatgttgactctagtactatagtgtcagagtgattagttatatataatttatatttagagatgatcactgatagaggaattagttgatttgctcttccttggatccattataatatttgaaaaacttagacttcagccatgacactaagaacaattacaaattattttaacagaaagaaaaatgtttggtgcacttaacattaagaaaagtatttttggtccctgtaaattattgagctttttttggttgttacattgttaagttgattttatcctttttttttttttttttttttttttactagtttttagtttttttcccctagtttttatatagtatgtaattatctttgatttctttcctttcctgtttcttctgtctgctccaattaattcagagtagattgatccttttaagatcaagggcatatctaaattggttctttgaagatgtttctc

SEQ ID NO: 25988 - DNA, 1035 bp, Homo sapiens
tacagaaaacttgcagaaatagcacaaacaagtccatatacactttatctggattccccaaatgttagcattttttccatatttgctttctccttttattatccatatatattttcctaaacaactttagaattcattatagagataatgacatctttaggaaaaaagcattctcttatataatcacattatgaaaatcaggaaatttatatttatgttgtattcttatttaatctataaatctcatccaaattttatgaaagaaaaaaatttgcttaggtctaggagtcaatccaggatcatttgttcagagtctgtgctcttaacctctaatccgtgcagccttcccttgactggtcaccattgctaataccaccagaatcattgtttccagccaagcattgtttatattccatttctcttttgaaaccttttgttgccatttccatcagcttctaagatttaacaattttatatttcctcttttctgttttcttcggagaatattttctccaattatgaatgcacactttgctttttctgttacctcctcccaattcattttacaactttatgccattggtgaaatctcatgggattaccagtttttaaatcagaaatgttattctttctgccaaacttccttccttttcttaatgaaaatacacttccaaaaaacataatcttgacagattacaactaagaaacccacatttctttggtttacctttaaatatatttgttttaatcaggggttcctaatctgaggcccattcaaaaggttcaggaggtctattaaccccttgaagttatatgcaagataggctgggcatggtggctgacgcctgtaaatcctggcactttgggaggctgaggcgagtggatcacttgaggtcaggagttcaagaccagcttggccaacatggtgaaaccctgtctttactaaaaaatacaaaaattagctgggtgtggtggcatgtgcctgtaatcccagctacttgggaagccgaggcaggagaatcgcttgaacccagg

SEQ ID NO: 25989 - DNA, 1061 bp, Homo sapiens
gtgcaacctctgccttccaggttcaagcaattctcctgcctcagcctcccgagtagctgggactacaggcgcccgccaccacgcccggctaattttttgtctttttagtagagatggggtttcactgtcttaggcaggatggtctccatctcctgacctcgtgatctgcctgcctcggcctcccaaagtgctgggattacagacatgagccaccgcccagctgaagcgaaggttttatgatttttagtatgtatgagatatgtactccctatttgtgtaggacatattgaatatcatttggaatgttggtgctatttatatgtattgtactgggcttcttcttttgtagtcagaaggaataagactcataccaataatacttattatggcttgcatgagaagttcaagtctttgaacataaataatttagaaagtttgattaactttattgacggggtaagtaaagaattcagtatcttgcttatggttatacagaagcctcaaaacagaacactaattctttatctctgaaacccggacttttcacatactacctgtttcaaaaaatctgtaccttattcataagttgttttgcttttaggaatatcagataataattgtacattctaagatatctattgaaaatagtacttcttctctaagagagtatctctctctttctctaccccatggtactgtttgttttattctatgttaaaccttattaactcagtgaattttatatgtagcatgtttgttaagttacagaattctgtgggtggttttcctatcatgcttctttcattccttggacttaaaagactgagcctacctaaggaaatccactttaccaaacttcagacttcatataccatggaacttaaaagaagaaaaactcttggctaagcctgaatgctgagaaccagctaagtggattcctctgtccggagaaaattggggaaaaaaaagggaattatcaagctcagcaaatgtagttgttgatggaaatgctgacagactggtcctgcttggtgccactgtcgtgagaagtcagtcaatgg

SEQ ID NO: 25990 - DNA, 1065 bp, Homo sapiens
tgggttccctgtgtatatttcctgggttcccagttccatgtgactttttctggctgataagatgtgagcagaagtgatatgtatcacttttgggcttagcatttaattttgctccagagttctcttattttcccttgttcttgaaaaatggcaactccaagatgctggttgagtccctgagtcacttcagggagcatagcatacctgccaacccattatgagtatataacatgagtaagttttaaatctttgttttaagtcactgagagtttgggagtggttattactataactatccttactgatactattagggacatttggtatgtttccagtagttatgacagacagtggtacaatgaatatccttgttcttgtctccttggactcacattcaaaatttcttgagagtgttgttttttagatgttgctatgcatggaaatgatatcatagggattagttaaatatagattctgattgaataggtctggctgggatcatttctgagattctgcattttctgccacgttcctaggtgatgccaattctgttggtctagggtctatatctagaaggagatcagctggatcaaagaaagggtttacattgtctttgatcttattgttgttctctatggtgatttcccatttatcctaccattgttattttgtgggaggtcctgttattctacctcttggtaacatctatattgtcaaactttttggtttttgccagtctctcgtgattgtgaaatgatagatcactattgtgatttttattttatttttattagattattagtgaatttaggttttaggcatgtgggttttctctcatctacttcctgaccacttttaggttgtttattgttttctttttcatttataggaattatatactttggatgccttttcctgttatatattgtcttccaatgcatggcttacctattaacattatataattagtagtttttgttgcgtagaagttttaagttttggtataatcaaatttattttgtgggtttcaaaaaattttagttttagaccttcttaagttcagta

SEQ ID NO: 25991 - DNA, 1040 bp, Homo sapiens
agacctatatatagcaagctaattacagtgctaagatgaaggccacatagtcaggcagctaaaatccacatttcctttcttaggtttttgattttttttttctttaaataggaagatcagagagcctagggaggcattattaatataagttctgcatttcttaactttggaatttgcttttctgtgaggttgtcttttgtgacgttaccgtagatctctggagggaagaaatgaaaagaagttttacccagtagaatgaactatacttgccatttaacttagaagtatattgagtcaagtcagggtgtactgaatttgaaaccaagagattgtctactattgaataatatatcagcttatgcaatttatattgaggagttttcggtgattcttcacgttctccaagtgtcaaggtaaatcagtatctttacatggaaacctttcttttcctttcctttgaaagggggaaaagttaagcttatttgagattacttgaaatgtcaacggtagattctcttatgtattccaaacagctttttcaggcaagtggttattctacagttttcctacttgtcaaagcagagattgtttataatttatttgacaatctccctttatttcaaaggaaggagaatgaatccagattgctctgccttttctgaagtaagtgttcagaatcttgactggaagccaaacatgtacagtcatatgttgcttagcagagaggatatgttctaaaaaatgtgtcattaggtgattttgttgttgtgtgaacatcatagagtatacttacacaagcctagatggtatatagtctactacacacctaggctatatggtatagcctattgctactaggctgcaaacctgtacagtatgttgctgtacttaatactgtaggcagttataacatactggtaagtatttgtatatctaaatgtagaaaaggtaatgtgttgcactacaatacaaagcctatgacttcactagataatacagtgggaccaccattatatatgtggtccatcgttaactaaaac

SEQ ID NO: 25992 - DNA, 1155 bp, Homo sapiens
aagctcattggtctcagggacacattgcaggggttggcactaattcatttggggagatagctgttgctaggcaactgtccaggtctgaatgtcttatctgaaatactgtaggccagaggaaattcctgtgataatctctgtttgctctgtgtacaagtactaacaagatgtccagatatttcaggaatgcaagggagagagtttctttatggccttccccgacttcattttggttaaagttttgacataagtgactccattttgttattgttaaccgccacattattgttttaagcatttattttattttagataattattgaaaattagacttgtagttacactgaatttttgttgttgtttggttttcattttaagtaatattttattgagcatctactatgaaccagttactattctagattcttaaatgcattttattttttcagttggaaaagcaatacatgtttatttaagtaatagataaagtaatacagaaatagaaaaaattcagaattgcatcatctaaacattgtattagtttgctggttttctttctgtccttgattgttttctatagaattgaattaaaatatttgaacatatttatctttatattgaatgtgtatatagttttacatctgtttcttcacctcaccttccttcttactctcctcttcctcttccttttactcatcttccttttcctttccctcatcctttttccttcattttattatactttatataactgtggcaacctgggaaaggtaaatgcttctatgtactggcaatgtgaaaaaggttgcttcatgtgcaaaatgatgataataactattctgctaggattatatttggggaataagtgagttagtgaatataaaatgtttaacaggatttggcacgtattttaaaaatgcttacttttactactattttataattttgggctgaatttaacctttaatggtatggatgatagtgcagtaataaaatagcatagattaaattactgggtggtcaaataattggtctctgtttttgtttgcttttcatatgagttggtactataagtaacttttttctgctaatgttcttgagccatcactccaaactcagaaatatatatcacaacttttttcagaaccatgatta

SEQ ID NO: 25993 - DNA, 1046 bp, Homo sapiens
ttttgctttctttcagcattgtatttagcatacaaggttggcacatattttgttagatttatctgcaagtaattcattttctttttttaagtgattttaaatgttattgtatttttaatttcggcgtctgtgtcttcattttctattatatagaaatgcaattcatctttgtatgtttaccttgtatctttgtgatcttgctggactcatttgttagtctaggagtttttgtgtagattccttggaattttctgtgtaaacaatagtgttatctgcaaatggagagagttttagttattttccaatttttatgccttttatttccttatttcactggctagaacatctaggactatgctaagactggtaaaagtggatatctttgcctttttcctgatcttagaaggaaagcattcagtcttttctcattaagtatcatgttaactttaggtttttttgtggatgctctttatcaatttgaggaaattttcctctattcctattttctgagagtttttattgtgaaagagtgaattttgttaaatgcttataatgcatcattttatatgatcatgtgatttaaaatatttagtctggtgaaatctgttttgaacattgaatgaaccttgcctctttggaataaaccctacttggtcattgtatacacttctttttatttgtctctgagttctatttgctgatatattgttaaggatttttgatctatacttatgagagatattggtctataattttatttattttttattgtcttatgtctggttttgatagagtaatagtaacttcttaaaatgaattgagaagtagcgcctcactcctcatctattttctggaagagattttagaattcatgctaattctgcttcaaatattttgtagaattcttcaatgaagccttctaggcttgaagattttaaattgcaaattcaattgactgtgtaaattactgtgtcatattggtgagttgtagtctgtattttttgaggaattggtttatttcatttaagttgttaaatttatcgtgc

SEQ ID NO: 25994 - DNA, 1034 bp, Homo sapiens
atccctactaaaaatacaaaaattagccaggtatggtggtgcgcacctgtaatcccagctactcgggaggctgagacaggagaatcatttgaacctgggaggcagaggttgaagtgagctgagatcacaccactgcactccagcctgggggacagagcaagactctgtctcaaaaaaaagaaagaaagaaagagagagagaggaaagaaagaaagagagaggaaagaaaaaaggaaggaaagaaagagggagggagggaaggaggaaggaaggaaggaaggaaaaaggagaccagtggctttttttgttgtttggaatgcagcttcctgagcaatcccatgaataaggccattcagacacacatgcgttgtggtggcacacacctagggctctgggtggtgtgctgtcctgtcaccagctgtcaggcccctctcacacagcttctgcctgcccctcaggccctgctggagacggcgctgacgcgagtggtcctgcccatgcccatcctggtgctacccccgatcgtcatgtccatgctggagaagtgagttggggcagccaggatggagaggccaccatgggggaggagggggagagggagggggaaccggctggcccaggcaagagatgagggggtggcaggaagcccaccccagtttgtgtagagggtggaaggtgtcttgctccatcttggactttccaggtagtgccacagaatcactctgtgagaattcttggacttttactatgcaggaccctgggctaggtgccacgagggataccaggataacagtgctggccctcccctgaggagctggcagttgtgtgtgtgtgtgtgtgtgtgtgtgtgtgtgtgtgtgtgtgtgtgttttcatgtgtgctcacatgctctcagtgaatagtatgtacaggaccatttgtgaaggcagagtctgaggattcaggtaggaagactagatttgggtaggcatctgctgtggggcaaatcaccaccttactgagcctcagtttctctgctcgtaaaatacaaatag

SEQ ID NO: 25995 - DNA, 1047 bp, Homo sapiens
ggaaggagatgacactttctcagacacgttggtcatagagaggagctggtgtggcacacatgagaaagcctgtgctctcgaaagatgaaagagcctaggagatggactggagtgacgaagaccccaggcaggggctggggtggggtgtctggcatcctgggccaggtgacaggtatgaaggcgatgacagtgagtccaggacatccgcctcaccctccatcctgccctgagctatgctgcttagtcctgcagcctgtgggcaggtgtcggggtctccctgtcctgagcccttatggtctggctgggcccacacctgcatgtaccatggggtttcagaaagatggtgcttagggctggggtgggaatgaggccttcctacacttcatttattcatggagtatgtattcttctacgagcaactgccacagcatcctatcccttttctcctctgcagtgtgtgtgtatgagtgtgtaaatgtgtgtgtatgtgtgtgtgtgtgtgtatgtctctgatgctttacctctctccctctttctcatgggccagttacctgggatgactgggcagtggtactttaagcagcgacgctggagctctgcaacctcaggtgacgctgaggattaggggtgtgaggtgcagttgtggggaaagatgacatccctcactctctgatgttcctccagttctgccccctcctcccacaagccactgcagcatcatgtactttttctgtgtttttatttttttctttcaaaggtgggccttaatgtcctggttcagaaagccaacaagttcaccccagccacccgccttctcatccagaggtttgtgccgttccctgctgtaggtaagacctgcacaccacatagatgtgtgctgtgggtgggtgtgggggaccgctgggctcccagggagacagatgacccttccacacctctcctgatgcccagggggcacccagctgggagaattggtgtaatatgtttagctaaaagacaagaccatggggtcccactgaccagctctgtgctgagattctgctttca

SEQ ID NO: 25996 - DNA, 1050 bp, Homo sapiens
ctgagtagctgggattacaggtgcgcaccaccatgccctgctaatttttgtatttttagtagagacggggtttcatcatgttggtcaggctggtcttgaactcctgaccgcgggatccaccaatctcggcctcccaaagtgctgggattacaggcatgagccatcatgtccagcccatagtttactttttaattactatataatagttatagtgtgcatatattgctgtttacttatccattctacaatgaattatttgcagtttggggctatataaatgctgctgctatgaacattcttatacaagtcttttggtggggacaaaggctaccttctgttactgttgctgtctctttagcttttagacttaaaaaatcatacggttttatcctttttttctctttctccccatcagttactctggccatatgtactttagtaggttaatctctgccagtgtttttaaaatgttgaaaatatataagtgctacttaaatatgttctcctggccgggcaccgtggctcacacctgtagtctcagcactttgggaagctgaggcaggcagatctcgcttgagcccaggagtttgagaccagcctgagcaacaatgcaaaaccccatctctacaaaaaataaattagccagatgcagtggcgtgtgtgtataatcccagctacttgggaagctgaggtgggaggatcacttgagcctgggatgttgaggctgcagtgtgttgagatcgtgccactgcactccagcctgggtgacaaaataagacgttgtctcaggaaaaagagaaaggaaaaatcctccttataaaggctttctatttttttcttttttagatggagtcttgcactgtcccccaggctcactgcaacccctgcctcctgggttcaggtgattttcctgcctcagcctcctgagtagctgggattacaggcatgcaccaccatgcccagctaatgtttgtatttttagtagagacagggtttcaccatgttggtcaggctggtctcgaactcctgacctcatgatcttcccgcctc

SEQ ID NO: 25997 - DNA, 1025 bp, Homo sapiens
ctcaaggagcttacattttagttccctgaaggaggaatactctttctcacttccttgcccttatacatgctgtttcatgtgctccgattgtctttcttctcctaccccaacctcataattgctcttcctcacctggcaattatattttgctcttcaagagtcagcttagatgccaccacctctgggggttccccagtcccccaattcctcaagttaagtgtagaatcccgtgcctgcctcttgcataatgtttatttcataattgtatactctaacacctcagtcagccctgggagacaacaaactgtttgcaggccaggactggatcttgtttgtctttgtcctcaacaaacctagcacagcacctggtatagctcatggcacagggtaggtactcagtaaatagatatagaataaattcgtgtttgaatagagcttaggagagaaatctaggctagaaatgcagatttgggagactattagttaggacacttgattgcaagggacagaaattcagcctgaactactttaagtaaatttaccaattcatataactggaaagaagggaaatgaatgagtcttagacacctaggtcctcacagatgtggtgaggactttacagctcttggctcagctttcctctgagtattgccaccttgttccccaccatgcatgggctttctccatgtgatgggtggaggttgcacaaggccatagacagcttcactgtcctagcatgggatcccagagggacaagaggactactttatctttcatataaactcccaatagaggactctgttggctcagcttgaggaatgtgctcaaccctgggtcaatcactgtggccaagaagatagaaatactgtgattagccaggcctgggtcatgtgcccacctactaggattgacaacccggccacaaccacataaagtacagaggggcagctcactaaagaaaggatgagatgttgctattaccaaaaggtgaagaagacttgctgagcagatgaaaatcgtaatgc

SEQ ID NO: 25998 - DNA, 1049 bp, Homo sapiens
ttccggaagttgtgagctttgtttcggagcgggagctcttccgagacgcactgggggccggatggtgagttttccttgcgctctaacgggcaggctcgggagcgggagggtccgggcagttttagtagtgtctttgggacaacggctgcggttggtatttctcaagcggcaacgaggccagcccctgggaatgcagcacgagaatgatagagtcaggctgtcccctcaagaaatagtttagtgaggagacatgcagcggataggcgcaggattcttcagagttgtgattgggcccaaaaaggagctagtcctcagactaaaaagagccgtagtgccggggttctgggcgctgtagtaaatggactccaaatggagttgaagggagggaggagtgcgtcaggcggagatgaaaggagagagggaactacctgtccgatagggcagaatcggggagaaaggttggtgacttgagcttagagaaggccattgcggcggtagcagaagaggagaggcagggaccagatcgtagagtgtggaacaccgtgacacaaagttggggctttatcataagagcagcagaatgacaagatctgatgtacattttgaaaggatcactgtaactgctggtgacgactggattataggagggcaggaattgtgagaaaccactcagaaggctactgctgtagatgagcgatgtgacctagcgtatgggagagaagtggacgaatcaaaagtatatttagcaggtgaaaattcaggactttacggattagatataggatttgagtgacaggttgggtctcaacgatgattccaagtttctgacctgagtgagtaaattacgctaaacaagaacaaactattttgaagttttctaagggttcttccccccactcagtgttaaaaagcacgtttttttcctttcttattatgtgtactcatgttttgtgtgcttactgtagaaaattcagaacatacataacaaaatattttcttttatataaaggacaataaaaatcacctcataacctcactacccaagatgg

SEQ ID NO: 25999 - DNA, 1145 bp, Homo sapiens
caggtttgggagtgttcccctcctgctccagacaatcccataaggaggtggaggtgctggagccatagctgactggggggcagaggatcaggatgattattcaggggattcaaagcaccaagcagtgccctgtcttccccacctaatggtgggagtctaaaaccttaggtttgggctgtttttccttttgcagcatcaaattatacctcttttgagtaggttcattctgataaaagagtataaaagcctggacatacaggattgcatcctattttctctgctcttacagaatagttgcagttgtattatagtagcataacttaaagaactgtttgtcagccattttttcccaaattctaaggcatattgaggccaagcagcgttacagttaaaaaaattttatttttcttcatgggctcatagctgaaagtggcccaattctggagaatgcagccaatgatgctactctctgggatcaattccaaatttgccctgttcagtcttttcacataacacacacaccacacacacacacacacacagatacacacacacacaccccccaaaccaaacaacaacaacaacaaaacaaaatcacaaacagaaaaccaaactccctacaggaaagcaaacaagaaaatgggcatagtccaccattctattactcccccaaaagggccctcttcacaatgcaagcagagagagtgagatatggctgtgtgcaccgcagtgacttacccttcaaaccaaaaccagaagtccagatagcagtctgagatgtttctctgctctaagcttctagagtaccaacagcagcctacactgacctagaagagcgactttagggccccctgaccaacacacttgggcagctgctgggacactcgttcgcctaacctggccagggcctattgccatgctagacctggcatggttgccaaaatctgttgcagaaccccaaaagttaggttcaagtacctgatgcgcagtaagccaaacactgacacatcggtgcttcagagcagagaaaggtttattcaatttgaccaaagcatgagggtgggagaggcaaattctcaaattcagcctccctttgcacgtaaccagtggcttttatgagtaaggtaggtatatgggaagtgaga

SEQ ID NO: 26000 - DNA, 1001 bp, Homo sapiens
tgagggtgggagaagcagattctcaaatatgaccttcctttgcatgtaattgggggctttccctgatgatcaaagctgctcgtgtcccttggccagtcaaatttctggatgccatcagggaggtcagtatgacctaaggatcattgttctttaaaagaaaaacaagtacgttaatcttgcaagcagcccctgggggttaggatataaagttaatcacttgttagtgactgctctctaccaaaatgactacgtgcgagcgatcctgcctggaggaagctaaggacagagaaagaaaaataagtaaaataaacacctgatgatttttctaatataggctgggttacagtatccccactgacactgttcctttcctcaatcttcagttggggtgttgactcagtctaactacttcccgctggcaaggggcattcctagggggctgaggaatggaacttacttacctgcagttgaaaatattcacatgtcccgggacttaggcaattttgttgtaacattgttgaacagggtgtcaggagcttgagaagggcgatcttgcaatcccacatatatagtgccacagcagtataatccacagccaaggagtattcctgttcctatagtcatagctagaattaccagtaattttttccaccaagagggtactgaccggaagtattaagataatcattggtttagtgacatcatgaggttggacacagcatcagtttgtacatatcttgaagggccagggtgatgtttcctgaattgtctggaatgtacacatagcattcagttttcattatggcacaagttctccttgtgtagctgtgaagacatcaagggccatgtggttctacaaaactgcttttttcatcatagtcatctgagaggtgactaaagagatgcctttgaatgcatccttcagcacatgctgggtataatttgttaggatctcaacatgtcagataacattttttaaactaacttggggaacaaaaatg

SEQ ID NO: 26001 - DNA, 1050 bp, Homo sapiens
tttaaaatattttatgaaaatataaatttaaaataaataaaaattattgtattaatcctagtaatggcttattactttttgttttgctttaagaaaattttcagagaatccacatgtttaccagagacaccatctccctcctcctggtccccctggagaggactattcacacaggaggtattcttggaatgtgaagcccaatgccagtcgggcagcccaggatagaagaaggtggtatccttataattactccagactctcctatccagcctgttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaacctagttactacctgtaattaattgtggtatttttgtgattagatattactttctttggcagtcagttgtgggatttgaccaacttcctttgactgaattgtcagatatacggtctcacacaggaatggatgaacttttagggattgtcaattgagcaagagagactgactgataaaccagattgctggtttattcaattatagtgagtaagttacctggcagggtaattgccatcaactgagtagaactatccagaaaacttgaaaacttttataaaggtgataaacagagtagaata

SEQ ID NO: 26002 - DNA, 1049 bp, Homo sapiens
ccaggttcaagcaattctcctgcctcagcctcctgagtagctgggactacaggcacccgccaccatgcccagctaattttttgtatttttagtagagatggggtttcaccatgttagacaggatggtcttgatctcctgaccctgtgatctacccgcctcagcctcccaaagtgctgggattataggcgtgagccaccgcgcctggccgataaggaattcttgctgttcagtttgaaccaggagatattattctgctctgtattttgcatttagcactggaaaatcagttacaggacagggaatatgtgacttttcagaggcaattcggaaagggacttagaaattttgattgattttaaacttaagccaagagtttgatgtggctatcaaaaaggatcttatattcttaggctacattaatgtagtatagtttttagaataaggaagattgttatttaaggagttgatatgaattataagaaaaataataaaatcctaatagagaaatagcaaaggatctgaacagataaaacgacaaaagtattttcacttggaaaatggggaagacctcagtatggttaaagtggtacattagtatgagttctccagaatgatagaaccagtaggatggatggatggatggatggatggatggatggatagatggatgggtggatgggtgggtggatgggaggaggagcttttttattcggggtatcagcttatgcacttgtgaaagctgagaagtttcatagtaggctgtctgcaaactggagaaccagggaagctggtagcattcagtccaactcagaaagcctcagaaccacggaagccagtggagtaactctcaatccaaggctgaaggcctgggaatctggtaagggttggaggacactggtatgagtcctcaagtccagaggccatgaagcctggagttctaatgtccaagagtaggagaagaaggtaaggtattccagctccaggagagaacacaatttgcctttcctctgcctttttgttgtatccaggcccccagcctattggatgg

SEQ ID NO: 26003 - DNA, 1065 bp, Homo sapiens
aatgggaagttagtgacatctgagctaagacctgaacaagcttcatgacaaactccaaactctttaacatggtctgcaagacacaagaagatctgatccctgtgtatgcctctctggccttggctttcctttaggtagcctaccctcctgcaggaccaaactccaatcatgccatgttctcttgcaaatatgactttgcatatgctttcccatttcctgaagcgcctcctctcctcacctgaccaactcttactcaatcctcaaggttctgtttagatgaacctcctgtgtgaagcctttccagatcctgacacctctaagctggattagctagtcctcctttctgcatggttggtattctgggtgagactccatcactgcaattgtcattgtgtttctccagctacaggatggggctcctccagggtagaaaacaaattacaacctaatgacctagctgaatgaataaaatacacaatatattactaatttcagttccctctgaaacctacatttgtgaaaaataaaaaataaatcttaagactgtatctggacctcaatctcctctatcagaagtaatctttctcaagggaaagaaggggggcatccttccacttatggttactgattggggtgctgatgtctcagcataagaacccacacatttaatagatgacatttactacatgccaccccaactcctctctgaataggcaggataagaacaaacagcatgaatctgtggatttgtacagtcacgctcatctctcagtccccacctccacctaacttgtgtgtgcttcttcacatctgttcgatccctgctcttcccacactccaatgaataaatgccctcccctgctcttccaggcctgtgtctaaatcctttcccccagcaagcctaaggtgccacttcttcaggacttctctagctctgaattcctaccacactggtcaggtgcgaagtggttgaatgtgtatattatcagatacctgtctgccctgagtaagccctcgcttaaaatatttggcccagatggtcaatatttagattgtaggttgttt

SEQ ID NO: 26004 - DNA, 1007 bp, Homo sapiens
ttgaccagttcccatcctgaagctttataggagcctccagccaccagtcatctcattagcatacaagatactcttagcactctggtgattccaacaagggttttaggagctgtgtgtaaagaaaaaggaagaccaaatacttatatcacaatatcatacctatatttttaaaaagagagggctggacgtggtggcttacccctgtaatcctagcactttgggatttgggatgccaaggtgggcagatcacttgaggccaaagttcagtaccagccttggcaacatagaccacatctgtacaaaaaagaaaaaaaaaagaaaaagaataaatgcctactttaaaatgttcacagaggttatttcatcattcttttggacttcagaaaactagagttgggaatcccttctccaaaagacatttacagagtttcagttttagatccatttttaattgttatttttcttctctttttaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattctttta

SEQ ID NO: 26005 - DNA, 1024 bp, Homo sapiens
ccaccactcccagctaatttgtgcatttttagtagaaatggggttttgccatgttccccagggctggtctcaaactcctggcctcaagtgatctgcccacctcggcctcgcaaagtgctgggattaaaggtgtgagccactgcacctggccagctattagttattattaaatactttagtatgtgggtactccctgttttcatttttatgttgcatcatagtaagtctgaatgttttattataggaataaacagaaatttgagttacatttgtcttgaattgcaaacattttattttttcaattttattaataacatttatgtttcctgtttctagtttttaaatgaatttcttggaagagtttttagttgatcttttaatatttgattattttttcttgtgcttatttagtatttaaagcagcacaatttagaagtaattatctggcttgaagatgctagatttaaaaacattttgactttaataaatttcaagaaatactgaaaaagatggaactctatcactcataatattaagtccatcatatgatgggattaatgtttgctgtgtttccttccagtttcttttttttttcttataataaatgactgattttatgtgatgatagatgttatcaagatgtttgcttcttagaaaagattgtcctttctgactttgctacaagtgtaaaggaaaaaagatccctaatgagtttgtagttctatttttattataatattttaggaagaatgtttttattttatattgtgttaagttttattattcaagctttaaaagaaatgaaaataaacaggaaaattaaacttacctatggctcaaatgctttacacagtgatgttttgtataactcttgttaatccttctagctcggcaaaggtaaggggggaaagtatgcatgcctaatgtatatctctaacacctggcccccaaaacagagttttataatcttgggtccattgatgataataaattgatgaccaagaatctcagaagaatgtagtgg

SEQ ID NO: 26006 - DNA, 1066 bp, Homo sapiens
atttaatgtctggcttaatagacacctggattcttatatccgtttctgtattcagtctgttgtgatattacacatcatggagcctctggaaaacaccattgtgccctcttgagagagtaagagtgaaaagaacaattaaaatggtttgaccttacagatcctccctcagataggggattcctggaccacgttttgagaatagctcttctagaccaaaccaacttccacctgggcatattttttgttttgagtgaatattgaatacctaagtgttactttcttagaaacatgactaagaggaagatttataagtgagggagttttgtataaaattccttttacaagatagcattttaaaaaaatctatttgttttttaagaaacttggaaaatacctagttgtttttaggtacttctttagacaggagactaaaactttttatttatttattttttcgagacagggttgtccaggctggactgcagtggtaccctcacagctctctgcaaccttgaactcctagtctcaagggatccttccacttcagcgtcctgagtagctgggactacaggcgtgtgccaccatggctaactaattttttaaaattttcaatagagaccggggtctagctgtgttgcccagactggtctcaaatcctggcctcttaaagtgctgtgattataggcgtgagccactgcacctagcctaaaacattttttgaaactttccaaggcttatgtggttctctttgcatagagtatactcactcagtaaagtttatttactcaccccctgcctcttccattttattctggatctagctgaagctccctcaggaagtaccccctgactacttccaactcttcatgactttgccttttctctgtagcatttatcgttggcctttggatcctgtcttcttatatcttgtactattattgctatttttattttgagacagtgtctctgtcacccaggctggagtgcagtagcaccatcacagctcacggcaacctcagcctcctgggctcaagcagtcctctcgcctcagcctcctacatagctg

SEQ ID NO: 26007 - DNA, 1050 bp, Homo sapiens
atggcgctgcatccagttatcagctcaagcagcttgaggagcagaatgcccgcctgaaggatgccctggtgaggtagggtcttcagtgcttgcctctgatgcttactcttgtgtctccaaatgtgttagagcacccatcgccagagactctgacacgtgctttcctccttctgccttcctcacatccctgcaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtctggggagcccagcccctcacccagaatcccccacctgactctcctatcagttgatgcctcctctttctaggtaccttccagcagcccttctccctatcctccccgtaacacaggtggatgctgctctgggtgctgaggagatggtggagatgctgacagatcggaacctgaatctggaagagaaagtgcgcgagttgagggagactgtgggagacttggtaagagaagagcagacccctgacatctgacttggacctgctgagaaaaagattgacatgtgacccttggcctttgagcagggtgtgcggtgagggacccagcctgggcttgctaccctgaccctgccttttttttttttttttttttctgagatggaatctcgctctgttgccaggctggagcgcagtggcgcaataatctcggctcactgcaacctccgcctcccaggttcaagcgattctcctgcctcagcctcccgagtagctggtactacaggcatgcgccaccatacccagctaatttttgtatttttagtagagatggggtttcaccatgttggccagcatgatctcgatctcgacctcatgatccgcctgctttgacctcccaaagtgctgggattacaggtgtgaaccaccgccgctggccgaccctgcctttctttagcccaaactatggtgtggtgtcctaggaa

SEQ ID NO: 26008 - DNA, 1058 bp, Homo sapiens
tcctgctgcagccactgaagcatcatctctgtgtccttccttttgaggttgccatggatacgcctttgcatggtggtttgaggagattgatttccattatgatcagatgatgacgtgggtttaaaaagagaaaggatggaatgctctgcttttggggagtggccggcgagctgcccaaaaggcagagcccagtacagccgatagggctgtggctttgttggctgctttggcttttgctgaagttgtgaaatggtgcatctctctctttagagcgcaggctcagggttccctgtctacagggtcctagtgccaggaacttgctggttgattcagggggaggaatcagcaggaacttcgaacagcctaagtaggacttctgataccactgagaggattgaggttcttgagtgcagggctgagtgcctcttgccttcttgcagaagttcctatattgaagataagtgaagcatatagcatagcttttcttcttgacttttagaggtctgggcccttggaggtgggcctggaagtcactggatatttctggggaaaggggacattttgagatggagtagagctgcattcagagtgggagtgggtttgtagacgtttttttagggtaatgaggagctggagaagggaaggaagtccgttgagtgtgtaggccttatctatgaaatccgcaaggcagatactgagtaggacctaggaacaaaaagctctgtgtacgttgtcttctggggtcctgtgaatatctggaatccagctttccaagcttccagtctcccagcctccatttaccactcagtaagcagaccttttcctttctgactcctgaaggacttaggtccacgtttatctcttccttactagtgctttcagagatgtatagttttgccttgctgtcagactgcctgggtttcagacaagctcctctaggagtgggaaagcagggaaagcagacagttgggttagcccaggatcaaggtttgataaggtgagacaagaggagatcaaggtatcaaaggatgctggggtgccagtaaaaacaaggtaga

SEQ ID NO: 26009 - DNA, 1160 bp, Homo sapiens
agggaatgtgagacgatttggggttctggtttggggagggccactggtagctgacccagggcatcaagtcactcacgaaggtcaagcagtgaaccggtagggaaaggaccagccccatggcatgccccatgataggccaacaagttgatttcacgctgccgctgctgttgttgcagcctgagtttagctcgtcggtggcggaaggcgcaacagcagctaaagaggatgaggacagtccagagcagccagaaccctgcaagaggcaaggagggagcaactcaggcatctttcatgcagagaaggggccctgaaggccgaaattctgaggtccaagggagggtggacacagggacctggaaatagccctcttggagacttacaccagagctcatagtagtaggtgcagcagccagtctccccgcagcagtgaccactctcacagaggtagggctggttgttcactcctgggcacagctctcgaagctgcgggcaaggaggcacttagaactaagggggattccagcccagggcactgtccacccccacctcctgcatgcacatacacaatcccaccctgtgaaccaagttcagcttggagagatgggggaagtggaggatgctgagaggagtgttgaaatatctgaagggctgtcaacgtggaagaggatttggaatagcaagaatcagtctagagaacaagacaaaagtgtggacatacaaagagggagatttcagctctgcatatatgagacttccttcacactcaagcctcactctccccaacccccctacccccatcccctcggtgctttctgttaagggagtgttttggcagaagccagaagacagtctgagataatctcagtctcagacaacgggtagcggtaggtcatttccaaagcaagttgctttcattatcctgcgcggttcactaccccccacccgcaactggatctttccacccctgggcctcaggctccctaggatagaggaggggcagtgtgagacccagagcagtgctcccaaccagatgggattgctgtggatgataaaggatggcatccagggcgcgagtctgggttccagctcttctccaaattgctccctcaagagaagacgctgccggactctgttgtgacaataggcacatagaaaaagat

SEQ ID NO: 26010 - DNA, 1034 bp, Homo sapiens
gaaagtgagaccttgttttcaggccccagagtcatttctcccactagcatccctgcctcaggagtgtgagaaggagctggcatctttgtgtcacagactacttcatcagtcgcttatctggagctgggaccaaggtgagaaggaaggggcactgggggtgacataagtcccaggttaccgcttccccaccacactatactctctcatcctcaggtttctgccaggccttgggatcagctcttgggggtcagagcagccttcccacatcctctggcactgctgaacttttgcagcagctctttcctcctctcttggatgcccttcgagagcccaggttacgacggattttctgccagcctgcaggtgagacgaggggctggggctggggacacagagcagttgaggatatctcttttctttcactctgttctgaaatctgcctcttcccaaaggtactccatgacccctaagatactcactctgctgctcaaatccccagatcctgcgcctgtcgccctaggtctctgtacccttcagaccaccttgctctggttcctgggcagagctcagcagtacttggcagcatgggacccagcttccttcctgctcctgatccaaaaggacttacctgtgagtggctggggagtagggaggggagcagcctgagctaggctgagccctcactccctgtttccacccaaagcctctgttgcatgaggcagaagctttgtatagcctggcctcagaggaaagcttagctctggaagtggagcagcagctgggcctggagatccagaagctgactgcacagatccaggtgagaacaggggcctcaacagtggcagtgtaagaccctatgttctgtgccaagtatcgggggtgggaagagtagaacatctcagtaacttggaatctccttggagtctctgctaaatgtatctttttttgctctgttcattttttgttctctttaacttttttttttttttttttttgagacagggtctcactttgtcacccaggctggagtgcag

SEQ ID NO: 26011 - DNA, 1031 bp, Homo sapiens
ggccctgctcccatggtttctgatgtaggtcactgcagggggcctgagaaattgcatttcttttttttttttttttgagagttttgctcgttacccaggctggaatgcaatggcgcaatctcggctcaccgcaacctccgcctcccaggttcaagcgattctcctgcctcagcctcccgagtagctgggattacaggcatgtgacaccacacctggctaattttgtatttttagcagaggaggcgtttctccatgttggtcaggctggtctcaaactcctgacctcaggtgatccacccatcttggcctcccaaagtgctgagattacaggcgtgagccaccgtgcccagcctgagaaattgcatttctagtaagttcctggatgatgctgatgctgctagcctagaaagcacactttgagaatccagtcccagaactctggattttgtgaatttcagcaccaattcacccacactcctctcttcctattgtgggaagcatgactatgtaggacagttgcagacaaaaagtggtttatttagcacccactatgtaccaggcacttgggaggtattttctcacactttcgctttccatcctcacaatatcccttatgaggtagggactaccctcatttttacaggtgagggaactgaggcttagatgttgacagacccatccaaggtgacccagctggtaatggtagacttcatcctgctacacagtatttaaggggcctaaaccataaacaatttttaaaaatttgggaaagtcacacataaaggagatgtttcaataccttctctctccaggtatgaacagtattgagcaagacccacagggcagcaataatcatttatcctgatgaaaggttcctctgtgaaaggtaagggggttgggggagacctaaagccttctgcagacccacatttaaatgagctgacagtcccagcaggactacagaggaaccagctaggggaagctgccaggatcttagacgtgaaattaaaaggagatcatgcttcttaccc

SEQ ID NO: 26012 - DNA, 1246 bp, Homo sapiens
cacccaggacgcgagcaggcggacagtaggacgcggggcacgccggtacctgaagtccttcagaagtgcacgccgggaccaggattccgggaggccgactcctccctgccccacgaatgccgggaattgtggtctccgccggacgcgagttgtgagacggcccaaggggccgcggggtatgctgggaccgctagcccttccggcgcgcctcaggacttcgggtcccctcaccccgggcggatgcccaaagactccgccttcccaagagcccctgcggccgggcgcgaaaatggcggcggcggcgacggccgggcgctcctgaagcagcagttatggagcttccctcagggccggggccggagcggctctttgactcgcaccggtaagagacccggcgggaagagaccgatccccgcgtgctctcggccttcggcgcctgaccacttcgcctctcgcccccaggcttccgggtgactgcttcctactgctcgtgctgctgctctacgcgccagtcgggttctgcctcctcgtcctgcgcctctttctcgggatccacgtcttcctggtcagctgcgcgctgccagacagcgtccttcgcaggttccgacgcgggcgttcggggagtgtcagagctgggtctggcccgaggccacacagtcaccacctcctgtgtccccagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccccatggaggatactgagccttacccctaaccccgatcctctacccaacatgtcagttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggt

SEQ ID NO: 26013 - DNA, 1025 bp, Homo sapiens
gggattatgggaactacaagatgagctttggttggggacacagagccaaatcatatcacaccactatatgagattggggtgcatgggggaagaaaggagagaaatttctgaattagaggagtgacagtgggatggagggttagaaaggataggaggtaggatttttccggacaacggagaggaaggatccggggtgatcctcaggtttgagcctgtgtgactggaatcctcaggatactatgaacactgtagagaaaagaggaggcaggtaagctgggggaatgaacttagaacatgttgagctggagggatctctgggaagtgcaagtggagactcctcccccaataacctcagtgttctggactccaggtcagcacagtctagcttcctcctccactcctcctagttaggaccagcccaccttgatgcccagacttatctgacttgaggcagtaaataactcagcaggtctccctgaccccatgagggcatagagattagggcatcaattctgatggactgatcttgagaaccttcctgcctatgtccatctcctgtgtcttacctcacaggactagcttttgattgtctctgaaaattagtggtccctttctgaggttccgactcgtatagtccctcttgggacagaaacctctgcctccaggctggtgctagggccctaatacttatggacagaatctagagtctgaaaactggtttttaaagataacttctgagttttctatctgttgcatcagccaaggggacatcttgtggttgccgattgttgacagttttaaagctctgcaggttggctcagctctattgtatgcaaggcccagtccatccccatgcctgtgttgtcctcagggaggggccctggccctctctgcacttccagatcctacttcacattcaatatcacaccatgcgagtgactcccaggaagtatgagatgtccagcaggtatacaacacactctgcatcttgtactcactcgggacctttgatgaaagcatcttgc

SEQ ID NO: 26014 - DNA, 1046 bp, Homo sapiens
gggaaaacaagtgcaaatgacattcaatagtaaagggtggttttaaaacttttaaaaagagtttacataacaaaacttgtaggatcttctgccttaggcagtcagtgtgtcagtatttttcctgaatagttgaaacaggtgattaaggagtagaattctttttcctcaaccatgttttaaatgctgaccaatcttagaaagagcgcattccagaacgtttatttaatatactgtataatatatagggtgcattttaattttttccccaactctctgctttctatattgatcttgatgttaccaaatgtagcataatctgtatgattatctaggaatttccttgaatagtgtgatattgtgacaggccaggtttccattagcaaacagaacgatcagtttccaagaacccgttactataacgttaatgaaagtgtaagctaaacattaaaaaactggagaaactggtgcctgagtacaaaactggaatgcaaaaaccaacccattaagaacctgcctgggttttctcagcccctgaaatctgatggaataataaaagcattcttacacatacacctcattctgtcttaagattaagaaactttccaagactctcgagaaagctttccagaccctagtccctagctaaagatgagatagagattgaatgcaacactcccacttgcagttacaatcccacacgtagcacggagctttaaatatatacaagcactagaaaaaagcttagaactttgagttggtctggtgagttactctgacctcccttctttcccaattgtctgcatctcgttttcggacctcaagagcaggcagccatactttgttctctccgggaacaatatcaagtttttttcctttctccccttttccctcccttctttacccttgtttctgctatgaggaagttttttttttttttactttttaaattttttctaacatttttctgtttttaccaaaacttttctcaaaatcttgtattactcttaggatgacaatgataaaatgtaatttccatttccaaaaga

SEQ ID NO: 26015 - DNA, 1767 bp, Homo sapiens
acaatttatttggaaatattaatactttgaaagaaaactttcatgaataagagtagtatttccatattccctttaccaagatttacttgtcattaatattttgccccattggctttatcattagcccttccattttaaatatatacatacaatatgttttctcctgagtactgagaacagggtgcatatttgttaagacaaggatattatgttatataaccagagtagttagcaatttcagtaaatttatcaacacttaatctaccatccatattccacttttgccagttgattcaataatgtcctttataacattttcaatagaactattttaagaaacaaaatttaaacaatatgggaacatttgtcaaggccagcatccaaaatcattaaaattaaatgaaaaaaatcaaagcagctttttttgtatcatgaacacctaactcagtaagttacataaactcagatgctattttttggagatactgtctagaaaatgcttttttttctttgaacagaattcagaatgtttaaagaatggagtaaaatacaactgagttttaatttttaacattaaataaatgttgatatatggccacttgaggaatatgttatagataattaagtggaaagagaaacgacttcaggtcatgctttttaagaaaaatatatttgaattctacatttatggataattcagttagtatatagtatgtgacagttgaatttgtgctgtatacattgtcattgacttaaaaattaacttttactctaatgtgtagtatgccatttttatttttcaaatatgaataagaatatcattatataaataatataaatattgctaatatatgaaaaaaataaacactcattgtctttcatcctagtacaaggattaataccatcgtaggatattttcatcctggcttttttttcaaagttataatcctaataggcatgtaagttagtatactacttctgcttaatgttatctcattgcgtatttatagttgtctgttactgtagtcatcataatcttcagctaaagtttatgatagattcactggagcgatgtaacatctccttaaaattccctgtgattgaatagtttggtcatttccaatttttttatgtacaaacaaaatggatttccctaagtggattttccaacaaaggacccacagctggagtatataaaagacttgtacaaatcagtaataaaaagacagaacctaatacaaaaaaatagcaatgttggcaagcagcttaattaggtactttgcaaaacggcttgccaagtggcaaataggaatatgaaaagatgcccaacagcacattactcaatgataattaaatgagaattaaaacaacaaaatgaaatatgactgcatacccactataattgcaaacattaaaaaacaagaaaatgccaattatcgtaagtatgtagtgaaacaggatttattttatactgcaggaatgatgtaaatgggatgccactattctagaaaccgtttggttttttgtacgtagttgaacgtatggacatgaactgtactccagccattccatttctatttatatacccattagaaatgtatgaccatgcatactaaatgacatgtacaagaatttttatggcagcattatttataatagccaccaaaccagaaatcacctaagtgttccatcaatagtattcatgcaacaaaatactatatagcaatgaaattgatccaactatacccatatgtagcaacatggata

SEQ ID NO: 26016 - DNA, 1025 bp, Homo sapiens
caataaacccagcgtgagtcagcagtgtcacttgagtaacagaaaacaggtacatgggagtttctcctagtatgtgtgtgctattttgagtaagaatggcatatttggtgataatacccacagattagaccttcctgggaatattgcatttaattttcggtgtaagcatattaagtggagagtgtcttaagatagtatgggaaagagaagatgtaaaaaaaaaaaaagtatgatattcatcttaaaatctagaaaattgtcatgtggaagtggggctagttctattctatatgatcccaagaagtaaaccaagaccaaggagtggaagctgtgggagggaaaagtttgttaactctcattgttaactgaaatctaatagtccaaagttatgggcagcctcaggagataatgatcccctatcagcaaatggttttagacatggctggtggaccatttagtagaaatgtgaaaataagtctaaacatcacttgggagttcagatagattttcagactcattttttgttttttcttttttatcaacagaatctatttcaaataaatcttacgcaatccgatacgcaaacacacatacagaagtaaaactgctcctactgttgtgagcacctgcctttattcttccccaaccatccccaacatttgtccaggccatcctgggattacctccatggatatagagaacagcataaaaaccattggcatcacacaagtgcctctttaaagctgtttcaaagtatatatatatacacaaagggttgtatgtgagtctgaaagtgtgattcagaatgcttgttaaaactgtttggagaaccttattttccatcaaacaaatgatgttatttaatacttagaaaagttaatatctcacggttttaaaatatgtgaatttatgggaggtttcttttcttttttttgtttttttttttttttttgacagaaccttactctgtcacccaggctggagtgcagtggtgcaatctcagctcactgcaacctccacctcct

SEQ ID NO: 26017 - DNA, 1592 bp, Homo sapiens
aaattaaaaaaaaagcctgcagctagtttgatgtctgcccaaacagccacccagttttgtgcatgaaacccacagccctggtggggtaggcactggagggaatctcctggtctgccggttgcgaagaccgtgggaaaaacacagtatctgggctggagtgcactgttcctcctggcacggtttctcgtggcatcccttagataagggagagaattccccaaccccttgtgcttcccaggtgaggcaacacccaaccttgcttcagctcaccctctgtgggctgcacccactgtccaaccaggcccaatgagatgaactgggtacctcagttggaaatgcagaaatcaccggccttctacgtccatctcgctgggagctgtagactggagctgttcctattcggccatcttggcagcctccttacactgagggggattatttttaatacaagataaatagttgtttgtagggtgatggaaaaaatctagtacaagtgatgtcaataccaaagtggaaggacagtgttctgggaacaggatcttagactaagccaaaaggcttgggatctcatccacaaaataaacagtttgcctgaagtggtgggagtgtgggtgcctcatccataggaataggagacaagttagagcatatcggcacagatgtaggtaggtgtgtagatgctgtggtaggagcttcatagtgctgcttttctgattgcttctattttcttagcaaattaggaagtaattagctgaaagagaatgcaagggagtagaaaaaataaagtaggaaataatcatctagaaggaaaaagtccatcaactgagagagagataacggagaggggagaaggtatgaagtaatcatctaggtgagagggagagtgaatggacctgagagacagagagagagagaggctcactcaagttgtatagtgatcaagttaatgtgtttgtttttccagccactttttatctgcatggttgcaggcagagactcagtgacaaggtgaacttaactataaagagctgtagtttagccagaggagtttaacaaagcccaagaagaacaaggaaattgaagatgtatgcaaatatgtaatggtaataattggccatggaacttaaactgaataaggagggaagtagtgtttgttaaaggtcttgattatttgtatatgaaaagcaaaacaatctagtaaatacattgtgtaccactgaaatatttgtttcagactttgtagaattcctttgggatcctttgtcaacctcacagacaacaagtttaataacacattgcagagtgattcttgaagaacattccacttgtgaaaatgaagttagtaaaagcagacaggtaataatttctagagttgcgaactccatgatctatctctaaatcattataattttcttacagatcttggtttataaaagatgcagaagtgattatcagaaaactgtttgggggaaaacatatttacttttgatttatagaaactagactttttctcagactgcactgagatgaaaaaaaaattttttaaactggacttggctattttttatctttataataataagatgaaagaa

SEQ ID NO: 26018 - DNA, 1044 bp, Homo sapiens
ggtatgggtgctcctcaaatgttgattgaatcaatgaacgaactcacatttcagtaccagatgataaccttgtctggcatcatacaggtttattgtcaggatggaatgtgatcaggaatttcacttccttgccattgaatacatttcttggatttgcctgtaagacgataatagtctgttagttccagcttatctagaagtgggtctgtatgagcccaggcctggtgtgtagatggggagatcacacatgcatgagcgcacacacatctacacctgtgcattagaggtttcccaagatttagttaattagatgctgcaggctctcaggggcattgcacaggctgagtaacactaaaaggctaggggattgggaggtaagctgctgtttatcacacttctgatacactttttatgagcaccaaagatctgatgttgtaaaatcttgagctccatagaattgatccaggagatctggagttactacgagaaagcagagatcttcgttggtctgttattggagctgtgctttagggacacagacagacctgccttttctcagggtgacttctgctcctgtggaaggagaagtgaattgtctgatctttgttaagttagtgagtataagagtacttgtgcagaaccaaactttacctacaaaaagtattttatgttaacaagtagggactccagatatcctgatcataacatctgatcttataatcaaatcttctaccttctggtctgaaaacatatggtatgatatgatatgatatgatatgagcatttgttgaagatgcaatgggagggactggtaaagccaattccactagtcagaaattgtagcagggtaggaaagggtgtagcttctacacaaataccatggttgtaggtgttcagctgggagaagtggaagccaagggcaagaatgggtctcgaatgcagcactggcaagggtgggctgtgctgcacagctcagtagggacagggtctcaggccataaatccctgctgtgtccactggcctagagtcagatgcttagctgtg

SEQ ID NO: 26019 - DNA, 1044 bp, Homo sapiens
gaagagtgtctaaaagatctagttccttactccacccttagcagtcctctcaatcctcttcccacagaactggaagtgtgttcttcctagactcccaggatcatttggccctagagtgaccatctggtttagttttgttactggagtgggcttgaattattcaagtcatgtgattaacttgttattacgggtctgagatttaaaccaagatgtattctatattaagaggggttacagacaacaatgcttaatgtgtaaacacctctaaattcacaaaactctaactcctctttcccatgccacatttccgagcccattttcactcccactagaaaaatagcagctacaacatcaccttgcaaactttttttttaaaaagggaccagaaattatttagtctgtgaagctaatagagctacagatgttagggaattttgttccctctgttaagtttcaacttatggtacattacttgctgaaggtcatagtgttgcaatattgattagagttaacagccacagaaaaaactcaagtgaacactggtagatgccttccggagccctgttttatagcttatgaaaaaaggaaaagtggcctggcacggtggctcatgcctgtaatcccagcactttgggaggctgaggcgggtagatcacaaggtcaggagttcaagaccagcctggccaagatggtgaaaccccgtctctactaaaaatacaaaaattagccaggtgtggtggcaggcgcctgtaatcccagctactcaggaggctaaggcaggagaattgcttgaacccgggaggtggagcttgcagtgagctgagatcgtgccactgtactccagcctgggcaacagagtgagactctgtctcagaaaaagagaaaaaaggaaaaggatccagttgaagtggagagagaaaatacaatgaaaaatgaggaagagttcttccatgagaaagtttaaggatttcataagcacccttgaagttgaaatagtgaagttttaagagaagcataaagtaatgcaaggtctttttaaaactg

SEQ ID NO: 26020 - DNA, 1032 bp, Homo sapiens
tcttgaactcctggctttaagtgattcttccacctcagcctcccaaagtgctggaattaataggtatgagccaccacgcctggcctaatccttgatgtttgcacttgctgttatggtttttgtttgtttttctgagacagagtcttactctgttgcccaggctggagtgcagtggcctgatctcagctcactgcaacctccgcctcctgggttcaagtgattctcctgcttcagcctcccgagtagctgggaatacaggcgcctgccaccacgcccggctaatttttatgtttttagtagaggcagggtttcaccatgttggccaggctggtcttgaactccccacctcaagtgatccatccgcctcggcctctcaaaatgctgggattacaggtgtaagccaccacgcccagccggttttttcttttgtttttccctttttaaccccattctctaccttatgcaactggtgccctgtggtcaactcagacttctcattcatgccctcagctccttaaacccctcatcctcaaactctaccagctttgcaagcttccaagcctgaattgcctgactcagtttatccctgtgtgtatctgcttggggtgtagaatataacaactaaaaatgatagaagtgtacagattgtggctgttatgaatctagggcattcaactgcggttggacctcagtgccattgagcaatctttgtctttggtcagaaccctcttctataaacattcaccacttggttccaactgcttactcacccacgtgcctaatagataacctcacctcctaattcacagagggaggaaagttcaaaatgcaggaactttcacttcccactgtgagcctccaagggagtgtgtacatctgcatcctgctgcctcatgcatggagatagcctttctgttcaacctgtcatctgttatgatcccacttcatcccatcaatgggatcttactccttcagccacccccttggcacctgtactttcagctgctcagcctctactggtccgttgccctc

SEQ ID NO: 26021 - DNA, 1293 bp, Homo sapiens
tcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctt

SEQ ID NO: 26022 - DNA, 1076 bp, Homo sapiens
tgaatgggaaagagtggaagagggaggggagccaggatctcacatgcctgccccaccctttctgccctcaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggtatactcactgccccatgttgtcaggacctgagaccctgggcccctgtcgcccaacgtcctctgttcctgccctcaggccctgctgtcccctgcagcctcccatcccctgagcagggctgcctgggcaggctgtggcccctgtctgattggagccagctctgggtggccctcatgtggagggaagagcaccaaggccccaccctcccctgggcctgcctgggtgcacgctcaggggcctctgctcttgcctcctaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagg

SEQ ID NO: 26023 - DNA, 1030 bp, Homo sapiens
caggtgggtacagagctagggaaagtaagcccaagcagttgtaggatagtgtgaaagcacctgaagatactcactcactgtgcattttcccaggggcctgccctgcctgagtctaggtagctggactccaaggtctgagaaatgggcacaggcagagagagatccatgggggccgtgggcctttctcttcatcccagagctcacagaccctcagccaagctcttgtgcctgcaggtgtcagtgtgaagaaggggcatgagctggtgaacatctattgccccatcgtggtctccaacgcaggactgttcaacacctatgaacacctactgccggggaacgcccgctgcctgccaggtaaaaggcgggtctgcactgcccctcttgcaggttccccaatgtgtccccttctggagccaacctgctccgtgtgggtcatgcttctcctcttcttggccggccctctgattgtccttaagcaacaaggtgagaacgctacctctaacatcatcctaaccctagcatttaatgttggggaaactgaggcccatacagattaattacagtcctgaggccactcagctgaaaggggcagggctgagcagagtagctggtctgatttgaaagctccgctcctcccacccttctgggctgagggggcttccagagaagaggcctcaggaagagaagcaggagagcaggcagcccacagggagcagagccgccgagccaacgcagctaagaggtcccgccaccttcatgtaactggatctgaggaagggaggccgctgggaagaggggaccagtaacccagcaggggtgagagagaggggcccagatgaaggactcaggatggggcgggagctggagagcatggagtagctccggatatggtatggcggaaaccttgactggtgcaggagctagagagcaggggaaggagccctgaccccagagggtgggcccgggagctgctccctgaggagccggggaaggggacagcagagcgggctggggggtaaagcgaggtcct

SEQ ID NO: 26024 - DNA, 1031 bp, Homo sapiens
atcctctaccagactgtataaagagtggtgtacccttccagctgggagatggagggtcacttggggggagattcccatatatgcctgtgtgggaggagtgaggaccaggtgccttctaagggctttagctgaaattcttctggtgaaacaggagtttgaacttggtcggctttttcctgtttttcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtg

SEQ ID NO: 26025 - DNA, 1046 bp, Homo sapiens
cttggaacataggatttcactgcaagtctggctttttagtctggaaatacatttgaggtctgttttcgcacagctggatcacctgtttcctggttttattacacaattcagaaggctagaagaggagtttgggggcttggcacctgaaaatttagaccgcattcttattaagtaaaggaagaggtagggaggccgaggcgggcggatcatgaaatcaggagatccagaccgtcctggctaacacagaaaccccgtctctactaaaaatacaaaaaattagctgggcatggtgacatgtgcctgtagtccatcccagctactcgggaggccgaggcaagagaatcacctaaacctggaaggcggaggttgcagtgagccgagatcacaccactgcacttcaggctgggcagcagagcgagactccatctcaaaaaaaaaaaaaaaaggaagaggtaaaaggcaaggcagcatttaataagtacctgttgtatccttttaagtgtttgttgtggtaatcctcacaaagaccgggactgatggaaactccttgctattaaactttttttcttgaggaattttgcttttcaagtgcatatacactattaatattttttacccaagagagcattctaagctaatttatgcagtgtgactgtattaagcattaagcttccttcagagctggcctatcggagatgctactgccctctctacagatgtgtctgaaatgcctgcccaaggatggcccttagccagttaacagctttatagcccatcctcattgcttactgccacccctcagctggggtccaaggcagtactattcagtttattcaccagacctgcctccagacatctacttctttcaaaaattagtgttttccatcaaggagcatgttccagagcatttcccagagatgtcccaaagaacactgtccggtgctgtggcgtacagtggcaacagcattagactaagtggaacatcccagcaggctgctttagaatccgctcatttgactagatacgatgtaattggctgtctttaa

SEQ ID NO: 26026 - DNA, 1065 bp, Homo sapiens
aaagtgcttttagatcttacgtatattaattcattgagtctttatacaacctcataagaaagcttctgtctgtttcacagtcaggaaacaggcacagagaggttaaacaacttgcccaagatctcagctagtaaatggcagagcctggatttgaacccaggcagagctctatccacccttctgctttccagtactttttgctagacaaatgtgcattgtgtacctactgtgtgacaggattgtgctggcctcagagcagggatgcaaaggtaaataagtccttgattggcagcacaccaaatgcttacactggtccgggcgcggtgattcatgcctgtgatcctagcagtttgggaggccgaggtgggcggatcccttgaggccaggagttcgaaattaacctggacaacatggtgaaaccccatctctactaaaaatacaaaaattagccaggcatgatggcaggcggctgtaatcccagctacttgggaggctgaggaaggagaattgcttgaacctgggaggcagaggttgcggtgagccgagatttagccactgcactccagcctgggcaacagagcaagactccgtctcaaaaaaaaaaaaaaaaaaaccacttacactggacccataagaagattggggcagctgggtgcagtggctcacgcctgtaatcccagcactttgggaggccaaggtgggtggatcacctgaggtcaggagtttgagaccagcctggccaacatggtaaaaccccatctctactaaaaatatgaaaattagctggatgtggtggcacttgcctgtaatcccagctactcgggaggctgaggcaggagaatcgcttgaacctgggagcggaagttgcagtgagccgagattgcaccactgcactccagcctgggcgacagagtgagacttcgtctcaaaaaaaagaagactggggctttcctaaccgtatattttcctgcagcatctctatggacagggccttcagcagcaccccccctcttctttcttactgtggttcatccttccagatgtctctgcccacccacgcaaccc

SEQ ID NO: 26027 - DNA, 1050 bp, Homo sapiens
catagcattcctcccctggcccctccaaatctcatgtcctctcatttcaaaaccaatcgtgccttctcaacactcacccaaagtcttagctcatttcagcattaacccaaaagtccaccgaccaaagtctcatctgagacaagccaagtcccttctgcctatgggcctataaaatcaaaagcaagttagatacaataggggtacaggcattgggatagccattccaaatgggagaaattggccaaaacaaaggggctacaggcaccatgcaagtccgaaatccagtggagcagtcaatttttttttttttttgagacagagtctctctccgttgcacaggctggagtgcaatggcgtgcgatctcagctcactgcaacctccgcctcctgggttcaagtgattctcctgcctcagtctcccaagtagctgggattacaggtgtgtgccaccacatccggctaatttttttttgtatttttagtagagatggggtttcaccatgttggccaggctggtcttgaactcctgacctcaagtgatccacctcggcctcccaaagtgctaggattacaggtgtgagctactacacctggcccaaatcttaaagttccaaaatgatctcctttgactccatgtctctcatccaggtcatgctgatacaagaggtaagtttccatggtcttgggcagctctgcccctgtggctttgcaggttacgccctccctcctagccactttcatgggctggtgttgagtgtctacagcttttccaggcacacggtacaagctgtcagtggatctaccattctggggtctggaggacggtggccctcttctcacagctccactaggtagtgccccagtagggactctgtgtggctgctctgaccccacatttcccttctgcactgccctaacagaggttctccatgaggtccccgcccctgcagcaaacttttgcctgggcatccaggtgtttccatacatcttctgaaatctaggcagaggttcccaaacctcagttcttgactaggctgccaaggcttgggg

SEQ ID NO: 26028 - DNA, 1044 bp, Homo sapiens
cgtgctgggtgtcacagagaggaaggagactcatctcctgccctctggtgtttagctgccctcccccgggcttatggctgctaatccttttccacggaaggatacagctgctgaaactgtggaagaggaatccatttctgctgcatgaaggggcacagacttgaatacagtcaggacaggttgtggtttcacttgtgtaatcctgagagcttgacagcttcgaggagtgtctaacattgctagtaacagagcctagaagcacctgaattccagctgtcacttggagaaggagagattcatacgaactgcgagagcatataaccagcatgtcttgagtcttttacccatgtgcctgttatatggatgctgctgtttttgtaagatgaaatgacccttggatattctgggttatgatcagcatttcttcgtctaggcgagaaaagaaacaggtgagataggaaggcatgaaggggctcatggaagagagagggctgacaggcagaaattttgagagctcacatttacgactatttggacagttcttataattttggcataaattgtaaattgttgcatgttatcaaaatagattggtgatgaacgttaaggatatatccgtggcagaataagaacacactctttgttctttggtttgctcctctagttcttccctgcttgccttgtgggactatttgcagcaatgaggggaatttatctagcaggttggcctcgggaggcaatgaatgaaaagaggttggtgagtcctctgtgggagtccattccaggtcctggagggctgaggtgggtgtcttggagccagcagtttctgggagaagggataaagctcaccttccacaccctcctggctcctgaggagcgatttaatccgcactgcctgtggacacgatggaggactgagatcactcccgaagggcatgctccgtggttttagtctgctgggaagctctggcagaagtaaaacaactgggaatatacacatgttaatgatgctccaagctgcctaactgctgaggaaggaaaagc

SEQ ID NO: 26029 - DNA, 1039 bp, Homo sapiens
gggtttcaccatgttggccaggctagtctcgaactcctaatctcaggtgatccgcctgcctcagcctcccaaagtgctgggtttacaggcgtgagctactgtgccggccagagctatgagttctttcagaatcctcagatgccattagctagccactgtttggacatccttctcaccttgccctttggggtgatatccatacctacttgcttgcttctaacagtttttttatttgttttgtagagacgggttttggtttattgctcaggctggtttcaaactcctaggctcaagcggtcctcccactgtggcctcccaaagtgctgggtggtgtgagccaccgtgcctggccagttaattttttttagtgtctcttttttgggttctcaccagaaacactatcagcattcccacagatattcctgtgagtctttgaaacattttctatcctgcattgagtaagaataaaaccgaggaaggggtgaagcaccttgtctcatccccagtctggaacttgaaccttcttttctcttcactttgccctacccccaaataatatgtacaaatgtctgtatccattgagcactaactccctattccttccacctccccagcccctggcaaccactgttctacgttctgtctctacgaatttgacttctctaggtccctcatacaagtggaaaagtacagcatgtctttttgtgaccggcttatttcacttagcataatgtcctcaaggttcatccatgctgtagcatgtgtcagaattgccttcttgcttgaggctgctgatacctcctcatgtgtatataccgtattttgtttaatcactcatctgttggtggacacttgggttgcctccacctcttggctgttgcaaataacgctgtgaacatggatatacagatatctgaggccaggccaggcgttcacacctgtaatcccaatacgttgggaggccgaggcgggcagatcatctgaggtcaggattcgagaccaccctggccaacatggcaaaaccccatctctactaaaa

SEQ ID NO: 26030 - DNA, 1051 bp, Homo sapiens
agtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttatacaaaggctttgtaaaaccagaggctagcttctatctttgtctactgttatttcagctcagggcgggtaattaacatcattggaactagctattaggaaagaaaaaaaacttggttttttttacaacaattttttcccttggtttgcagtttctgcatttggatttgagaacccagggcggggattttcttggcacagtcaggtcttgggtccctcttcctgtgctttcttgtctgaggccttagggggaagagctcagcctctgcagcctcctccacctctgcccctggcctgcctctgctgtgacctccttccagagctagctgctggccctgtggccaggagaagcagaggggagaagcctttatgcagaagctgtgctagccttggtctggggtggggaggctgctgctgtgaccttaggggtagggttggggatcaagggaggctttgtcaagggagagtgaccatgttgctccctacatccatgcaataggacccagcctgcacctcctaggcctacactggggaaagcctgacagaaatcagtacctcctaacggggtctgccaggttcaccaaggcatgggcacagaggaatatgacagttttgaggcagg

SEQ ID NO: 26031 - DNA, 1043 bp, Homo sapiens
atgaggggctggcctacaccagggaaaatgctaggtctctcctgctccgtgagttcacctgctagctcactcaagcacaagcgggtgtggactatctttagaatgctgcctggtcttgattcttaattcacccagaaggagagtataaaaaactaggagccaagttcaggaggagaaaggaagagatactcagtattctacaagataacccttccttctcatccccacctgcaactgggtttgatcaaaaatatttggaacaatatttgacaccatcttcttctaagaaagcaagtcctggcacttttttttttaatttttgggaatgaaactttgcaagtaagtggtgcatgtaaagatgaagactgaagggaaggaggcctgggttctgggactggacagagtagatgccagtagacgggttgggttgggtggcagtggatggagggtggtggctggatgggagaaggggttagaagggtggggcatggatggatggatgggttggtgggtggatggatggattcactgagcactagatattggagttaatctttttcttccttgcccacaaaccacagggagagcaggagggtgatgaggaagaggaggggcacattgtggatgctgaagctgaggagggggacgccgatgcctctgatgccaaacgcaaggagaagcaggaggaggaggtgagagaccctgtgtggggtgaaggagctgtggtcccagcccccttccctgttaacctggagggattatctcccggcacccaggccacacctctgtgtcatgaacccacaaggaaccctgaagcagcacctgcctgcccagcatacctctctcttgagaagatggggttcatagggtgggaatttggcacaggtccactccagggctgccttttagatgtggccatccctggacttaaatcggactcaaggatccagacaggcttctggcaagaaaaagtcaggctgcctctggtttttacaatgaaaatatacctctctctcctcccacaaaccagtctcctgctgtca

SEQ ID NO: 26032 - DNA, 1032 bp, Homo sapiens
aggcacagttacgaggttgaagctcgccacttcaggaagaccttgtaactagaagctcccatgtccggtcacaggtctttgtcaaggatacttgacctcaagtcagcgtgggtgggtgtggggagtaggggatataaaacacatggagagagagtgtgagtgtgtgtgtatgtctctgtggtatagtccctgaagggaagaaaaaaaactgctggtctgtatatgcttgcctctgttatattaaaaaataataataatatatatagagagaaaatactagtttcacatatgccctacttttttccatgaaggattctaggcgggtcacagtagagggacttgcacaacgagggtcacacatggagtagagggtgggtgactcccacaggaggcatcacccgcagcccggcattggtggccttgccctctgcaggtgatcatcagggaaggggagctgctctgcggagtgctggacaaggcgcactatgggagctccgcctacggcctggtccactgctgctatgagatctatggaggcgagaccagcggcaaggttctaacctgcctggcccgcctcttcaccgcctacctgcagctctacagaggcttcaccttgggtaagtgccgggctcgctgccctggggcagtgacccgtcagcgcagccgcctggccatctcccaggcccaggacagagagagccgtccacactgaagatttccaaggcttctgtgtgttcccagtggagaagtctttccaggtccccagtgcaccacgctttattacagggtcttaacagatagtccattcacccccaaaactgccaggtttcttttcctttgtagaccatatgcttcatgtgtgctacattacacagctagaaattcttttctgtgtcctctcgggaaggagctgggaagtaaccaggctcctcctacaaaggcgccctcacttggccacccctctcctccacagccagtgcttattcccgttcacagtgcagaatggcaccctcgtgcccatttccattctgt

SEQ ID NO: 26033 - DNA, 1035 bp, Homo sapiens
ctattaaattttctaattgtttatgattggtgtctagaaatacaattaattttgtatattgtccttatattcgacaagctttatgaattcagttattagatctctgtccttcaagttcttttaaactataaaagtaaacaagtttattgataaagataaaaggaaaaactccctccctccccaaccccactctccatatacacacatactctcatagaaaataaataagaatgaggccaggcatggtggattatgcctattatcccagcactttgggaggccaaggtgggtggatcacatgaggctagaagtttgacaccagcctggccaatatggcaaaaccccgtctctactaaaaatataaaaattagccaggggtggtagtgtacatttgtaatcccagctactcagaaggctgaggcacgaaaatcacttgaacgtgggaggcagaggttgcattgagctgagattgcaccactgcactccagcctgggcgacagaacgagactctgtttcaaaaaaaataaaagaaataataaaatcatatcataccttccctgggactgttcaggagaaccatgaaccacaattaaatctgacattcaaccacctgataaatctgatatttacaaccacctgtttgaccatgacatcctggtacctgaagcatgcattttcctgatggccaggcacatggacctcagatttggctggtctttaagatggcttactctgaacgagccaccaagtcctccaaagggaactccattatatcagacagtctgctttttcattgggaccacactaacacactctaaatatggcaagaagttcatttaaatgttttcataggctatgctgacaaatgtttttgtaattgtcttgtgactgatttcattcactggatgtactgggggctcattctgtgtctgtacatgtagatctgcctcgttctttttaacccctcctgtgttgtattcagtgatatgggtataccacagatgacttaactgtccctctattagtggatgttcc

SEQ ID NO: 26034 - DNA, 1021 bp, Homo sapiens
ctgaaagacacactacttacttgtcttaggtaatcatcttaaatgcctggtccctacctcctgaatggcagtcccaagcctcgttttctcatgtaacctgggtattgctggtagatggcatcccagagtgatcttgcttagtgtgagaaaccaagcccaatctattcctcacacaccagtatgatatttgtaaaaagaagtcagtatatatttacctataaaaatacttatttatccataattcaacttatatgaacttttctggtaaaaaacaggtagataaagatatttattataatgttacttataatagcaaaatatggaaatcaatccagatgtccaattatgagaatatggttaagtgaattaggaatcatccttaatggaatatcacatagccatgaaaaatggtgatcaggcaaaagctacatagcaacatgcagacatgctgatgagatgatactaaaagggcaaagtagtgtgcaaaataaatccacactgaagattacagttgtgtaaaatacgtgtatagacaaaaaggcctggaaaacaatatataaaagtgataggagttgttaatgtgatgggattatgggtaatgttttcttttactttgcttttttttttttttaggttttatacaatagccatatggtttttattactatagaaatgagattaagggccagagggaatccaggcctgataatatgctacccttgagattgatttttgtggtcaagttgcaggcttggggataaagaattgataaatcccattgcagaaagagtacctgtttctgatttattgcactttgattctcctccttggctccaggaattgaggaagctcagataggaaaacgaggatacttaacacccaccagtgcccgcgaacacctttctgccctgtggaagaatgaaggtgctgtatcaggctaaagaaatagccttgatcttctctaggcttttatttcctggactcattaaccctgccttattacttcttttaagttgtagtg

SEQ ID NO: 26035 - DNA, 1023 bp, Homo sapiens
tgggttttttctctcttcaatcacaactgtcctcctgcacaggaccgggcgatccgttgtccgaaaggaacacaacagcaagttgactatcacgtttccagccatggtgcacaggacagctggccagaaggactctgagcccctgggtgagcaggctgggtctggagaggagctccatgtgaggccagcagatgtgtcctaaaccctgggaatacctggttctcctcaccacgtgtttctctgctgcatttgggaggggccagcagaggcacagtgtgcaggcctctcaggcctgaggggaccctggcaagcgcccagctcaggcctctcacatgggagagctgatgggaggggctgttttatgaggcagtgccccacaggcgcctcttgccttaggtggtcgtttttctgaaaggtttttcaggaagaaattaagaaatttacctgacaaatattttgaaacattttactgtaaaacaagtgtggatctattttggaataaaatgtaggcgaataatttttaagaaaaactgcaagaattcagcaaaacatgagcgcctcctgcaggctactcctggctgtccacccagatccccccaggtagaattctttcctcagctctgccctacccaagctctgcttgggaaaaattttgagataacttaatactcccactttttaatttttatagtcataggcttatttaaaaatgttttttggtttttattctgaagtggtcagaagattaaatagagtattccaagagaagcactgagagcggtacctgctgtgtaatatgtgctatgtaaatgttaactgttcatttcttattatgtcatcagtgttccagggtagaaaatgcataacctggctgggcacggtagctcacacctgtaatcccagtactttgggaggctgaggcaggcagatcacttgaggtctggagttcaagaccggcctggccaacgtggtgaaaccccatctctgctaaaaacacaaaaattagccaggcgtggtggcggg

SEQ ID NO: 26036 - DNA, 1009 bp, Homo sapiens
ttaggtcattgatcaattttgagttgacttttgtagaggggagcagtggagatctagtttcattcttctgcatatggatatctagttttcccagcatcatttattaaaggcactgtccttttccccagtgtatgttcttggcaccttttgcaaaaatcagttggctgtagatatgcagattaatttttgggttccctgttttcattggcctttgtttctgttttcatgccagtatcctactgttttggttactacagctttgtagtatattttgaattctggtagtgtgatgcctccagctttgttctttttactcaagattgctttggccattcagggtcttttatggttctatacaaatgttacaatttttttttttctgtttctgcaaagaatgtcattggtattttgatagggattgtactgaatctgtaaattgctttgggtagtgtagtaattttaacaatattaattattctgatctataagtatgggatgtttttccatttgtatcctctccagtttctttcgtcactgttttgcagttttccaagagtctttcacatccttggttaaatttattcctaggtatttttttggtagctattataaacgggattgccttcttgatttctttttcagctaattcattgtttgtgtataaaagtgctactgattttttttatcctgcaactttactgagtttgtttatgagttctaagaggtttttggtagagtctaggtttttctatatatgagattatgtcggctgggtgcagtggctcacacctgtaatcccagcactttgggaggccgaggcaggtggatcacaaggtcaggagatcgagaccatcctagctaacacgaagaaaccccatctctactaaaaatacaaaaaaattagctgggggtggtggcaggcgcctgtagtcccagctactccggaggctgaggcaggagaatggcgtgaacccaggaggcagagcttgcagtgagccaagatcgcgcc

SEQ ID NO: 26037 - DNA, 1055 bp, Homo sapiens
gctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaactgagtatcttatcccttttcaaaaagtacagttctggccaggtgcagtagctcacgcctgtaatcccagcactttgggaggctgaggcgggtggatcacctgaggttgggagttcgagaccagcctgaccaacatggagaaacccatctctactaaaaatacaaaattaagctgggcgtggtggcgaatgcctgtaatcccagctactcgggaggctgaggcaggagaatcgcttgaacctgggaggtggaggttgcagtgagtcaggatcgcac

SEQ ID NO: 26038 - DNA, 1027 bp, Homo sapiens
caagccatcctcccacctcagcctcctgagtagctaggactgcaggcatgcaccaccacacccagctaacttttgtatttttttttctgtagagacaggctatattacccaggctggtctcaaactcctgggctcaagcaatccacccgcctttgcctcccaaagtgatgggattacaggagtgagccaccatgcctggccactagttcaccaattaaaatgttaatctcatccaaaaacacagtccaagttgacacataaaatgaaccatcacagatagtatctaccttattctttgcccaggctggaatgcagtggtgcaatctcggctcactgcaacctccgcctcctgggttctagcaattctcctgcctcagtctctcgagtaactgggactgcaggcacgtgccactgtgcccagctaatattttgtatttttagtagagacagggtttcaccatattagccgggatggtctcgatctcctgacgtcgtgatctgcccgccttgggctcccaaagtgctgggattacaggcttaagtcactgcacccgacacagtatctgccttattctttatgtttgggcttatcatccttgcattccttagatgtgggtattcagtaaatgtgctttagaactctggtccctctgtttttgttttcttcttttattcctcagacctaacaccatctttcttctcttagtcccaatactgcatcaccaggcccagcctttttgaagtggtcattgagtttggaggacatgggctttccgcctagcctagccttctctcaaactacaaacctggaagtggtcatttacatatggagtagtctttcctgcttataacttgaaagaagaagaagaaacattattattcttgaggatcaaccgctccagcttacttaagaccaagtttgataacccagctagtttaggattgaacttgtgtgtggacatgagctatcatcttctagaattccttctttctgttaggattatgaaacattatgttactcagtgat

SEQ ID NO: 26039 - DNA, 1059 bp, Homo sapiens
tgggtcccagcctttccattcataaaacaaagaggttgagggctagctaggtagcaaacttctcagtataagaaacagatggaatccagagaagctgggagaggagaaggaaacaaaggagaggtgatggcccaacaacttagcagaaagacattttaaaaggatctctagccttagtaacatagcaagaccttgtctctacacaccaaaaaaaaaaaaaagaaaagaaaagaaaaaccagccaggcatggtggtacatgcctgtagtcccagctactcagggtgtagggagcctgaggcgggaggatcacttgagcccaggtggttgaggctgcagtgagctgtgattgtgccactgcactccagcctgggtgacggagcaagactctgtctcagaataaaagaaaataaaataatttctgatattcttttaatccatttgcttttctgtgatataaacttgctctgtgtcccagaattttaagcaaaattggctgttcacactaaaaaagaaaaaaaaagcagaagaagaaggatggtagctaaatgctctctggggttcccgtctgaactgatgtctgtcactctgagtagtcattggcagtgtgctgctaggtgccagaggaacacaggatctgtgccttgattcccagacctaaaggcaaaacttagatccatttaccataataaaaataagtatgtttgttgacacataatttacaagtatgctttatgtcagatgttgcattgaaagtctgcatacattatttctcttaaccctgactgtagccccatggggtaggtactattatttccattttacagataagcaatcagaggtttagaaagggtaaggaatttgcccagctcttttttctttttttggagacagggtctcactttgtcatccaggctggagtgcagtggcatgatcagcactcactgcagcctcaaactcctgttgttcagttcttaaacattacatattagagccgtgaagcaaattcaaatctgtctgattttacagctcttgtgttgtctttgcctaagtgttgctgc

SEQ ID NO: 26040 - DNA, 1063 bp, Homo sapiens
gtagggttttcagaaatatattttgtcactctcaagtgatagtttgctaagagttttcataatgaatgatattatattttatctaacactttcattgagacaatgtgatttctttttggtctttagtctaagtggtaaattgcattaattaattttaccattaaaccaaacttgccttcctggataaacccaatttggtcatgaagttgttttttcttttttctagttaaaatgatcctggaggcgatttgctaatatttaggattttttttaagctatgtttgtgagtggtattggctatgttatttttgtatggttttggtatcaagattgtgctagcctcataaactaagctgggggtgtctcatctttttctgtactctgagatagtgtgtgtaatattggatgtctttcttaaatggttagtagaatttgccagtaaactgctcagagccaggggctttttcaacaggaagattttaaactactgattcaatgtatttaatagttataggtttatttgatcttttcagatcaatattattttaggacttaattcatttctgtaatttttcaaatttatttagttaacaatattgcttctgcaccctattccttctcccctcttcttctagcactctcattagacatgtgttagatgttcctactctgtctttcaagtctcttcattttggccgggtgcggtgtctcacacctgtaatcccagcacttctttgggaggccaaggtgggcagatcacctgaggtcaggagttcaagaccagcctggtcaacatggcaaaaccccatctctacaaaatagaaaaattagccagacttggtggcgggcacctgtaatcccagctactcaggaggctgaggcaggagaatcgcttgaacccaggaggcggaggttgccgtgagccgagatcgtgccattgcactccagcctgggcaacaagagtgaaactttctcaaaaagtctcttcatttcttatttctgatttatttttctgtcactgctgcattatgaataattgtgtgcacatctgtctcctcagcca

SEQ ID NO: 26041 - DNA, 1074 bp, Homo sapiens
gctgcctcctccctttcccctcccccttccgactcccgggcgacccccattaggttaaagtacacagagaataagcgagtgatccctccgccataggcctattctttccatttgttgcctcacagtatgcaaaaaaaaagtcccgcgaaatcggttatcaactttggggcccggaggaaaattgctgtggcgcatagataagactgaatggcgagaccctgagctataagtgcctactggattgttcttcaaccgcgtaggctgtcgaccgaagatgagccttccacttggcggaagaatctcacaggaaagggtgagggcggtgcagggttagcgggggagggcagggaagagaacgtgcggtttcaggcgtactcagctagagggaggagcgatagtgctctggaggctcgtgcgcaggcgcctcgccgagcttaggctgctgggcgaaatggctgcgggaggcgcaggcgcacgtggtactgatcgtggaacgtctaaagtccgccattttgaaggataaatgaagaaaggcgtggagttactggataatgacgttcattaaatttagagcaaaagagacctttaaatacaatgtataatgagatttttttttctccaaagtgggattgagaaggtattcagatacttacaaagaaatttaaagtagttgaaggccataatgaatgatggaagagatgaaagagaaggtgactttgaaggacaaaggagtttagaggtgattgtgtgctctggacctgaagtattttgattgaatgaaaaagaaatggaatgaagaaattgaagatatgttcataaaggctagtgtttgacattacatcacatttaatccttaagaagaactcatgcctcccattttacaagcgtggaaacgtataatcagagaatgtttggaaacatataagggattatagatgcaaatcaactctggatgttgattttcaatatacatattctgaatgtgattttaagtttttaaagttagtaacaagaattaaattggatttataatctgtagaccatttaaaggaagggggctgctaaatgagaaga

SEQ ID NO: 26042 - DNA, 1074 bp, Homo sapiens; identical to SEQ ID NO: 26041

SEQ ID NO: 26043 - DNA, 1074 bp, Homo sapiens; identical to SEQ ID NO: 26041

SEQ ID NO: 26044 - DNA, 1049 bp, Homo sapiens
gggttcagcataaattctgttctgttttatgatttatcagactcaagtgctgagaaaccttgttgatgtaataaaatggtaatggaaggagtttagttatagcagtgtcactcagttttttgagcttctgagtcatgtactaaaaagcacatagtaatttagcataaaattgacttttaatgattaattgactcataactcaggttttccttcagtgtttttgaaacgtgaagaattggaaaacagttcacttgcataataatttggtaatcattagagtaatttactactttctcaacacctccaccagcatttccagtccaccctatgtttagtgcttcagaaatttttgcctgtcaggaaactaccatggtaataagagacataggttaggggaatgtttttcttttgtaaaatggaaaagcattatttttaaagggaaaaagggaaagatgagttctcatgacacagacagagtagtttttgaaatgactacctgtgaaagatgaaaattttctgatgctcttaaagctaactgtgcacttggacctcttcaaatctttgtgtacctagacagtaccgtactctttccgaggttttatataaagtgctgcttacagcctgccctcggctacgaatctttgaataacttaaaactcctgtgcactgtgaataaaaagaggtgaaattaaaaaaaagtaaaatttgaccctaaagctctgtctttgaaaatggctttttaaattttgtgtctgtaataaatgtggagttaatacaaaattcttaaattagattgagttaggagtttcggcttttctcctcattccttttctaaaaattttcccaggtcaatgagtggtcattgaagataagaaaggaaatgagagttgttgacaggcaaataaggggtaagttatcattttatgtcttctatttttcaccctcttggtatattttgcttcagttcataaaaataaactgcatttatatatcataagacatagtttattcctatatcagttatttatagctgtctgactgattttgct

SEQ ID NO: 26045 - DNA, 1029 bp, Homo sapiens
agaagcaccgttttggactcatggatttttatatatttagtgtgttatagttctaaccattattctgtttgatactgaaaaacttatacatttggtcagtgggagctatttcaagccagttcctatctgcttttagcataactttactaatctttgaatacttccttgttttctagcatatatcctggtatgatttgtgaattcctagcctgagacctgaaatcggccatttctccaagatgcagtggtttcttttagcgggaatgctatttagataccaaaatttgagtgagcctgatgcttcttgctattcgagtatccctgcttctaagcctttttatggaacagaactgggaaacatgttctttaaaaaatcatgaaggtgtttatagactaagttgctttgaaccaaccctttgccaaaaataactaaaagagctaaacaaaaagtgtaactatttgaaatcactgaaagctaccagggcagtgagaaattgcaaaatcaagatctcagcaaagagggaagctcagttacatgaacccaatcatttgggactaccttccccctaaagagatcctctaattcctaatgcagtgggtgacaaatagaatttgagtagagtttttgacaaaccctgtggttggggagtataaaaattggagttcatggccgggcatggtggctcacacctgtaatcccagcactttgggaggccgaggtgggcagatcccctgaggtcagttgtttgagaccagcctggccaacatggtgaaaccccgtgcctactaagaatacaaaaagtagctgggcgtggtggcaggcatctatagtcccagctacttgggaggctgaggcaggagaattgcttgaacctgggaggcagaggttgcagtgagccgagatgggtgacagagagagactccatctcaaaaaaaaaaaaaaaattggagttcataagcagatattcagggcttgtggttgggactctgaaagaataccccttagcaataatagtgacctggaagtag

SEQ ID NO: 26046 - DNA, 1029 bp, Homo sapiens; identical to SEQ ID NO: 26045

SEQ ID NO: 26047 - DNA, 1029 bp, Homo sapiens; identical to SEQ ID NO: 26045

SEQ ID NO: 26048 - DNA, 1029 bp, Homo sapiens; identical to SEQ ID NO: 26045

SEQ ID NO: 26049 - DNA, 1029 bp, Homo sapiens; identical to SEQ ID NO: 26045

SEQ ID NO: 26050 - DNA, 1033 bp, Homo sapiens
gctaccttgggcctattttataagggcattaattccattcctaagggacctaataacctctcaaaaggcaccgcctcctgatactgtcactttgaggattaggatttcaacatacgaatttggggacatgcaccaacattcataccacagcagatcgtacagtgaaaacctgtataatcaaatgttgatagcactttgctattatttgatatatatttttcagctcggtcagtttgaaatagattataaatataacacattttgcaacatttcatattgcatctctggaatatatggaaattctgtataacaaaaataccttcatatcattgaatatctagtccatatttaaattttcccaggtgttcccagtatgtcttttataactttttaaaacttaggattcagcgaggtttgtgtttggctgttacttgattttatttaaaaatctgtttggggtcgggcgcggtggctcacgcctataattccagcactttgggaggccgaggcgggtggaacatgaggtcgggagattgagatcatcctggccaacatggcgaaaccccatctctactaaaaatacaaaaattagctgggcgtggtggcgtgcacctataatcccagctactcgggaggctgaggcaggagaattgctttaaccagggagtcggaggttgcagtgagcctagattgtgccactgcactccaggctggcgacagagcaagactccatctcaataaataaataaataaatatcccctgctttctacttatagcattgtaagaataaagactcgtttgtaaaatagagcatttgttttgtagaatgttccttgttatggttttgtctatgtcttgtggttatcgctttttttttttttcctccaacttttaagttcaagggtgtatgtgcaggatgtgccggtttgttacataggtaaacatgtgccatggtggtttgccgcgcacatcatcccatcacctaggtattaagcccagtatccattagctgttcttcctgatgctgttcct

SEQ ID NO: 26051 - DNA, 1075 bp, Homo sapiens
gggtgaggtgctaaagaaatttgtcagggaagataaattgtttgcattacagcctagctgtttatttacagtttcctctcttgtagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttgg

SEQ ID NO: 26052 - DNA, 1022 bp, Homo sapiens
tctattagtaatgttatattttttaggaaagagaggaagtgatgaaaaataaattttttccattactaaaatattgaagaactagaagctatctcagtgatcaacagtagcagaaccagacaatcccctatacccaagttgctgaaagcttctggggcaaaccacaccactgagtagggtagtatttccacagattgatgattttcattttctattgggggtttcccccatctcagaggataaaatggcctcttctacctattcaatccctctatctctatgcataatccccaccccctgctcccaactccaggatctcattccatcaattattgtctcccttccatacttgttcagtcttttattctccacatcctataaacatgttcatatctctattgcttaaaaaataaacaaacaaaaaagttgatcttgcaggctgggcagcatagcgagaccccatctctacaaaaagtaaaaaatcagctggcatggtgtggtgtgcctatagtcctggctacttgggagcctgaggtgggagatgggaggatcacctgagcccaggaggtcaaggctgcagtgagctgtgattgtgccactactgcacttcagcctgggcaacacagaccctgggtcaaaaaaaaagaaaaaaagaagaagatgttgatctcggccgtgacaccatcatttttcttcttatctgcagctcagtttctgaaaaaggaaatctaatgacttgcttccatctcctcaactccctgcaatctggctcccactctgtgggtacttcctttttaaaattttctcccctggacttctaagacccacttctttcctgttacctccttcgttggcttcccttttcactgcctaccttcttgccctcagtgattttctaactaacctcatcaaccttccaggattttctaccatgtgctgatgaaatctctatctctaataggactgctttcccaaattctggagctacatatccagccgttatgtagctccacctggacatg

SEQ ID NO: 26053 - DNA, 1112 bp, Homo sapiens
tttttttttttttttgagacagagtctggttctgccacctggactggagtgcagtagcgtaattttgactcactgcaacctccacctcccagcctcaagcaatcctcctgcctcagcctcctgagtagtggggactacaggtgtgcaccaccatacccgctaattttttattttttgtagagacagagtttcactatgctgcccaggctggtcttgaacttctggactcaagcaatccagccacctcagcccccaacgtgctaggattacaggtgtgagccaccaggccaggcctataacctttttttttgaaacagaatctctgtctgttgcccagggtggagtgcaatggcgtgatctcggctcactgcagccttcacctcccgggttcaagcaattctcctgcctcagcctccgagtagctgggactacaggtgtgtgccaccacgcctggataatttttatattttttcatgcagacagatttcaccatgttggccaggctggtctcgaactattgacctcaagtgatccacccgcctcagcctcccaaagtgctgagattacaggtatgaaccactataatataaccttttcataaatgtgtccaccataaagctgttatatcatgagaattgttttgcaattttagacctttggagattaaatacgtctatgaaggggggagttagtcctgcagatgctgtacaactttaccaagtggtggtaaacagtgctacattttcttggaatccttgggaaaggtgcaggagcagaagatgtctttccttaattaaatggtgggtttctgcctgaccctataccaaagttagacttccaaaacacagcacagaaatcagctaaaacaatttgcaattaaagtcacctaaagcctatatctatctatctatctatctatctatctatctatctatatctatatctatctatctatctatctatctatatatttttgagacagagtctcactcttattgcccaggctggagtgcaatggcaccatctcagctcactgtaacctccacctctcaagtgattctcctgcgtcatcctcctgagtagttgggattatgggtgtacaccaccatgcc

SEQ ID NO: 26054 - DNA, 1034 bp, Homo sapiens
aaaaaaattagctgggtggccagtgcacatatgtagtcccagctactcgggaggctaaggttgaaagatcgcttgagtccaagaggtggaggttgcagggagccatgatcacaccactgtactccagcctgagtgacagagtaagaccctgtctcaaaaaaaaaaaaaaacttaataatgaaatccaaccatgatcctgtctattaaaagtagtaaagtaagaaagtatttcattgtgtgacttcccccaacccttggtgtatatcctttcaggcttttttccttctccttctattaatgaacagacaatatttaaattagcattattagcagtgactagtattcatattctacttgcaataatttcttttttaaaatgatcaggatgagttagatttttttttatagtttattcagaatatttctctgtttgtatccagccccttgactgttgtcctaaatttaaactctccccgtcatttccaaatatttccaagtaggcaatgtagtacttttgtttgtttgtttgttttgtttgtttgtttgtttgagacagaatctcactctgtcacccaggctggagtacagtggcacgatctcggctcactgcaacctttgcctcccgcgttcaagtgattctccagcctcagcctccccagtagctgggactacaggcgtgcgccactgtgtctggctagctaatttttgtatttttagtagagaccgggtttcaccatgttggccaggctggtctggaacccctggcctcgggtgatccgcccacctcggcctcccaaagtgctgggattacagagtgtgagccaccacacccggccagcaatatagtactttttagaaagatttgtagattagagtcccagtatacattgcggctccaacccatgcctgctttggaaaacatattttctctgtgctagtatagtcatgacacatcagcctatatatcctcatgttcagcaagtgcatgttaactgcttttgaaattattattacaataaagtctgttactcagg

SEQ ID NO: 26055 - DNA, 1035 bp, Homo sapiens
tctcaagcgtgccctgaagttcagggaaagacgccagcgccccctgctggttgcgctctcccatagcagggctcacattttgggagaaagaaatcagctgttagcagcttttgttcttcaccatgttaagcaaagcacaacattttataactgggtgaaaagccagatattctgtcagctgatttgattgttctgtacgcatatccctaagccattgtttgacggatatttgtactgagttgactttcttcataagatgataggactaatgaagagaaaaggcaatggagtttttaaaaccagcgtgatgaaccaaatgctgccactgactagctatgtacatgtaatccaaaggttccctccgttgaaacaaaataacagtgcttacctaaccaggtcagctgtgagctgggacttcacagacaggcatagagagacatggatgcaggaagggcttccttagctgagagggtcgtgaaactggaaggtagtagcaagcattttccagttggatcttttggccgacatttgtagtggggagacaaacatgtctaattttccccccaccctggcacatgggcaggtaggaagatgctggtgggtttggttcgacagtttggagaatgtcttgtggaaggggtgctttttttaatgcacactcaggcaccatgggagcctgttgtcaccctggatatctagctccatgcccttgcccttccactctgcctcgacaagaatcatggcacccaaaatacatgagttcaaatctaagtttcacaggctcagggatgaacccaagctaccaaatgcacaggcccctcctgtatacggttacagcaggtaagggagtaacttactcagtgcaagctgctgtaacaaaatagcacaagctgggtggctaatcaacaacaggcatttatttctcacaggtctggaggctggaagcccaagatcagggtgccagtgctggcatggtcgggttctggtgagggccctcttccaggtcacagacagctgtcttctcattgcatcctc

SEQ ID NO: 26056 - DNA, 1062 bp, Homo sapiens
ataaggacactttgtgatgacattgcgtatccacacagataacccacaatagtctccccgtcgcaaatctttgaagtaatctcatccacagagtctcttctgccaacatcccattcactagttctggaggttaggacgtggacatctttgggagttatcattccccctttcacaggctatctgggctgtatacagaaccagagatctgagaatcatcttggcggcctcactctgtgagcagagaaacgtgtctgtgctcagcagcaatccctggaggcagagactggaaattacacctgcaaccgtagtaagagcttgccagggggccggaatgggtgccatacctagagctgtacaggcatccacctcaattctctcagcggccctttgaggtcactctcttactgccaccaaggtgcagggtggtgaagttaactcagagcagagacctggccttgaagcctcgtctccctggggaacaaccaatcagcaggaatctgaacacaagcacgaggggcaatctgagcccttccccaaagcctcactcttcattcactctggctggaatcctgccctcccttcagggccaagcttagggaacaaggagcaaccagatcctacctccaaggacagagcccttacgtatttctgcaatctgtctgcagccggtggtctgaatgagcatcgtgtcatcacagcacttgtaaattttggaggggctcctccacactgagggaatatgcttgttcaggggagggcacactcccccatttctcccggaaccacacttctgccgtgggaccctgagaacacaagggccctccccttgccctgttgcttcatgtggcttagtcttgcttaacaaacatgctaggtgtggaagctgaggcctacatgtagtgttgagggcaagcagggaccgcctggaaatgctgaaagcattctcttaaagtggggccttcccatcatgattgctaggcccatgatgagaagatattgcaggaaagcacgacctggaccatagaaagggcagatcaatgtgtgggcctttatgtgcttatc

SEQ ID NO: 26057 - DNA, 1051 bp, Homo sapiens
ccgcctgtgcctccctccctgcgtgcctcgccccgggccgcctggggctgccgcggtgcgcgggtgccgggccctgccttgccggccatgggggaagggggcaccatggggcgccgccggcccttccccggggcgccgccgcggcgctggtggcggcggcagcagcagcagcagcggcagcggcagcggtggtggccgggccgcggcggcggcggcgagggtgcggggcgcgctgccatgggccttggccgggctgcaggcaagaagatgtccaagccccgcgcgctggaggcggcggcggcggcggcagcgacggccccgggcctggagatggtggagcggaggggcccggggaggccccgcaccgatggggagagcgtatttaccgggcagtcaaagatctattcctacatgagcccgaacaaatgctctggaatgcgtttcccccttcaagaagagaactcggttacacatcacgaagtcaaatgccaggggaaaccattagccggaatctacaggaaacgagaagagaaaagaaatactgggaacgcagtacagagcgccatgaagtccaagaaacagaagatcaaagacgccaggagaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacacaacagaatcacaaacttacggatttctaccctgtccgaaggagatccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcatttctcccggggtgcctttgtggtggaataccacggggacctcatcgagatcaccgacgccaagaaacgggaggctctgtatgcacaggacccttccacgggctgct

SEQ ID NO: 26058 - DNA, 1013 bp, Homo sapiens
gtaatcccgtttccaacgaaatcctcaaacttagacaaatatccacttgcagattccacaaaaagagtgtttcaaaactgctctatcaaaagaaagcttctacactgttagttgagggcgcacatcacaaagaagtttctgagaatgcttctgtctagttttcaggggaagatatttcctttttcaccataggcctgaaagcgctccaaatgtccacatccagatactacaaaaagagtgtttcaaacctgctctatgaaagggaatgttcaactctgtgacttgaatgcaaacatcacaaagaagttcctgggaatgctgctgtctgctttttataagtaatcccgtttccaacgaaatcctcaaagctagacaaatatccacttgcagattccacaaaaagagtgtttcaaaactgctctctgaaaagaaaggttcaactctgttagctgagtagatacatcatgaaaaagtttctgacattgcttctatctagcttttattggaagatatttcctttttcaccgtattcctgagaactctcaaaatgtccacttccagatactacaaaaacagtgtttcaaacctgctctatgaaagggactgttcaacactgtgacttcaatttaaacatcccaatgaagcttctgagaatgcttctgcctagagtttatatgaagacaatcccgtttccaacgaaatcctcaaatctatccaaatatcctcttgcagattttacaaaaagtgtgtttcaaaactgctctatcaaaagaaagcttcaacactgttagttgagggcgcacatcacaaataagattctgagaatgcttctgtctagttttcaggggaagatatttcctttttcaccataggcctgaaagcgctccaaatgtccacatccagatactacaaaaagaatgtttcaaacctgttctatgaaagggaatgttcaactctgtgacttgaatgcaaacatcacaaagaagttactgggaatgctgctgtctgctttt

SEQ ID NO: 26059 - DNA, 1034 bp, Homo sapiens
ctcctactcctgccgtatggaacatcacattgtcgcttggccttctggtatgattgggaggcttcctgaatcctcccagaagcagaagccactatgctccctttacagcctgcaggaccatgagccatttaaaccttttttaaaaataatattacagagaatttgtactgtagagtggagctatgaaatgccctcaaggtttttttccttatttttttactattagcatttgccttcttttatatgcaaatatctgaagccttcttgaatttttcccctgaaaatgaacttttctttttccacattgccaggctgccacaatgatagctgaaaatgtagatgcagattcagaagtgggtaacgaccagacgctgcacagtttggagggcttggaagaagacagaaagatgagggaaagtttagactattgtagagacgtgctaaatagttacaattaaaagagtgactatagagacttattaaatagttacaattaaaatggtgactgaaggttggacagtgaaggccaggcttagaaggtctcagatgaaaatgaacaacttactgggaacaggagccaaggttacttttgttttgccttagcgaagaatttggctggatggtgcccctcccttggagacctccgaaactttgaacttgagggtgatgacttagggtatatctggtgaaatgaacttctaggcagcaaagctcaagaggtgtcttgtctgtatcgtacagcctgtggtcttctgtgtgactgaataaatgacctcaagttgaaacttatatttaaatgagatgcagggcttaaaagtttggaaaatttgcagcctggccaagtggtcaaaaagaaaagctgattttcagtgggaaaattcaagaaggcttcagaaatttgcataaaatggagcccagtgctaatagctaagacaatgtttaaaaggtcttgaaggcatttcagagacctttgcagcagagcttgctgtcataggccatggggactaggaccgaagaatggtttcctgggttag

SEQ ID NO: 26060 - DNA, 1043 bp, Homo sapiens
ggtgatttaatcatggagaagagtgggggttggaggtaggggtgtgaggagaatgggggagattattttgtgggtgggggtgaaagatgagggtgggggggccgatcattcacaaatgtttaaacagtatctccttaatgctgttcacatgacagtgagttctcttgatgacttttgcagctgtgagattgagtgaatactgtcctgctgggttttggacttgcattgggcctgtgggcccatttgtgttatttttctgggaaatttcttccctttggactgagaaagcttacccaatgcccataccatcattttaccttgaaagaaaagaagtctgttttaaattcagggactcataggcagaagggactgtagccttgtctcaggtgagactttgaattttttacatttggaatgagttaacacttttggaaacttttgaaaagtcatgattgcattttgctctgtgataaggacataagattctgggatatcagagtcagaataatatggttttgctgtgtgtccctatgaatctcatgtggaattgtaatccctaatgttgaagcgggtgacttaattatggacaggaagttggtggtggtggaaggcaaaagggatgggtaggattgggaggagtgggttggcagtagggtggtgggagggtgggtggtagtaggaagggggagtagcctgctgcagagtgagaggctcatggaaagcctctactagggcagtgcacctgtggctttgcagtgtttagcccctcagctgttctcatgggctggttggtattaagggcctgtagcttttccacactgagggtacaagctgttggtgggtccgtgaatctggggtctggagattggtggccacctgtgtgggggctccaagcccatattttctttctgtacttccataatagaagttttccaagaggctcttcatctgctggaggcttctgcctggtaacagtgggagttggggtgtgggtcatatccttcactaatgtttaggcaccatcttcatgatgctgaccttgt

SEQ ID NO: 26061 - DNA, 1035 bp, Homo sapiens
catgaactaaatcatgccatgaatgcctaaactaccattgtaaattttggaagaatgatcataccactttactgctttttgaagtatgaatattttagtgtatatgctatagaccacaaaccctgtaaagagtctcaaataagttggctggataaagcctgctgtgcatgtctttatactcaaagactgatgatgcaattcgaatatgtgtccccaccaaatctcatatttaattatatttcctaatgtggaaggtggatcctggtataaggcgattgatttatgaaggcaaatttctcatgaatggttcggcaccatccccttgtaccatcctcacaatcatgagtgacttctcatgagatctgaccactgaaaactctacgtcacctccctactctgcgtgttttcctcttgccatgtgagacaactcactctttctttgccttgtacaaagattgaaagatttctgaggcctcccagaatcagaagccctgtgcttcctgtcaaccctgcagaaccatgagccaattaaacctctttttcaaaatgaatcaaacagaaaatggcaaatgacgattgcagcattgctataaagatacctgaaaatgtggaagcagctttgtaactaggtaatgggcagaggttggaagagtttggagggctcaaaagaagacagatgagaaaatttttggactatcttagagactggttaaatggttgtgataaaaatcctggcagaaacatggacagtgaaggccaggttgaggaggtctcagatagaaataagaagctttctggaaaatgtcttccttttgaatatggaaagcttacacaatgcctgtaccatcattatacgttagaagctgtgaacttgctttttatttcagaggctcgtaagaaaaagagactgtagccttgactcagatgagactttggactttgtaagtttgagttaatgctgaaatgagttaagactcactctggcaaggcatgattgtattttgcaatgtgagaaggacatgccgttcatggggt

SEQ ID NO: 26062 - DNA, 1040 bp, Homo sapiens
tcagtaaaggcctcatcagtggggacctggtgacctagtcattggaagcctggtccatggggacctggtcagtggtggtcttcttagtgaggcctgatgggttggaacataaacaatgaaaaactggttggtggggcctatacagtatactaggtgcctggtcagtgttgggccttagtggcttggagcctggtcagtgagggcctggtcagagggggctcggtcagctggggactgatccatggaaaattgttcagtgggggtcaggtgagcagcaacctggtaaattgcggtcttgtcagtgggaacctggtcagtggggaccaggtcagtgggaaattggtcaatgaggtctggcctatgaggcctattaagtgtgagcctggttaggaagacatagtcagtggggacttggtcagtgggaactggtaaatggaggagtggtcattagaggcctcatcagtgggaacctggtcctgggcggctgatcagtaggaacctggccagctggccactgtgtggcctcaggcagggggtttgtctgtggagtctccttgcctccatctgcagagaaggtgagtcagggcaccttggagggtggctggaaagagaaggtgagaagatgtgtcgaatccagcactgcttggccgacctacaactttacacatgacctgtgtttcacctagaggtggtgccagccctctctgctgtgcctggtgcccctcctctgtctgcatccccaggaccaccatgggtggggaaggcagagattggggaacacctatagaagctctaatgctggccatgagccctcagtgatgacctgggtgcacccgtgagtggagaagctaggcctggccagagaagcaggagaaacacacacataagtgcacacatatacaggcacacacacatgcacaaacacactgcatccacacatgtcagttcaggggatagaggacattgactctgggccctgttgacccatgcaggctcccattgtggtgggttgtgtcaccccacaatgtcactgttgctaa

SEQ ID NO: 26063 - DNA, 1016 bp, Homo sapiens
agataacttaagtgccatctaaggaggaacaaaaatgaattatcagaaaaataaaagtaagatgaagtgcaaaagttctgtggcaaagatgatgatagtaaataatatatttctgtgactcatggtaactttaactttgttcttaaaattctgagtaatttaagggttcacatttgaagaatccactgcattacagataacattttattgcaagtaaatgcatttcaaaatttgctattggttttgtattagattattctcagcctacttcattatcaagctgtattattttattcatgcagtttgatgatcttacggcagagaaggaagctttatcttcaaaatgtgtcaatttggctaaagacaatcaagttcttcaacaggagtttttatctatgaaaaaagtacaacaggaatgaaaaacttgaggaggataaaaagatgttgaaagaagaaatattaaatcttaagacacatatggaaaacaatatggtagaacttagtaaactacaagaatataaatcggagctagatgaaaaggcaatgcaggcagtagaaaaattagtagaaatccacttacaggttagttttttaaatcaggtaagtttatctgtaatgtgctttcatttatttcaccgcaaattttattttggatatgtatatattatgtttcctctgcctttcttgcagcaatttgctttgtagagttctagaaaaaaaaatgacatctgttttttcttttaaatatttacatttccattattattataacaaaatcaatctttcagagtaacgactcactgtggagtcgtttgatgattaagatcagttggcataagaaaaaattgtgatttagaaattatgtgacacttttgaattggtcataagctacgttcattaatcactttttaaaattatgaatggattctattactttttatatgaccagattacattaatactaacataattatgattttgaatttttataaatcagacaattctgaattcagtta

SEQ ID NO: 26064 - DNA, 1051 bp, Homo sapiens
gtcttgaattcctgacctcgtgatctgcccgcctcggcctcccaaagtgacatgagccaccatgcccggccacttattctttaatgattttgaaaacaatgaccatgccttggacatatagtgtccggtgcactcttcattatctagtttgaatttttatttctgaagatattttttgctgtctgtggtcattttttcttccttttgtagtatcgtctgctgcactcaaattgtttaaagaagacctgtttgtgtcatacgttaacatcaaatttatcttgatatgtagcttatattttgtttctgcttctttttcttttagatataaaacatatggaaatttactcattgtacatgagtacgtctgttgtatacatgaagtatacatgttattaaacttgttttacataaataaatttcatatatataaaaatatatgtataacttaaagaaaaagtaaaatgaacattcatgttttgatcacagattttttttaaaacaatggaatctgtctttgaagccctgaacacagctactttcctattttatttactgagcacttaatttggttttctgattcgaatcaacatttttctgtcattgcctttctctacatggttttgtatctctttcattttgttgacattatgtcagcaaagatgtctagatctcttcttcaaagtctttaaatcgtcacacatctctctgcccctttccttttttctaaaactgcctgtatcctttttctcctcaactcagatattaaagatgttttcttctctttttctacattgaatgatctccttgatgctttttgtgtgtacttttttttcttctgatagactgtggtcaatgggtatcaaaatgtacttttgtgtctttttaaacgtatgtgttttacttttttatcttggttactcatctctgggttatggcttatatttagtaataggttattttacttggcataccaacatggatatgagtagtttatttacaaaaagtgtatggttaggccaggtgtggtggctcacacctgtaatcccagcac

SEQ ID NO: 26065 - DNA, 1047 bp, Homo sapiens
gccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtat

SEQ ID NO: 26066 - DNA, 1366 bp, Homo sapiens
aagccaaggcaggcatgtgtgataacatataggaactgagggagaggacatttcaagatggaggggatgccatacaacaggactatgtgatggtttttggctgtgtccataggaagtcacaacaggcaagggaaagaaaccagaacccagtcatggagttaagaagtgagtcagagaggagatgggtagggacagtgaggtaaggcctctttctaaggaagtttggctgaaggatagactagctggacacatgctggctgtgtggggtagagggaggaatgatggagggtaggagagccttgagcctgcgagaagagtctcctagaatagagaagctgaggttaaagttgtggaagacagtggggataactgagtgacagataatcaggagaagaaaaggagatccagaatcatgacagagagatgacctttgccaagagcacagccatctttcactgtcacagagaggtaggacaaaacgattggtgttcaagaattggtttgtagcacaatattttaactatgtcctttaaaaagtttctccacagacactacccaaagcagtccttcactacagtggcagacagacctgaaaattttcatctgaagcagcagagtgaactgcagagtcaggtaatttctagaaggcttgctttgttccattgatactgaagattattcatgaggccagtcttctgagatttctgtcatttctctcatgccaggtcaccaaccagtgtggaggctaaaagcgggcctctttggggattccaggtggaagtgttggacatctgtagtattcctggtctcaaatcatcctgatattcttcattttgttattcacattggactagggcaaggaaatgagttctggtcagagtcaatgtttcccaacaatgttgatttatttggtcctaaatatttaaacacattttataaatagcttttccacaccacatatatagggaaaaacagggaattaacttggcccagcagcactgtttgtggggctaacaccctgtgtatctcacaccaaccctaagctttgtttccctcctgtcactttgctcctatttctttcatatgaaagaatgttcattttctttgaaaatgagctcatttcctcattttctttccatctttcagcaggaacaaagatcaccacaactggctccccttcaactatgttagatggcaacttgccttcagtatggtgaaacacatcagttaagactggggttgtgcatggcaggactttctacaaggacacccagtctccttaataaacatgagatgctctctttccagaagttctcttgcctgacacagcataggaagatgctgaacggccacacagtgacccatt

SEQ ID NO: 26067 - DNA, 1051 bp, Homo sapiens
gcttcaattcaacaagaagacctaactatcctaaatatatattcatccaacacaggagcacccagattcataagtaaagttcttagagacctacaaagtatgtttcacagtaatagtgggagactttcacactccaatgacagtattagatcattgaggcaaaaaaatgaacaaagatattcaggacctgaactcaacattggatcaaatggatctgatagacctttacagaactctgcactcaaaaacaacagaatatgcattcctcacatcatcatatgccacatactctaaaatcaaccacataattggacataaagcaatcctcagcaaatgcaaaacaactgaactcataccaaatacacactgagatcacagtgcagtaaaaatagaagactaagaaaattgctgaaaatcatgcaattacatggaaatcaatcaacatgctcctgaatgactttttaataaataatgaaattaaggcagaaaacaagaagttctttgaaaataatgagaacaaagttgcaacatactagagcctctggacatagctaaggcaatgttaggagggaaatttatagcactaaatcccacatcaaaaagttaggaagaactcaaattaataacctaacatcacaacggaaagaactagagaagcaagacaaaaccccaaagctagaggaagacaagaaataactgaaaatccgagctgaattcaaagaaaccgagacatgaagaaaaaaaaattcaaaagatctacgaattcagggtaggtttcttgaaaatattaataagaaagtctgctagcagactaatacagaggatgattgaaataaacacaattagaaatgacaaagggaatgtaattaccactgaccccacagaaatagaaacaaccatcagaaactactgcaaacacttctgtgcatacaaactagaaaacttcaaagagatggataaattcctggacaaatacaccctcccacaactgagccaggaagaaattgatttgctgaacagaccaataacaagctccgaaattgaatcagta

SEQ ID NO: 26068 - DNA, 1060 bp, Homo sapiens
agctgggactacaggttcgagccaccacgcccagctagtttttgtatttttagtagagacgggatttcaccatgttggccaggatggtcttgatctcttgacctcaagatccacccatatcagcctcccaaagtgctgagattatagatgtgagccaccgcacttggccaggattccctatttaaatggtgctgggaaaactgactagccatatgcagaaaactgaaactggacctcatccttacaccttatgcaaaaattaactcaagatggattaaaaacttaaatgtaaaaccccaaaccgtaaaaaaccctagaagaaaatctaggaagttccattcaggacataggcataggcaaagattttatgatgaaatcatcaatagcaattgcaacaaaagcaaaaattgacaaatgggatctaattaaacgtaagcacttctgcacagggaaagaaactatcatcagagtgaacaagcaacctatagaatgggagaatatttttgccatctaccaatctgacaaaggtctaatatccagaatctacaaggaacttaaacaaatttacaagaaaataataaccccatcaaaatgtgggcaaaggccatgaacagacattctgaaaagaagacatttatgcgtccaacaaacatatgaaaaaaaaaaagctcaacatcagtgtttattagagaaatgcaaatcaaaaccacaatgagataccatctcatgccagtcagaatggcaattattaaaaagtcaagaaacaacagatgctagagaggctatggagaaacaggaacacttttatactgttgggaacgtaaactagttcaaccattgtggaagacagtgtggcaattcctgaaggatctagaagcagaaataccatttgacccagcaatcccattactaggtttatatccaaagaaatctaaatcattctattttaaagatacatgcacacttatgtttattgcagcactattcacaatagcaaagacatggcatcaacccaaatttctatcaatgatagattggataaagaaaatgtgatacatat

SEQ ID NO: 26069 - DNA, 1614 bp, Homo sapiens
ccagccactgcaaaaatgtactgaagtacaaagaccaatgacactatgaagaaactgcagcaactagtgagcaaaataaccagctagcatcatggtgacaggatcaaatccacgcataacaatattaaccttaagtgtcaatgggctaaatgtaccaattaaaagacacagaccagcaatttggatataaagagtcaagattcaggtgtgctgtattcagggttcctatctcatgtggaaagacacacgtaggctcaaagggatggaggaaaatttaccaagcaaatggaaagcagaaataagcaggggttgcaatcctagtttctgacaaaacagactttgaatcaacaaagataaaaaaaagacaaagaatagcatcacacaatgataaaggaatcaattcaacaagaagagctaactatcctaaatatgtatgcacccaatacaggagaacccagattcataaaacaagtctttagagacctacaaagagactcaggctcccatacaacaatagtcggagacattaacaccccattgtaaatattggatcatctagacagaaaattaacaagaaaggactggaacacagctctggatcaagtgaatctcatagatatctacagaactctccaacacaaaacaacagactatatattattctcagtggcatatgacactctaaagttgatcacaaaattagaattaaaacactcctcagcaaatgcaaaataactgaaatcataacaatctctcagaccacagtgcaatcaaattagaactcaagattaagaaactcactcaaaaccacacaactacatggaaattgaacaacctgctcctgagtgacttctgggtaaataataaaattaaggcagaaatcaagaagttctttgaaaccaatgagaacaaagagacaatgtaccagaatctctgggaggcaactaaagcagtgttaagaggtaaatttatagcactaaatgcccgcatcataaagctagaaatatctcaaatcaataccctaacatcacaactaaaagaactagagaagcaagagcaaacaaatccaaaagctagcagaagagaaaaaaaaaatgactaagatcaaagtggaactgaaggagacagagacatgaaaaacccttcaaaaaaaaaaaaacaagaaataaaacgtgttcaaatagcaagagataaaatcaaattgtctctgtttgcagaaaacgtgattctatatctagaaaaccacattgtcacagcccaaaaactccttaagctgataagcaagttcagcaaagtctgaggatacaaaatcaatgtgcaaaaatcacaagcattcttatacaccagcaatagacaatattcttcaattcctatacaccaataatagacaagagagccaaatcatgaatgaactcccattcacaattgttacaaagagaataaaatacctaggaatacagctaatgatgggtgtgaagaacctcttcaaggagaactacaagccactgctcaaagaaataagagaggacacaaacaaatggaaaaatattccatgctcatgggtgggaagaatcagtctcatgaaaatggccatactgcccaaagtaatttata

SEQ ID NO: 26070 - DNA, 1138 bp, Homo sapiens
tcctcctcactgtttgggacttcccaactggggcctccagccacccccactggtgttctcctgctgacagtgatttcagttttttcttggctggagctccctgatggaggggcaggccatcatgtttgctgtttttgcaacttaaccacttcaaccttcagtctttggagtgtccaaggagaccaggggctgatgtggaccctcagcatagcacagatgctctataaaaatgtggtcagactgctttttaagcactttcccaatgtcattccgcctcactgggcaaaaccccctaactggggtctccagctacctcctacaggtgtgtttgggccagcaacaagttcattcatacctccctagggcaaagcttccaaagggagcagtaggctgccaacttttctgtttcacagccttcactgatgataactccaggtactggaaaatctgaggctactagagactgaagtgggccctgggcatactgcagcagccctatggaaaagtggccagactgttacctgggttcccattcctgtatcttctcactaggcaagtcttgcaggcctgggcctctacctaacccccctgccagagctgtcgagccagtagcaactcagccactccctggacagagcctccaggggcaactgaaagcctctctgccactgcttctgcagtggaactgtccttgctaccctcagactgatgaaggagctaacacccttatctacaccttcaacaagctttaattgaccaaagcccatctcccacgggttttacacactccccactgctcataacagacagggaacccctggattggcccccacagcatgaattctccatcctgcttgctgattgcaataaacagttgctgacctgtattctccgggggtagaaccctgaggagacaaacaaaagacccttggctacaaccactactaatgtcccttcctcttcttccccaaagttagggaagaaatataaacactgagattgccccagagctgcagtgggcagcctaggagtgccaagccatgatctacagccagcactcaaggaggagagaagcacattttcagatcattgagagtgaacatggctgcaactgtgaggaaacataggggagccacat

SEQ ID NO: 26071 - DNA, 1812 bp, Homo sapiens
actgggcaggacctccagacctccatgccagggagaattcaaatctctgtcagcccgagaacactggtgggggtggctggaggccctggttgggaggtcctgcccagtgaggaggaatggatcacagaccttcttaaagacccagtgtggccacattttggtagagcaccttgctatgccaaccccgccagtgttctcaggatgacagatttggattctccctggcatggaggtcttgaggtcctgccaagagagggacctcccaactgaggcctccagccacccctgccagtgttctggggctgacagagttttgaattctccctggcatggaggcctcaaggtctggcccagtgagggacctcccaaccgtggcctccagccacccccgctggtgttctggggctgacagagatctgaattctccctggcatgtagttctcaaggtcctgcccaatgagggtccctttagctggggtctccagccacccccaccggtgttctcagtctgacagagatttgagttctccctggcatggaggtctcaggatcttgcccagtgagggacctcccaactggggcctccagccacctccgccagtgttccggggctgacagagatttgaattctccctggcatggaggtcttgaggtcctgcccagtgaggaaactctcaaccgtggcctccagccacccgcccctgctgttctcaggctgagagagatctgaattctccctggcatgtagttctcaagatcctgtccaatgagggtccttttagctggggtctccagccaatcccaccggtgttctcaggctgacagagatttgagttctccctggcatggaggtctttaggtcctgcctgcccagtgagggacctcccaactggggcctccagccacctccaccagtgttctggggctgacagaggtttgagttctccctggcatggcggtcttggggtcccgcccagtgagggacctcccaaccggggcctccagccacctccgccagtgttctggggctgacagagatttgaattctcccaggcatggagttcttgaggtcccacccagttagggttctcctaactgggacctctggccacccccacctgtgttctcatgctgacagaggtttgaattcttcctggcatggaggtctccagttcctgcccagtgagtgtcctttcaactcaggcctctagccaactccccccacccctgccagtgttctggggctgacagagatttgaattctccttggcatggaggtatcagggtcctgctcagtgagggacctcccaacaggggcctgcaaccacccccgccagtgttctggggctgacagagatttgaattctccctggcatggaggtcttggggtctggcccactgagggatctcctaaccagggcctccagccacccccgccagtgttctggggctgacagagatttgaattctcccaggtaagcagttcttggttcttgaagtcccgcccagtaagggttctcctaactggggcctctggccacccccacctgtgttctcatgctgacagagatttgaattcttcctggcatggaggtctccacttcctgcccagtgtgggtcttttcaactcaggcctccagccacccgcccctggtgttctcaggctgacagatttgaattctccctggcacatagttcttgaggtcctgcccaatgagggtccttttatctggggtctccagccaaccccactggtgttctggggctgacagaggtttgagttctccctggcatggcagtcttggggtcccg

SEQ ID NO: 26072 - DNA, 1053 bp, Homo sapiens
ttcagtcacaggctcaggctccaattttacttagttctctcgctagttccaccacactcacagttacttcctccactgaagtcttgaaaccctccaagctatctatgagggctgaaatcaacttcttccaaacttcatattttgacctcctccaaggaatcacaaatatctttaatttcatctagaatagtgattgctttctaaaaaaatccaaatgatttttaatttgccttgtgcagatacgcagaagaatcattgtctatggcagctataggcttacaaaatgtattcttaaataataaaatgtccttgatccatgggcttcagaatgaatgctgtgttagcaggcatgaaaacaatattaatctatttgtacaactccatcagagctcttgggttatgagtgcattgtcaatgagcagtaatattttaaaagatatatatatatatacatatatatatacacatatatatatacatacacacacacacatacacgtatacacacacacaaacacacacacatgttttctggacaataggtctcaacagtgtgcttaagatatttggtaaaccatactgtaaacagatgtgttttcatccaggctttgttgtttcatttatagagtataggtagcataggtttagaagaacttaaaaatgtagcagaatggtaaatgagtacttcctttaatgttttaatgtaaccagctgcattagccagtacatagaaagtcagcctgtcctctgaagattagaagccaggcattgacttctcctctatagctgtgaaagttttaggtatcctcttcttccagtataatgctgttttgtctacattgaaaatctgttatttagcataactgcccttatcaatgatcttagctagatcttctggataacttgatgcagcttctctatcagcactggctgcttcaccttgcacttttatgttatgaagattcttttcttaaacctcatgaaccaacctctgctagtttaaacttgtcttctgcagcctcctcacctgtctcagacttcatagaattaaag

SEQ ID NO: 26073 - DNA, 1028 bp, Homo sapiens
cacccctatagaactatcagcctgcaaactgaaactgttctcacaaaacaaaggcatcgtcaacttctcaaggttaaggtagtgatttaaggctaacagaccccacactcgtgataataattagttaagcaattacaggtcacaagcagtcacttgaccagtgacattttaaatctctagtcattgactttgtcattggtttacttttgcccgtgggaaaagttgaaaattccttagcatggaatcaaaactctcacatcagtgtggttcttgtcaagttattcagccttatctttcgccacttaccatactctgcacctttgttctagcatccagccaaactagactacatggagctccacagtgatcgtcttcacctccagctgtttgcatttacttcttccctctatcctacatgtgttttccttccccttcagatatcaacctatgaattgcctctaccaaaaagcctacaatattgacacaaacctgggctagtatcccttctatgtcttccaataagtgctgtcttatgcctgtcattgtatgtatgactctgtacgggaattgcctgtttgttttttcagattatagcatacagttgttgaggggtggactgtatcatctttatcttgtaattccagtgcttgtcctagtaccttagcacatggttgctgaatacatgaatgaagagtgagaaaccagaagctctgatacttaactgccatgataatgaattcagtgtgcaactatgggcaaattatatttaatagtaattgcatattgtacatatttttcattcttattaacactgataaacttttcaacatatactgactttctcttagttaactgtgaaatcatttagataaagaatataattctttttcattgtaacttctgaatttaaatctgaatcctctatagcaggggtccccaacccccaggtcacagacaggtccatgacctgttaggaaccaggctgcacagcaggaggtgagtggcaggcaagcgagtgaagcttcatc

SEQ ID NO: 26074 - DNA, 1054 bp, Homo sapiens
cttttgaactttggggaatttatgctgtatgaggtttgaggttttgactcaacttcttttttcccagttagatatccagttatggcaacctctcattgtataaatgttcgggttattatttaatttcagaagcaatcacaatatgttatcctattggatactagttacaagtttgctttgttttacttaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatgaggaaacattagcagaaacgatagcctgttatagtggacagcttgctgctctgacggatgaaaacacaacgctccgttctaaactggagaagcaaagagagagcgggcaaagactggaaacagaaatgcaatcataccgttgtagactgaatgctgctctatgtgatcatgatcaaagtcactcatcaaaaagagaccaagagcttgctttccagggcacagtagataaatgttgtcatttacaggaaaatttgaattctcatgttctgattctttctctgcaactttctaaagctgagagtaagttcagagtcctcgaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaagcaggaaagattttgtcaactaaaaaaacaaaatatgttgcttcaacagcaactggatgatgctcgcaacaaagctgacaatcaagaaaaagcaatacttaatattcaagccagatgtgatgctagagtagaaaaccttcaagctgagtgcagaaagcaccgtctcttactagaagaagacaataaaatgttggtgaatgaattgaat

SEQ ID NO: 26075 - DNA, 1039 bp, Homo sapiens
tgtgccctcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggccttttctgcatctattgagataatcatgtggtttttgtctttggttttgtttataagctggattacatttatttatttgcgtatattgaagcagccttgcatcccagggatgaagcccacttgatcatggtggataagctttttgatgtgctgctggatttggtttgcccatattttatcgaggatttttgcatcaatgttcattaaggatactggtctaaaattctcttttttggttgtgtctctgcccggctttggtatcaggatgatgctggcctcataaaatgagttagggagggttccctctttttctattgattggaatagtttcagaaggaagggtatcacttcctccttgtacctctggtagaattcggctgtggatccatctggtcctggactctttttggttggtaagctattgattattgccacaatttcagagcctgttattggtctattcagagattcaacttcttcctggtttagtcttgggagggtgtatgtttccaggaatttatccatttcttctagattttctagtttatttgcgtagaggtgtttgtagtattctttgatggtagtttgtatttctgtgggatcggtggtgatatcccctttatcattttgtattgcatctatttgattcttctctcttttcttcttttttagtcttgctagctgtctatcaattttgttgatcctttcaaaaaaccagctcctggattcattaattttttgaagggttttttgtgtctctatttccttcagttctgttctgattttagttatttcttgccttctgctagcttttgaatgtgtttgctcttgcttttctagttcttttaattgtgatgttagggtgtc

SEQ ID NO: 26076 - DNA, 1044 bp, Homo sapiens
gcttttcagtgtcttctcagaaacaactggcctggaaggtaattaaacactcatatatattttgaactattaactgtatagtctatgaatatatactttatgtattgattattttgtttcaaatcccattcaggctacaagtgtcaagaaagattctgtttcgaatatagccacagagataaaggatggacaaatacgtgggacaggtattttggaatacacctttaatgtaatgttcgatcaaatagaagagaaattcacttccccaaataaatcagcggggggttcattgaagctttatgtttggattcagcatgcttgagattcttcatttgtaataagtcctcgggtgaccctgatggtgctggtccttgaccatgatctgagtagtaagattgtagacttccctacattgaaattgggaagaagagccataggagagcggttcagcacataacagcctcaggggacagcatcattttgctttaattctacagcaagtttccatcaagaggggaaggagaacgagacgaagtaatagatattataggcgtcagatcatattgttataaacggagggaaaagtgatcctaatacctcaaaaacagcgtagaatgagaacaaacaagatcactgaagtagcaattattttccacaaggaagagggattgtgaggcaggaaggagagaaaagaagaagttatttatgtaattttggggtttctgttgaggaaagctgagtgaactcacttcagataaatttggaatatttgcataaaagaatattaaattttggcttctccaagaactactggaagcaggaaacaatgctagaattgggataaagcacactgactcgttactcctctttgttactgttaggcatcagagatacacgttttgttgattttagttataaaaatgagataaacttgaatatgaatacattggcttcattgttcaaggagctaactcttgggtaaaatagctattggatgaaacttctttagagaatagcatgatactcccaacaagactattatag

SEQ ID NO: 26077 - DNA, 1054 bp, Homo sapiens
tatattttacaaatgttgaccttctcaacaacatatggtttttttgagtaaggtcatctatttctactccaaatgtatttacccagatcagtcttctaagtcccctttgtgcctcaaatttgacaggtctcaaactgccttccagattctttcctgactctttgtaatctactctgtcatctggcgtcccaattttagtaaataacaccaagaaagtagcaatgaaacattgaagcagaaaaactgcactccaggtttccctcacattgccaatccagtgactcaccaaattttgtattttctacctttaaccatttctcgtatcttattactgtaatacactgtctgccctatacttttggaatgttcgtttttgtttctctcttctccccatgtttatctatctatatatgtctttcagggtgacctttcttaaacatgtttactttgatctaactcatctgcttacggctggaccctcattacacgaaagaaacatttacattctagcataacacttattttgtggtttggcctgtttctcccattttatctctccactccactttctctgtctgtgcccaagttttaccacgttattgtggtagttcttattggctatgctgtttcatttttttgcacatgctgccctcactagaaacacttcacattcttagtcttcacttgtctattttaaaaataggaccctaaatttacagtgtctcagaagcttcccaagtagaaataagtgttattgcctttgtgctgtcactgtattttattgacttgaattgtagaaataatgaattgtgtctttctgcttttgtttgtttttatgtttcttttttcacttgataaataaataaaattggtattttattcatattatcagattttccagtatagaccttatgaatttatagacacagaaaatgtttcttgaattactgaccgattgagtagtaaatataacattttctgaagatttcttttttttttttttaataggaaggaaaagcactaccagcaactggacaaaaagcaaatggtattg

SEQ ID NO: 26078 - DNA, 1051 bp, Homo sapiens
agactcccattttccagtgacacagattagtctttgaatcagaaatagataatggagaagagaccgtgccttttctaccttgttttaggttatcaggtttactgcagttcagtaacaaaagttgtgacagatatcaattggattttcagtttagtctttagggtagataatttataaggataaattattgtctggctgtgccattataatgcctgtcactaattgttatgggtttaagggtgagtctgcattggatatttcataggttgggagaagtggcagcagaaataggtaactgaaatgttttctaaaatggaagccatatcttaattataccaagaaatattatttaatataaggataactgaccttcctcagactttgttttaccatttgttttggaggggacctgcatgtatagactgacggtttttgttttcttttaagaaatgaacgtgctcatttttttcatatctttttgctctgtaggtgtctctacctactggaccgttttgcacaggctgtgacaaaggataagtttgctttggaatctgaggtagagtactctcttgtgaaattaattttctcactccgaatctcattttttatattattttcttctaaaacttagcaattgtctacctatcattgttttatgttagtattaaaacttttattagagataaccattttaaagaaatagggggggttaattttaatttttttttactttgcaaataagaaatagttgataaatactttgagaggtgtgatctgaaaaaaaaattgctggaaaatacatagtgacagaaaaatgtggttctggaacgctttcccacaacagaggagatacaaattttggtctaggcttatctgagtaagtgtttttactctgagttgtatatcatatgagtatgactaataatacctctgtttaaatgaatctttgttacatcagatgacttattatgggaatcatggaatcaccctgttacacatagcatatagtttcttttcatttcttgtacacctattttaacatcatacagta

SEQ ID NO: 26079 - DNA, 1025 bp, Homo sapiens
ttaacattgacacatgtaagggtcaatttttcatatttggaagctcaaacattccttgaatgaaaatattttgaaatgccttaactgtctaagattttactttaaattttggaacttttaaagaagcattataaggaacagctatttttcatgcacttatggtaaataattatacaaacatgaattacaataaatttggaattcatgacaactgaatttgggaaaggtaatagttaagtgtttttccactaaattactctttttctaatcagtgtgaagtgacacaggaaagtaaaattggcccttataaataggctttattttaaatttcaaagaaaattaaagaatttcacaataaatgtacatcttgttgctgttgacaagtattgtatgtgaaggtgatttcatctgaaagtgattcctctgtggaaaggcttaagagggaaaaatgaagaaaaggagagcaatcagaaatgcacaagctaatttggaaattaggtaatgagggaaaatactgtggagagtgtttttgtgtgttttgttgtttgttttcaatttatatgtttagacaaggatcgcttcagttttggggatgattattcttactttgggaaagagtttgtgagttgtgaaattgcccagggatcaattttggtaggactctgaggaaaccaggttggcagtgaatagtggtgatgaagcggcacacagttcagcagagagaagaacacataattaatggacattattcaattctggcagaaacagccactcagataagcatctaaactctactctcaagtccagaatgtcttgatgggcaggtgggagatacggagcttataaatagtaaaatcaagttggattttgagcttactagtctcttccctacccctacccaggaaaagtaaatgaagttttcagtgaatggctctatcttttgctctttcctcttttcagccaaatcccaaacgataaagggaatttgccatgtgagtgagagatgagactgaagtgattatcaa

SEQ ID NO: 26080 - DNA, 1066 bp, Homo sapiens
ccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgtttttgtttttgttttcctgcttgctactgttttgtggtgttgaaaagtggtttaaacctgagactaacttaaacacttccttgaccttcttgttgcctgttcatttttgtgccaaggaagtagctgccccagtgtatgt

SEQ ID NO: 26081 - DNA, 1021 bp, Homo sapiens
aagtgctgttgtttttgacccacagcctagtgagccgtaaattaccaaaggaactcacttcatttttaattaattcatttgtttgttgtagacgcagggtttcacagtgtggtccaggctggtcttggactcctggcctcaagtgatcttccttccttggcttcccagtgttgggattacaggcatgagccaccacgtctggccttcgcttcatttttagaacttagtttgtatttattcatcttagtgactcctttgttttgtgtatttaaaaatatcagagccagctttttaggccttccccttaacttagctctcctgttgttttatatatagacattactaagagtttgcttctcctttcctccttaccagtgctgtggagcatccgagtgtgccagagtctccagaattcgtcagggtcagatcatatgaatcccaaatggttatccgtccccacaagtcatttgatgaggtgagttttacctcatccaagagataacatgtcatggctgtggaattttctcaagggatgtcttacctgaactagggaggagggggtgtggcgcaggaacagttctcgctcgggggagtctgatgctactggtctgggaaccattttttgggaactcctgacgtaggtgatgtacctggaagttccccaaggacaaagtagtggcaatccattggttccctcttatctgagagatagttaaaagaatcatagccactgacgcattagcctgtatcagtagcattcttcaggaactagagcgagtacctcctgtcaacattttactacagtgggcagagcactggatggaaacttttctggatttctgcttccttgccagagtaatgggaagattggactcatgctgtctgccttctttaaaattctgtgacctttctttgaaaagaatatttatttcagcctaatgaggtgttttgtgtttattttttatctttttaagctaaatctccactgagagtatagatattgatgctagtggctgctggt

SEQ ID NO: 26082 - DNA, 1020 bp, Homo sapiens
tttgggttccatagttgcacaggtgcatgggatttctgttcttcatacttctctaaactgttctggttgtttctcagaaaatttgccgtagttttttgtttattgtttttcttctcccagatgacaaatgtctcagtgttgtctttgcttacatcctctttgtctttctttgttgctctactaagacttctagtttctgaacctgcctttaagatctcttagtactttagatctgaaacgccgctaggtgaaagaaacaaggcgagtgactggagtatggccagcatcccttattctttcttttcattctagtttttggaacctacacagatgtgacacctcggcagttcttcaatgttcaggtgagttaatttttctctccagatttggagcctcctagcatatcaattgctactgtctacatgaatcatttatctgactcaggtgacattggcttaagtacatccatctatctacctgtcatccacattgcatagcatttaggtaaacatttgacttagaatttctttatctgtcccatggggatgagatcagttttaccctcccacaggactgttgggaatatcagatagaggaatggatatgaatactttaatgtattttatgaggctttattgtttttttccccaaacaacttaagagtaagttacatacatcatagtcctttactcctaaattcttccagtgtgtatttcctaaaactagccatatgccgtatttcttaactaatcatgataccattattgaaattagtaaatttaacactgatggaacactttcatgtagtcctctgtttgtatttatcagttttatcagttgactcaatgtcctttatagcattttccacttcagtacagataggattatatttagttgtcacatctgtttaacctcaaatcaagaacatttccatagtggagggtttttttttttctttcctctccctgagacagggtcctgctgtgttacccaggctggagtacagtggtgtgatcatgt

SEQ ID NO: 26083 - DNA, 1032 bp, Homo sapiens
ctacagaaagcaattagagctgataaatgagttcatcaagtttgcaggatacaagatcaatacacggaagtcatgtttatgtacactaacaatgaatctgaaaataaaattaacaatttcatttacagtagcataaaaggaataaatacatacgaataaattaacaagtgtacaactaaaactgtaacactaaaaacaacaaaacatcattggaagaaatttaaaaagacataagtgaaagacatcccgtgttcatggattagattagaacacttaatattgctaagatggcaataccacttaaagtgatctacaaattcagtgtagtctttatcaaaatcctaggcagttctgcagaaattggcaagccacttctgatagtcatatggaaatgaaaggaactcagaatagcaaaaacagtcttgaaaaaagagaacaaagtttggaggactcactgttcccaatttcaaaacttattacaaagctacagtaatgacattgtggtactggcataaggatagacatctagattgttagaataaaattgagagtctagaaataaacctttacatttttggtcagttttcaacaaggatgccaggatagttcactggggaaggaataggcttttcgacaaatgacactgggtcacctggagaagcagatgcaaaagaatgagtttagactcctacctcattatcatacacaaacattaacttgaaatggggtaaagacctaatgtaagctaaaattctaaaactcttagaagaaaatataggcataagttcttatgaccttggattaggcagtggtttcttggctataacaccaaaaacaagcaatcaaagaaaaaataaacatcaaaattaaaaacttttatgcatgaaaggatactatcaagactagtataagcacatgaaaaggttagggaaataccagtcaagacgcaatgagataccatttcacacccactaagttggctggaataacaaagatggacaataacaagtggggcaattggaaccaaggatg

SEQ ID NO: 26084 - DNA, 1028 bp, Homo sapiens
atagctagcttagaacatcttggatttcgtttgttctagtgagatgatttttgggtagcttccataatggagcacagttggagtgtgtctcaagtgcatttctttcattgttaatggaaaaagagcatgattgtcacatggcccctaaatcacagcctttggctcatctgtgctgattctgtaccaacttgtcctggcacaaactaattctaacatagctgttttggttaagcgggtggaatgtgcagggtgtctttttgaatgtgtgccttaaagtggcatgtgttttccttatgttatttgagtcctattcagaatgacaaagcataacttgtcttctcgtcttttgtgcttaagaacatcttaccaaatagcgtcttattaatcaagcaacagcaagaaaatttgagaagtgattttgactggctgctgtggccagatgtagaaatcagatcttttaatacttgctctagtacccagttgtcttaaattaaacaacgaaaatatcttgggattgctgtttttggtgctagctggcattctgtgattccagggcaaatctaatggaaaaatacagtagtcatgtttttgattgctttggaacagttaaaaagaaaagttacaggaacaaagagaggaaggatgttaagaaatgaaaggctaggggaaaatgttccattaacctcctcatagttttttaaaagttacagttcattgctccagaaatttgagtaaataagtgccattaaagttgcataaagaaaattggccattttctcttttctgtctttcagggcattcgggatatgttaaacttcagtgtgttattgactagataaatgatccgcataaagtccttttgccttaaaggaacttttttttttttttttggccattgtcacttcagggtatcttactggtaaacccttaaaccccttgttagatcttcagagctacataaaattagatctcaattttttgaggttgtcttcattattttaccattaactagttgccctagaactgca

SEQ ID NO: 26085 - DNA, 1963 bp, Homo sapiens
gtcagatctctttcactgtctcagttttaattctgcaatggcggttatcactgggagcccccagcccccgcagagacatgcggagccccgcccccaccctgcactctaataaagaagggggccagcgtgccggcctcttaaaacaagttaacacctggcaggattctaacaggaacctggccaggtttctccgcggggcggggctgggacggccggaagatggcggcgacggcggcagccgggtccgagggtcactctccaatgcgcccttgacggctctcgccgccgagccacctaccttgctagcaggcggcctccgcgcatgcatgaaggggcaggagggggcggtgacgagcacttcacggcgccaatgagcacccaggagcccaggtcgcgcccaatcacggcccaggtggcggagaaaaagtagggtgcgcgcgcgccgcgcgtgtggcagtcgcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagaggtgggcgctgcggcgagctctttctgggccgtggggtgggggggcttgtgaaccctggggcctgccctgtggtcgttggcccttgtttacccggtggtcttttaattggcaatacagtcgattgaacctgcttcagcaaaccgcgttgttatttgtctctgtgtgtcaatttgcatttgtcgggttataaaatagaactgaaagtgtgtaggctggtgtgtaggagggagactttgagtggggcgagcaagacagtaaagaaacaacactgtagaaatcaattagatagcgaaggcatggaggcccttgttcatgtaatctgtaatctttaacacaaccagaaaggtgcaaattcaaaacaaattttaaatttggcctaagggtggtgggctgctatttgcaaaatgacttcaatccagatgggactcaggcctgtgagaaaagccaggagagccctctgtcatcgtgactcgtggcaaaattgagagcctggaagcgattttgtccaggttacacaaaccagcagcccagacatttgaacctgtaagaattaggtcagatttttgcgacgttaactagaactttgggaatagtgtcccattagactctgaagtcatgctgtcgtcatcaaaactgtgaaaagcccagtaccattgattacgtttgttaatctgtagttctgagactgtagtttccaggtaatgtcatggggaaactttgctttggtttttggtttaccttgtgtctgtattttctttgcaacagatattcttaaactgtgccctccctgcacagaaagtactttgccgtgatttcgggaaccagagaca

SEQ ID NO: 26086 - DNA, 1055 bp, Homo sapiens
ggagatgccaagtccaatagcctcatctccatcaagaggctgaccttgcagcagaaggccaaggtgagtgtgtccactggccctagcatttgttctggcatgggggaagggtgagaatgcttcctgtgtccatgctcatcttgatttctgcctgctctttctaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatatagcattttcaggcatgttcctggtagttcttttgagtctgacattctaataaaataatttgtagaaaccatttgtctttgtagtgattccaaattaaaagttttctttctccaacctgagggcacggccaaaaagatctggttattttttagccaggaacgtgcttgttaatgagtatgtctggaggacagacctgctcattaggtgtgctgtcccctgtagcctcgtgagtcagcccagaggagggtacatgcgactgtggcctggcctcagtggtacccacacatcagcactaccacaagaaccaacactgagcctcggaagctagatcacaggttaggggtttctctagatgggggttctgaaatttgcagtgtctgctcctgggaggcagcaccagaaagggcactgaaatgtactagctggatgtgacccagtcttaataaacaggttttctaatccagatcttccgactgtcttcaaattcttaccttctgttctttagattaaatgcacacaaaattgaaagatgattc

SEQ ID NO: 26087 - DNA, 1649 bp, Homo sapiens
gagccgtggctgtgccactgcactccagtatggacagcagagcaagaccctgtatcaaaaaacaaataaaaacaataataattttttttaattaaaggagaaaagtttgggaagtttgacttacatatttgatcctcgaatagggagttattttggttttggcattagatagttttgtagcttggttcatggcacttgagcagcaaattcatggcccttacactgaatactaaaatgttatacaggccagccagtgaagctagttgtaagtgcagagattcataaacagagtcgtcccgtgatttgtccgtgtctccccgtattaacattttactcttacttggcgaagggagttgggcttcctgagcatggtctccgtgttgaggtggcttttccttctttccctgcttctgtcaccagctatgtggattaccccatctatgacgtgcttcagatggtgggccacgccaaccgccctttgcaggacgatgaggggcgctgtgtcatcatgtgtcagggctccaagaaggtcagtcctagactcatggagcctcttggatccgtagcctcagaatggattctttaatctttcttttgatagatgtcttcagtaactttagtctcttaacttctgcctctcttatttacacaattcttttgtgacgagcctgccacccacatggaattttgctgccttttgcttttgctgctgccgttggctccacgtgttgaggtcttcaccctctacttggttctctccttcctccttgggctgctcactgctctgccctcgtgacttgctgtacctctgttcccactgcgtattgtcaccagtgatgcactttctaaatgtgtggcttcttccattttggtattagttaggtctcacacagggaccatgccctgttgatttgcccttggccctctgtgaccgtgttgtcactaattctttattactccttctccctctccaacccacaggatttcttcaagaagttcttatatgagccattgccagtagaatctcacctggaccactgtatgcatgaccacttcaatgctgagatcgtcaccaagaccattgagaacaagcaggatgctgtggactacctcacctggacctttctgtaccgccgcatgacacagaaccccaattactacaacctgcagggtcagtgggcttgggagcacacgtgatcctttggtggttctcacagtctttgctgggcatcttcttgaggctccccactcacctctcgcctccataggcatctcccatcgtcacttgtcggaccacttgtcagagctggtggagcagaccctgagtgacctggagcagtccaagtgcatcagcatcgaggacgagatggacgtggcgcctctgaacctaggcatgatcgccgcctactattacatcaactacaccaccattggtgaggcccggcatggcccgtgtcctgtctgtgggagcctttttacacgggtcaggagcccactgggatgagaggtgcgcccgtgtttgtcagcgggatgacactgcaggggacagcaggggagcccgggcagttctgctccttctctgcctggttttagcttctctcacatttcctttttctgtcagagctcttcagcatgtccctcaatgccaa

SEQ ID NO: 26088 - DNA, 1050 bp, Homo sapiens
acttcattccctacaacagtgtactagtctcagacttatttcctaaatccttttataagtagtgtaatgttttagttgttattttgcagacacattttcatgcagctttgactcttgttaggtgcttgaacataaattctgagttgagaggcccgaatttgtagttgtagtctatttaaagttgctgttcaagataggatgttgaagttggtttaatttctcagctccaggactgtgaacttggtgggtgcattcccttaaaagtctttccagccgtgtttaggcttcctctgagcctgcacacattcctgcccttgcccctctccaggaccttggcttctggtggtgatggtgcaacttctgcttcctgctgcaggtgccctggggctgtgagtatctcgtgactgtagcaaactgtggcttctccttaggtgctggtgtttgtccactcccggaaggagactggaaagacagccagggccatccgggacatgtgcctagaaaaggacactctgggtctgtttctgagggagggctcagcctccacagaagtcctgcgaacagaagctgagcagtgcaaggtgaggaggggccagctgggttctctcattcctacctggcagctgtgtccatctcaggccccagacagctcctctaggactgtactgtggtattgttgtttcccatgggttaaggttgattgtctggatgtgattattactattccacataatagttaaggggcagggtctcatgggaggagatttccttagtccttggatgagtcctacaggaaggctcgcctcatccccggttctttgttccacagaacctagagctgaaggatcttctgccttatggctttgctattcatcacgcaggcatgaccagggttgaccgaacactcgtggaggatctttttgctgataaacatattcaggtgagggggtgcaaagcgtttggaggagcaggtgggacatacttcagaagatgggcaatgtcaagtttgtgccatgtttgctcctggtactttattgcttctggcccagc

SEQ ID NO: 26089 - DNA, 1049 bp, Homo sapiens
aggtaatttctgtcctccaattccgtaggatgagattcatcttctccacgatgacagaggtcctgtcttagaagctttagtggccagggccatccgaaacattgagatgacccaagaggatgtccgactcattggtctcagtgccaccctacccaactatgaagatgtagccacctttctacgtgttgaccctgccaagggtctcttttactttgacaacaggtatcaggaaagactgggcaaagttctgccaaggtgaccatcctgctctctttcctcttttccaaggagtgctactgggttgggttttagaagggcctttgggttttgatgtggtgtgaatcataaaggaggaatattgctcttggggcagtgaaaaagactgtttattcccacagtattttctgccaaagcctcatttgtctaactgttgaacttctagcttccgtccagtgcctctggaacagacatatgtgggtatcacagagaaaaaagctatcaagcgtttccagatcatgaatgaaatcgtctatgaaaaaatcatggaacatgctggaaaaaatcaggtttgcccgtggtttatggttactcttgaaccccattctttcgaatgtttgattcaccaataattggggaagattgacagaaattaaaagagagaagacacaacataaatcaccaatatcagctatgaaatgggatattactacagaacctatagccactggaaggataataagggaatactatgagtaattttatgctcataactttaaaaattcagaagaaatggaccagttctccaacaactaccagttaactagcaaaactcagcccagatgaaatagataacatgaagagccctacaactattagagagttggagaattaaaaatccccccagcaagcaatccccagtcccagataattgttttgtgcattcgcattatccagggtccctccataaaagatttggggtcacttacactaaaaatgcaagacaataaaaagaggaaaatgaaaaactagagggcattttactagacagt

SEQ ID NO: 26090 - DNA, 1076 bp, Homo sapiens
ccactgtttttcagagtagttgtactattttacattcctatcagcagtgtatgcgagattcattttctcggcattcctgccagcattctatattgtctcttttattatttatttatttttattttatttttgggagactgagtctcattctgtcgcccaggctggagtgcaatgcgcaatcttggctcactgcaacctctgcctcccaggttcaagcaattctgcctcagcctccctagtagctgggattacaggcatccaccaccacacctgtctaattttttttttttttttgtatttttagtagagatggggtttcaccacgtcggccaggctggtcttgaactcctgacctcaggtaatccacccgcctcagcctcccaaagtgctgggattacaggtgtgagccactgcgcctggcctcttttattttttattttagccattctaataggtgtgtagtggtatctcattgtggtcttttaaatttgttgaggtttatggcccaggggtgatctatcttggtatgtattctgtgggtgcttaaatgtgttctgctgtagggtggagtgttccataaatgtcgataaaattgttggctgatggtgttgtcaggttcttgtatatccttgctgattttctgtcaagttgttctgtcaactgtaaagagtggtgttgaaatttccaactataattgtggaattgtctatgtctcctttcagttctgtcagtttttattacacatatttttcagttctgttatttggtacatacacttttaggatttctgtgtctttttggtggattgacccttttatcattatgtaatgtccctctgtccctgttggttttctttgccatgaagtctactttatttgacactatacccattctacttgtttttgatttatgtttgcatgacatattttttattcttttgttttcaccctacctatgtcattatatttcaagtgaatttcttgtagactgcatgtagcatatgatttttcttctataccaatatcattcttttaattagagtttttagactgttttcttacatgtaattataggta

SEQ ID NO: 26091 - DNA, 1022 bp, Homo sapiens
gagctgagattgtaccattgcactccagcctgggcaacagagccagactctgtctcaaaaaaataaaataaataaataaaataaagtggatatgtaattgctaggaggagtcaggtggtgattcttttccaacaagcaaggggatgttattagattaaggcttcttgctgattcagaagcttctaatagctctgttcagattgccagacagagcactggactatgggtcaggtcatctgttttcagccagctgtgtgatcctgggcaaatcacctatccttctgggctttggttttcttacctggtttagagaggaagttgacttaattcagtgactgttgtggtggcaggatcagaatctcctcaggctttggaaaccgacgttttttaatgcttagaaacaaactacccatttttttgacatttatgaggcaattggaaattttaacactgactggatagttgttgatattacggaattgttaacctttttaatgtgtgataatggtattgttaggattttaaaacagtcattttttattttggggttccatactgcaatatttttggatggaatgaatttaaaaagaaaagtgaacaccaactagacttctctaagatctgtataagcacttaattatctgttttgtttctggcactgattggtgtttactatgtgtttccttcatgggaatggactattgtgtactcatcacagctgagaagctgcagggaggaagaggacagacagagactatgttgtgccctgcatcagggtccaaaaaatggactccctgcctgtggttataagttctctctcctctctgtcctgctggccataccaggaccttgtcagcctggcaagcagcacctctagctggaggcctctggcagtgggcctcactgtagccttgtagcaggctgtgggcaagctggctcactctaaggtgtattcataatcagaacagagtgatcatctgtgtacagccctgcctttgggcagggaagcccatgaggttttg

SEQ ID NO: 26092 - DNA, 1045 bp, Homo sapiens
ggagccgtgaggttgcctggttgaggtactctctctcctagtagctactcatagccagcttttagtcctggtgacactcctcttcattgcctccatttggcaagtggatcctcaactgtgggctcttagggcagggtgggactcttgagagcctttggaaaactctactttttagagaggactggatgacctgctcctccatgagttctcatagaatgtttgatgtctccaactgtgtgatgatgtggggagggcttcagacaggaagatgatcacattttttgagtctgagaaggactgtttactcattctgttgaatcctctatttttgttgttgttgccattggccttggctaggcagggtcaggatgtcttctgtcttttaattcctaccaactcagggccccttctcttccgattccagtgcaggatgagggatgagaagggtgccatcctctaagaagggcaaagtggggtcccccacggacagggcctgagtgaagtggtcctgaagcatgggcagtctcctttgaggggtggccctgtacgtagagtggttatcctgtgtgttctacattctacacatggctgtgttggtgctggtattgactgagtgtctgttgggattttttggattgtggaggatctcaactcagctccatgtcttagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaaggtgagtttctcttggtacgttaaatgagaactgagctctctcaggtacacagcattgccctttggtggccattcaccagcatgtcagcctttgctttattttgagagatgcccggagcaaagaagacatgagtctgtacatgtgggtaaagttggcatgagtccatctgaatgaggaccaggca

SEQ ID NO: 26093 - DNA, 1025 bp, Homo sapiens
gagtggtggcccagaagtatcgtaggcatcttcacatatgttctcctcagcattctacctacggtaaaagtgtaacattggtgaatacactgtaggagatgagtgttggtagtggccagggtctcagttctctggtgaccctgcttcactcactgtggctagcataatttccctttaaggaggaatttgtactgctgccctatttaagttactgactggacatctcctgggtgcatgtcggatattatgagcatggcagaccactggggggactccatagcatgcatagttgggtgttttcctcccatgctgctgggccacggtgtgggttgactggaatagtggaaggctcgctggtacaccagtcagcaagggcctcagactcaaggcaacatcctctctgggctgtgctctccgcagtggttcctctgccatcggactcttattttcccatgactatatttagattcacaacaaatactttggttgtttcccaaaggatataaatgattataggattgttttacttttaaagtgcctgctggatgtgaaagcgcaggtggatgggatcatgctcttcacccagctactttcactattagatccattatgataaagagggcagagaaggtatagaccttagccttttaattggctgttgagagtgaatgcaatgctggaagggccagggaagcttggtcttcccagctccaagtggaaaagtcagtattgattttttatcccttgttgacaggaagcaagtgtcaaggctttttggtttcaaagctatatactactgttagataaagcttaacccagggtcacatcctttgcctcaaagtgttgagtggctcacagttctagagtgagttacaaagaacatgaagatcctttgcagtttggtcttatcctttgcggtttggtcctatccttcctactggctttttacatcctcctccttccttacttgcatccttgacttttgtccatctgtgcctggaataagctctacacattcttgcctc

SEQ ID NO: 26094 - DNA, 1109 bp, Homo sapiens
gtacaaacatatcattatagttccctgctttcttacttagtattgcacaaagttaaactgtttttcttggtgattccagtgattgcatcaggctatcgtcaatgtggtagaatgcggatgctggaggcagattgcctggctgatctcagctttgttactgattagctgtgtaagcttggactggtgtctcatctctaaaatgtggctgataataatagctatctaggatttttatgaaaattaaattagttaattcaggtagggggcttaacacaaaattgggcacatagtaagcagtgagcccacagtaattattattactaatattaacagttatttaagtagtaccctcataggttcttgaaatatttggggtgttttgctccaatacaaaatggcctcacggccgggcatagtagctcatgcctattatcctagcacttcgggaggctgaggcaggaggatcgctttagctcaggagtttgagaccagcctgagcaacatagcaagaccttgtctctactaaaaataaaataattagccaggcatggtggcacacgtctgtagtcccagctagttaggaggctggtgggaggaggctgtagtgagttcagtcccaccactgcactccagcctgggtgacagagggagtccctgtctctaagaaagagagagagagagaagagaaagaaccaaatcaatccaagttgtctgaggccttttttttttttctttggagacaggatcttcctctctcactcaggctggagtgcagtggcactatcattgcttgctataacttcgaactcctgggctcaagcaatccgtctgcctcagcctcccaagtactgggactagaggtgtgtgctaccaccacacccagcaaagaaattttttttttttttttttttgagacaaagtctcactctgtcgcccaggctggaatgcagtggcacgatctcggctcactgcaacttctgcctcctgggttgaagcaattctgcctcagcctcctgagtagctgagactacaggcgtgtgccaccccgcccagctaattttttttgtatttttagtagagatagggtttcaccatgtctcgatctcctg

SEQ ID NO: 26095 - DNA, 1462 bp, Homo sapiens
tgtgacttagaggacctttgaaaatgatttctatttgctggcatagtgatgtagtcctgaagatgttgggccagcttttttttccctccagatgtttgtcaaatgtgaagtttcattagttgcatagcttttgaaagacatttaataaaattttcctgacacatgatacttctcagaattgctcaaatggattttaggacatttccaacattttagtgaaagaatgtagtagtatccaaaagcaggctttcttatcttagaaatcagaacttctgaattccagccaaaaacaccccattttccttttctgagccttctttagttttatattcaatattgtatgtatctgtataaatcttaggttggatgtttgaaattttaagtccaaggtctttgagttatcgtccctccttcccctcccccaccctctttatttccccttccttcattccttcccttcttctagtgtttagacaaagaattttataatctgaaaaaggaaagtatgactgttgagtttatctgatgtactttgtgtctccttgtttgacttctggttaaaaaaaaatcctttagatattttaatgttgaattaattagtcttctttgaaacagtatccaaaataatgattacctttgaaaataccagatattttcaggaccaatgttatattttggctgctttgaatagaatgagccagaggtcagcatatcattcaggttcagtcagagcagggagaacaaaagattttctgatctcatctaagaaaggaagaaaagacatttttgccctcatgaaaattgaataggcgggtggggcacggggtggggagtgccagttggctcaccacagttcccatcagctatttgactgtttaggcttgtatttaaaattctgtctcctgtttttaaaatttttgctaattatatctcttgcatgctctttatcttaatcttggtttagatcattttttttctgcccacttaattttctagcctcccacgaagctgacaaaatatagagatcatgtttcaattcttggagtcactttgttatatatccagcagcaatcctaagaactttttctgggattttggactctcaacgttgtggttttaaaatttaatttcagctgtcattggtgtatggtaataatttctaaatagctttctaaccctctgcatcttgcattcacatcattttccttactcccataattttggattgcagaattaatacagagtaagaaaaacaaatagggaaagcatcattatgtaataaaaacaggataattttggaaatgctgttgatatttcataaataaattataccttattctctgttgttggaattaaagtttgcaacgtgatcaataggctttgagaaagctccagagattgttgaacatgaaaaattgtattcgttgcttaacctggttgattataaattagcatgattgct

SEQ ID NO: 26096 - DNA, 1028 bp, Homo sapiens
ttagctgggtgtggtggcgcatgcctgtaatcccagctactcgggaggctgaggcaggagaatcacttgaacctgggaggcggaggttgtggtgagccgagatcgtgccattgcactccagtctgggcaccaagagtgaaacaccatctcaaaaaaagaaaaaaaagctcttttgagcttcagataaagaagaaaactgctacgaatgaagatcaactactggaatattgctagagtcagtatattcagcaaaaggatttatcactatttttacagttaataataaaaaataacgacgatggtaataacaaaaaggagctaccgtttgttgagtgctttctaggtgccagacattgtatcaatgtctcttcaaatgcattgtctcttaatcctcccaatgactcttggaggtatatccccccttcatctctgctcaacaggatgaagaaactgagctcagggtgtttaagaaaccttaattaggaagtgatggagaaggattttgttcaaaccaagcagcctgactccagaacccagtgttctcaactaccataccctctgccttaattaagggcagtaagaagagattaagaccagttagtggtggctgaacaaggtggcctggtatggttatgtatccctttgtggtattttctactaccttgtcctttgcaatttcagaaagtacataggagaactgtgtgattttttttttttttgtcagtttatccatggttatgattaagaggtttttgtggacaattcatacttatcaaagtcattagagacttaataatactataaataccagtttgtttcttttttcttttttttgagacagggtctcactctgtcacccagactgcagtgcagtggcacgatctcagctcactacaagccttgacctccaggactcaggtgattctcccgggtgggaaccttaacctcccaagtagctgggactacaggagtacgtcaccatttcttaatttttgtagtttttgtagagattgggtttcaccatgttg

SEQ ID NO: 26097 - DNA, 1093 bp, Homo sapiens
gccaggatagtctcgatctgacctcgtgatccacctgcctcaatttaagtagtcgtgtgtggcttatacctactgtattgaacagtatctaggcaatcaacttgttagccacttttctccatttgtactgttcttgtccctaaacgagctctcatgatttctggcccatctcagtcaactgcagtggctgcctagctggtcttctaaattccactcctgagctgtagcctactaaacaaaaattgaaagtgatcttttaaaaatattagcttgagccaaatcaacttgcttatggaatatattgtccttttttttgagactgggtcttgccgtgtcacccagactggagtgcagtggcatgatcagagctgactgtagcctcaacctcctgggctcaagcaagccatcctcccacttcagtttctgggactgcaggcgcataccaccatgcctggctaatttttgtgtttgttttagagacggggttttgccatattgccaaactggtcttgaacttctgggcttaaacaatcctccttcagccttccaaagtactgggattacaagtatgaatcactgtgcctggctatatttgtcatttatttatttattttttgagaccagctcactcctgggcttaagtgatcctcctgcttcagcctcccaagtgctgggattacaggtgtgaatcactgtgtctggctgtatttgtcatttatttatttatttttgagaccaggtcttgctctgtcacccaggctggagtgcagtgatgcaatcatggctcactgcagccttgacttcccgggttccagcagtcctcccaccttagcctccttagtagctgggatcacaggtgtgtgccacatgcccagctaatttttgtatttttggtagagacagggtttcctcatgttgcccaggctggtcttgaactcctgagttcaagcaatccacctgcctcggcttcccaaagtggtggtattacaggtgtgagccagtgcacctggcccatatttatcttaaaaaaaaaatagatgtttatcattttttatatagactcattgaaaaaatgactttgtgttcttccagt

SEQ ID NO: 26098 - DNA, 1025 bp, Homo sapiens
gttcatatgctgtcctgtgcaatttctttttttttttttttttgagacggagtcttgctctgttgcccaggctggagtgcagtggtgcgatctcagctcactgcaaggtccgcctcctgggttcaggccattctcctgcctcagcctccggaatagctgggtagctgggactacaggcacctgcaaccacgcccggctaattttttgtatttttagtagagacgggttttcaccgtgttggccaggatggtctcgatctcctctcgatctcctgacctcgtgatccgcccgcctcggtctcccaaagtgctgggattacaggcgtgagccaccgcgcctggccagtgcaatttcagttcttagatcttatattcagtccagagagtatggaaagtatcttcctttctacatcccaacaccctacaactatctaagagggtaaaatcaaatgtgtttgtcagtggcatggtttacttcaatatacataaaggcgccaggcattgttctaagcactttcacatacattatttacttatcataacaaccttttggggtagatgatagtattatctctattttgtgggtaagaaactgaagtgcatgtagaaaggttacagaacttgttagtgtcacacacgtagtgggtctgactccagagactccagtctgattattattgctttattattttgagctcattaaaagagggtgacaaatactgtaccttttgagaacttacaaatgaccgtggtatgtgtgcagaagatgtcctagacaaggaagacaaggagcaggtaggagggcgtgtggaacaattcatgaaattcctcaagacagtggtaaaaacatttttctggtttcttgtttccttgtcacgagagtccacatgaccctgttgctcaacctcttaccacatttgttcatgagaaaatattgggaaaatcatagcaaccagtaatgcatctgagaagagggtgagagacttcagtatataggctcaatcctcctacctcagcctccttccc

SEQ ID NO: 26099 - DNA, 1050 bp, Homo sapiens
gtagaatcagagacagatgaggctagaatgaaaagcagggccagtagtcttgttatgttgcacagttcctagggctgctgttcaccttgcattctacaatattaacactgtagcctcggcatgttaactagccgctgagactgactggcatctgcttgggtggttggtggctgaactgtttagatgagagccagagcagactgaatgtatgtgactcatgctcaccatataccacttggggccaagttctgaaggattgtgttcctgttgaggagtctggacttgattctgaaggggtaggtacattaaaggattttattgaagagaggatcatgactggatttgtagtcatgctgaggaaatagtggtagttagaaatggatctgaataagagttatcagctttagggcctgacaagagttttaaacttgtctctctgtttcttccagaaacaaattgttcaaactctgttagcttccatttcaccatgagatagtagtaattctggtttgagaaagtagaaattctgacttgggtttattttgtaaggattttgtagatgttaattaaaaaaaatttattttagatggtaaaaattgagacatcttttctggctagctattgtggttcttacttccaagtgcacattgtaattccctggagaacttttaaaaatattgacatccagtcccaaccccagagcttctgattcagttcgtctgaagtgcagtctaggcagccttcctcttttaaagctttccaggagattcacatgtatagccgaggttgagaacccttggactaacatgggttccttttatccttataaaactaaatttaaggccgggcgcggtggctcacacccgtaatcccagcactttgggaggctgaggcgggcagatcacaaggtcaggagttcgagaccagcctggccaacatagtgaaaccctgtctctactaaaaatacaaaattagccaggtgtggtggcgggcgcctgtagtcccagctacttgggaggctgaggcaggagaatcacttgaacctgggag

SEQ ID NO: 26100 - DNA, 1228 bp, Homo sapiens
cctataattccagcactttggtaggctgaggcgggcagatcatctgaggtcaggagtttgagaccagcctgaccaacatggagaaaccccatctctactgaaaatacaaaattagccaggcgtggtggcacatgcctgtaatcccagctactcgggaggctgaggcagtagaatcacttgaactgggaggcggaggttgcagtgagccgagaccacgccattgaactccagcctgggcaacaagagtgaaactacatctcaaaaaaaaaaaaaaaaaaaattagctgggtgtggtgatagtcccatctacatggggagctgaagagggagaactgcttgagtccagaagtcaagtatacagtgagccaagattgtgccactgcactccaccatgggtgacaaagtgagactctgtctcaggaaaaaaaaaagggggggagggggaggggtgaaaaagataagctacagaccaatggaaaccaaaaatcccataaaggaatctcaaagaactctcaaaactcaacagaagaaacaatccaatcagaaaatgggtgaaagacaggaatattccactgaagcgaaacacaggtgtccaccactgggaaatgcaaatgaaaaaccaccgtgaggcatcacgacacacctgtcagaacggctgaagtaaaaacatgtggacaccactaagtgctgtggaggattcagggaaactgatcatcctaggttgccggtgaggacatgagtttgacagtttgtggccaggtgcggtggctcacgcctgtaatcccagaactttgggaggctgaggcgggcagatcacgaagtcaggagatcgagaccatcctggctaacatggtgaaaccccgtctctactaaaaatacaaaaaactagccgggcgtggtggcgggcgcctgtagtcccagctatggggaggctgaggcaggagaatggcatgaacccgggaggcagagcttgcagtgagccgagactgcgccactgcactccagcctgggcaaaagagtgagactccgtctcaaaaaaaaaaaaaaaaagtttgattgtttaaaaaacgaaacatgcaacaaccctatgaccaagcatttacactcctcgaaaactaatcctgacacagaaacctgtacatgaatagtcgtagcagctttatttggaatagccccaaactggaaacatcccaggtgtccttcagggggccaatgcatacaccacgga

SEQ ID NO: 26101 - DNA, 1048 bp, Homo sapiens
actcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgccccccagcccttcccatcccttccctgctccctggtggtctaaggacccaagctccctagacttcctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattacagcctagccgtctttcctgggccgagaggagcccatgcttcagtcaccagggactgtctgatagggcccacgcctgttagccatgccggccgacagcaagataggccgagtgcagagtgggcgggatgcggggtcctggcactaggcttttgtgcttaaggcacctctgctcactgacgacaaggtcaaagagcagtggttctccacctcagctgcttatcagaatcaccaggaaggtttaaaaagtcctgatgtccagaccctaagtcagaagc

SEQ ID NO: 26102 - DNA, 1052 bp, Homo sapiens
cacagcccagccctgaaggccatccgggaccgaaaggcacggctagcatgtgacctgctgccttgcaacagtgacctgcgggacctgctatccagctgagccgccaccctatctccagctgcctttaaagggtacacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcatcccacacccaaagataaattgcaagattaaagatctaaatataaaaacacaaaactatgtaagtattagaagaaagtagggactatgtgagaagctgctttctagctgaatgcccttggtaaaagtcactttagctgtctgcccctccatttcctcttctgtaatgagagtggttatcatagggcccgcctcagagtcattgtgggaggaggtcagtgtgcactgggagagccctcgagagagtgcctggcacgtggcaagcagcctgagggaggcccgcttcccgagctcctcatcagcactttgcgcataccatgatttcattgattgcaacggtccgatgggagaaaagtgctgtttcatctgtttcgtttttcattgctggttactagtgaggttgagcacctgtgtcttctgtgagctgcctacccatgccgattttagaaacacttcttattgattcataggagtgttgatattctagatcctgatcctttgttctatatatgtacatttaattttttccctttttttcttttatgctctttcttttattctttcttttttttttttttttttttgagacgcagtctcgctctgtcacccaggctggagtgcaatgacgtgatctcggctcactgcaagctccgcctcccaggttcacgccattctcctgcctcagcctcccgag

SEQ ID NO: 26103 - DNA, 1070 bp, Homo sapiens
aggctgccgcgcggccctcgtggttctcaccaggccccggcccaaggaggaggcgtggggccaaggagaggcggatgaacggggccccgagagcttggggcttggggcttggggcctggtgcgggaaggcgggcgggacccacggttcccgtgtactgagagcctcccagggccccgcacgagctcggccaggagacacctgtcccgcgggcggcggggaagcggaagcactggtttccgtaaccctcccgagtagcgggggacgacctcccctgggagacacaagcctgctcaggtgtttgagagagggcccggggagcagaatctgcaccaggggcattgcacccaacctgaggggcatggagctgcaggcctgggggctgcgcggtgaaggagagcagtggcctttgtttagccccgggtgccaggcagcctgcatgctttaaagatggcaagagcttcgcacgggcagccttcgaggcagggcacagtatctcatctgtgggacccagagaggtaacacgtttggcccagattatacagagattatggtgccaataggaacagaggaaggcgggaaaccagggtgcttcttgtgagcgttgggaaccactgtgctgtgtcatctgcccttgcggatgcagccctcgattgccactgctgtgtaagcattctcatggaactcttcctttaccgtggttctggcacctgcctacttccctccgcccctcctaccgctgtcctctgcactgctgaagtggttgcctcagagggtctttctgcttccacgcttgccttcctacagggttttctactctcacatagcagccagagcggctttttgaaaattagaaatcacatcattccctgttatggcctacaaagctctgtagacccacccctgccggttctacttctcctcctcattttatttctcatgcttttcttcccccaatcactacgccgcagccacactggtcttgttttggtgtctcaaatatgcaagaccttttcctgagttaaggccgttggacttgctgtcccatctccttagaatgaacttcctacaa

SEQ ID NO: 26104 - DNA, 1084 bp, Homo sapiens
agtacattcaagtttgatcatgaaactgcagaaattcagtcacaggctcaggctccagttttactcttagttctctccctagttccatcacactcacagttacttcctccactgaagtcttgaaaccctgcaagctatctatgagggctgaaatcaatttcttccaaacttcatattttgacctcctccaaggaatcacaaatatctttaatttcatctagaatagtgattgctttctaaaaaaatccagatgatttttaatttgccttgtgcagatacacagaagaatcattgtctatggcaggtataggcttacaaaatgtattcttaaataataaaatgtccttgatccatgggcttcagaatgaatgctgtgttagcaggcatgaaaacaacattaatctatttgtacaactccatcagagctcttgggttatgagtgcattgtcaatgagcagtaatattttaaaagatatatatatatatatatatatatatacacacacatatatacatacacacacatacacgtatacacacacacaaacacacacacacacacgttttctggacaataggtctcaacagtgtgcttaagatatttggtaaaccatactgtaaacgatgtgttttcatccaggctttgttgtttcatttatagagtataggtagcataggtttagaagaacttaaaaatgtagcagaatggtaaatgagtactgcctttaatgttttaatgtaaccagctgcattagccagtacataaagagtcagcctgtcctctgaagattagaagccaggcattgacttctcctctatagctgtgaaagttttaggtatcctcttcttccagtataatgctgttttgtctacattgaaaatctgttatttagcataactgccctcatcaatgatcttagctagatcttctggataacttgctgcagcttctctatcagcactggctgctttaccttgcacttttatgttatgaagattcttttcttaaacctcatgaaccaacctctgctagctttaaacttgtcttctgcagcctcctcacctgtgtcagacttcatagaat

SEQ ID NO: 26105 - DNA, 1032 bp, Homo sapiens
ctattttagaaacaaaaattatgctggattctaattaactcctaaaatggtcattttcaatgaatattgcagtgatttctgaaagagaaactgatcagtatctaatgcttgtagcagttttactttgtataggtatgtcaaaattgataattgatgatatttttattgaggctaatatattatcctttggtgccacgactggatgaagaaacttttggaaggctaaactagtggatacaagaaacttaggcagattattacaccatatgggtgtgagagataatgaatattatctacttggtatcagcaaacaggtgtccaaggtgatcaattcaggactcttccactgaagagatgtgaagtgtaagtttaactgaagtatcattgcaattgtgtgccttctcagttattgggcaatttaaagagcatgatgaatgtttgtagtataatggtgtaaatccttttgatttgttgcatgaaagacatgtgggatcatgtagcacctgctttcacgttgattctcaggtgtatgagtttctcctctgattttagatcactttgtcctcatcactcagcatatccacgttgatattgacacggttttattttagtttttggcatataacaaatcataccctgtttgaaattataagagtatttttcatggagcctgtattcccttttctcagcgtatttctgtcatgttctagtccccagacacaaagtagaagccatcaaagcctatgctaatacaggcaggaagacagaggttgatgctaacactgcgtgaatgtgtggataattttgtcatttttacatatgagtgattatgaatcccttttacttttcagtgtcttttgagcaaccaccaggcttgaaggtaatgaaactgtcatttatattgtgaactagtaaatgtatagtctatgaaacatactttattaatttattatttcatttcaaattccattcaggctacaagagacgagaaagattctcttttgaatatagccagaggaaaaaaagatggag

SEQ ID NO: 26106 - DNA, 1009 bp, Homo sapiens
aacctgtatttcttttttttcagtgtatttctgtcatgttccagtccccagacacaaaaatcaaagcctatactaatacaggcaggaagatacagcttgatgctaacatttcatgaatgtatggataactttatcatatttacatatgagtgattatgtatcccttttgcttttcagtgtcttctcagaaacaaccagcctcaaaggtaattaaattctcatttatattttgtattagtaactgtatagtccatgaaacatactttctttattgataatttgcttcaaattactttcagactgcaagtgacaagacagattctgctttgaatacagctacagaaataaaggatggactacaatgtgggacaggtaattttgcaaaacacatttaatgtcatgttcagtccagatagaaaagaacttctcttccccaaataaatcagtgggggggctcatcaaagctgcacattctgattcagcaggccagagattcttcatctgtaataagttctcgggtgatgctgatgctgctggtcttggacatgatcttcacagtaagattatagacttccccacattgaaattgggaagaagaaacattggagagcagatcaagacataaggggctcaggggacagcataattttgctttaattctacagcatgttttcaccaagggtggaaggagaatgagttgaagtatagattttacaaacgtcacatcgtattgataaaaacagacggaaaactgatcgtaataaccagtaaaaattgtagaacgagaactaacgagaccactgatgtagcaattattttcctcaaggaagagggttgtgaggcaggaaggagggaaaagatgaagttatttatgtaattttggggtttctgctgaggagacctgagtgaactcacttcggatgcatttagcatatttacacaaaaaagatttgattttggcagctccaggaactactggatgaagcaaagaaagctagaattgggataa

SEQ ID NO: 26107 - DNA, 1048 bp, Homo sapiens
tggacacgacctggggtgaggaaagggtggcaccaaggcacaggtgtcccaggtgcagccttctgagggctgtgtccctgtccccgcagcgagcgtgctacctgtccatcaacccacagaaggatgaggctctggagacggagaaggtgcagtacacgttgccagacggcagcacgcttgatgtaagtggccgggcctggcactggagtggcagccgatgcccagcctgggggaaggggtagcccgcttctccaggaagcctgtctgcctcaatcttgtacactaaaggtggggcctgcacgattccgggcccccgagctgctgttccagccggaccttgtcggggatgagagtgaggggctccatgaggtggtggccttcgccatacacaagtccgacatggacctgcgccggacgctgttcgccaacatcgtgctctcaggtggctcaacgcttttcaaaggtactgtggcttgagagttggtggtggtgagacgaggcccagggcagctggaccctcagagagtatacccctacccagagccatattctgttggctttttggtggtgctcaatgaacattttttttaacagaccaaaatttaaaattaaattttgtttactctgtgaatagaggagaagtttacacaagctctaaagtgtattgtgagagtcgagcaaggagcatgtgcggcttcatctcacgctgcctctgtgaggacgcagggcccgcaggcagccatggggctggatcatttctcagccttgcccttcatcctgggaagagctgctgatagaggaccagcagtagctgggggccctgaaggctgggtgcgggagctagcagcgaggaggccgggtgcagaccccaggctcagccagctttgtgttcacaggcttcggagaccgattactcagtgaagtgaagaagcttgccccaaaggatatcaaaatcaaggtgaggttacagaaactccccctggggcactagggcgctggcagccttggcatggggaggaaggttgaatgctgcccccagacccgctca

SEQ ID NO: 26108 - DNA, 1028 bp, Homo sapiens
tccaagaactgaatctctgatccagaagcgctggcagtggggtagggcgcttgactgagtgagagcagggtgcacaagggagccccgacccagcttcctggggttgtcctccctcagtctgtggatggtgacggcagccctgccccaccgaagtcaggagcgtgggctgagtcactgtggctgcaggaagccgaccctctgcaagggctgggccatggagggctgggttctggcgctcagacatgcagctgtctctgctgaccgtgccttctgaccctgagcttctcgtcctgcctaggccccctctctagccccgaaccccataggccccagttccaacctgtgccccccagccacatcctggtgtttggaggccaggtaccctctgggcgactatggttggatttcggtttttctggacacaagctctgccatgctccctgcccaccttgctgacgttatccgtcctaacagtgtcgggcggccgaagcacatgcgggtgatggctggagccctggagggggacctcttcatcggaccaaaagcagaggtaacaccgaggagcctgcctttccctgggggtggggtcctcagttgcaggaacatggcatgtgttcttgggcctctgctggtgacctcccgggtacctcctccaggctccagctgggaagtgctgtgcaggggcacctccccctgagatggggcagcagttcctcttctagggagcatgggtagagctcatcgtgtcctgtcttttagaagctatttggaagctacagaaccaagaactgatcaaaaagtgatataagagtcagaatcacacacacttcacgtctgctctaatgagggccatggggccgcctctcacagtgaagccggagtgtcccaccaaggggctgcatggcctgatcagaccctcaggagagcatgtgtgggtgtggggagagcagcaagctgagcttggccaagggcagtttaggcgcctgaggagcattgtgtcgggtgccggggcgtggggcatgcgtggt

SEQ ID NO: 26109 - DNA, 1036 bp, Homo sapiens
tgtgggttccctgagtcacagcaggggatgtttaataaggaggttagcactgagcttggggacgtgctgtcacaccagcaggacgctgcaggaaggagcaggctacttcctttcttgacgtgcaaataactcgtataggctaatcaacaggcttataagttaaaagggctaccgctcggccccttggggattccatcccctcctctgtaacttggagatgtttgtttctgctgcagactcagagggttgcgatgaagagtggtgggactgagttgagaagcttatcccttcgctgggtgggaggtttctaattgccccgttctttgggggatccttaagtccagcttccaggtgggggcagcgataggaccaagttctcctagtagtctctgggaagccacttgagggaagctgccggtcatcccatgcacccattggtcttctccagcaggccctgtaggtcgtccatgttccatgccttctgggttcttgggggagaaggaagctgttgaaaaaaaaaaaaaaagacccacacagaggggtttcttctagcttttgggagtagcatgtgctatggaatcctgctggagccaaccattagttgtgcagaggaaggtgcccttcgtggtttctctatctctatattattgacattctgggctagctccttgttggtagtgcaggctcgcctgtgcatcgtaggatgttgagcagcatccttggcctctgcccactagatgccaatagcatcccccactgcatgtcccctctccccagctgccagacattgccaaatgttgccagagcagggggatacaaaattgcccccaatcttgaaccataggtgtacttgtaaatgatcctggcagggtccctggcttcctccttggcctgccttgacggggcagccagctctctccattgcgggggactggcttcatctggtggtgcatgtgggcagctcaactttgtttttccttgcagggttcgggggtgattaaagctggctttgcaggagaccagattcccaaatact

SEQ ID NO: 26110 - DNA, 1046 bp, Homo sapiens
agaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacggtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaagccttgttttgtggttttttttacacacaaggtgtatttattaggattttctcacaccaaagtaaaccaccttatccttgccttactctgtggagctgacaggttaagacggggtttgccttctcattgctggaacttcctgcagtctaatggagttctgtgtgttcccatggcaatcatggagggtccttgatcgaaaacaacttgaaagcctgtttggattcatccagtaagc

SEQ ID NO: 26111 - DNA, 1029 bp, Homo sapiens
tgccaaggaatgggaatcagatctcaggcactgaaggtttctgcagaaccaggaagggcccagggcatccctggtttaggaccctgagtattcactgatccttttgtttttctatttgtttatcaacagtatatgtttacataaatgtaataatctaaaataagcaaaagaagtagattaatcatattatctgtaaaaatctgcttaaataacactctcaactcaggcccaagggctgtgaacaccacactgcacacgccagccccagacctgtcagcactcagaaaaccctgctccacagctggtcatgtccctagctgtgtcctcagctctgcctctctcctccccagacagaaatgtgtactgtgtattacaggaataaaaataggccaggcttgagtcaggtgtaacgttgtgaaaagcaaaaataaaaagaatacgaaatctcagaatattaagaaaaagaaaaacattattattaaaaaatggaggaaaatatattataaaaataagccaggtgtggtagctcacatctataatcccagcactttgggaggtcaaggcaggaggattgcttgagcccaggagttcaagatcagcctggaaaatatagcaagaccttatcttacaaaaagtttttcttttaaattagccaggtgtgatggcacacacctgtagtcccaactactagggaggctgaggcaggagttagagactgcatagagcccaggagttagagactcaggagttgagcccaggagttagagactgcagagagccgtgattgcaccactgcactctagcctgagcaacagactgagaccctgtcagtaaataaataaataaagcctggcatctgaaccacctgtttttcctttttaaaaagaatcacttcagtctgggcacggtggctcacacctgtaatcccactgtaatcccagcactttgggaggccaaggacggcagatcaccggaggtcaggacttcgagaccagcctcaccaacatcgtgaaaccccatctctgttaa

SEQ ID NO: 26112 - DNA, 1057 bp, Homo sapiens
agccagcaccatgcccacagcccgctggagcagcaccctcagcctcctctgccaccgccagtgcctcagccccaggagccgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaaggtaatcatctcccactgccggagatccgtgatgtgtgagggaaaagccagtgcgtgcttaaggagctattaagattatagttgtggtaaacaactaattcagtaggttcctctggctcagatttatctccagtgttggacttcaacttttccataaaaatgcaattagaggtatctgtcataaaagatatatttgtatttcttagattgtttaccaaaatcagaaattctgtggacatctgcttttcttttcagctgcctgagattgtgttattgtgatagatttagcttttgttttattgttaaaataattttgagcacaggagtaaaatggagatcatctgccttttaactccaaattaggatttctttactttagagcaggggttggcagactacagttagcgggccaaatcaccacctggttttataaataaagttttattggaatagaaccatgctcatttgttggtatatcctcagctttcatgcttctatggcacagttaagtaattgtgaccaaaacaatatggcccacagagctgaaaatatttgctatctggccctttgcaaaaaaagccaaccctgctttagagttctgcttactgtattaattacctatttctgagtaacagatgacctcaaaacccaggggcttaaaagaacgtatactcttatctcacagtttctgtggtcagggacatgagtacagcttagcggggtcccatggccctcacaggacacaggactgcagtcaaggtgttggccaaggctgatgtca

SEQ ID NO: 26113 - DNA, 1050 bp, Homo sapiens
acaacagactatgaggtaaggactttatggggattcatggcagtggggtttttctgaataagtcagtcctttcttgtctttatgaaaccaaagaattaagtttactcagagttacagtttaccagtttcataccttaaaaactgagctttcgagaatagtttatagaatattgatgttcataggctcatagttttttgataaaacccaaccctcctaacctaaaaagcaacttcagaagaatgcctttagcacgtttagaattgctttgttagaaacctgcttaaacagatggttatatcattgcacagaccccagctgagtgtcctgagttagatacctctgattgttcctacaatcataaatagcagtcagggtctaacatttctgaaaaggaagataaaatcaggagatcatgtcctaatctgagtgctcacatttatattttcatgagtcattcaaagtcaagggactaaaggttactaagcttttaattaaaatattctgtgtggagcttattttgcattcagtaagattttgaatggatgtatttctgccagacctaaatgtttttaattgtatatctaaaagctcttaggaaagtcaagcactgttaaattcaacaacttaccacctttgccctcatagatgttttcagtggacacaactcccacgtggaaaaaaaatgtaattataaaataaacagaattggccatttaataataaatgatttgttgagagtatgtcaggtgaggaattcatggttatcactcatgacagaaataagtacatttcagaattcagataaatttttgttaatatgggtgaaaataagaattaagaaaaataccctagagaagtagctttgagagttactaacagtatgggatgggattctaactctagaatgttcagtgcatttttaaaaattaggttgatgtctatttctgtatcaaaaaaaaagctatataactctagatatgctggattttacatacattgttttaggagtacagtttgactttcttttttaaaataatctatttttatag

SEQ ID NO: 26114 - DNA, 1207 bp, Homo sapiens
cttatgacatggaattaaataggcccatgtttgtcctttttcttattcactaaggagttttaggatatattgtaagtgaacatttttgctcttactgggtcaggcactatgctagtactgctatgtaataaatgtattacttaatacctatatggtgcagtggtcctagttttctagataggaaagctgagttagagctgcttttttttttttttttttttttggaagtgacttacacaactataaaaaatgcaaaaataggccaggcatggtggcctcacgcctgtaatcccagcactttgggaggctgaggctggtggatcacttgaagtcaggaattcaagaccagactggccaacatggcgaaaccctgtctctaccaaaaatacaaaaattagctgggcatggtggcatgtgcctgtagtaccagctactcaagctgaagcaggagaattgcctgaacctcagaggtggaggctgcagtgagccaagatcacgccgctgtgctccagcctgggcaacagaccgagactgtctcaaaaaaaaaaaaaaaaaaaaaaaaagaggtatgtgaaacatgaaagtatattatacagtgtcacttagcaatcacatctttatgaatatatcattttaattgcatagtctatttctgttaaaaacctatatatctgttaatataatacatctgtacctacatctgtacctacctatgtgtgtatcttttataatatccaaagcccaaactctgccagtgttttggtagttttctcttattcccgccttcattcacccattcaataaatatttaatgaacatcaactgtatgctagctgctatgctgactgagaatacagcagtgaatcagaccactggggttccctaccccatcaagctcactgtttatcagggctctctggaactctgggagatatttagattttattctaagtgtaatgggaaattattacaggattttaaacgagagtgacatcatctgatttatgtgttgtaaaaggtcactgtagctactttgtggagagtgaacttacagacatggaagggcagaaagcaaaggagaccacttgggatctgatttagcaatcagcctgagaaatgatggtggcttagatttcccaccttatcagctatggggcaagcccacctaccgtggaaactgagttttcagagctcttcttaaggtttt

SEQ ID NO: 26115 - DNA, 1023 bp, Homo sapiens
agaaccaaatatagattgtttacctgggaagacactcttacccttgtagtccagtgttactgtgtgtcactagtcttgtcaatattacagtaagaaaagattgtaaagcgagaaaatgtatatcgtttgttgattatacaacataaacacatgagtatgttctcctcaggaaaaaaatgttaacaattcaaacatgaatgaagcaaaaacgtccctttgaacttcctacttcccagtccagctgtccagcagaactttctgtgatgatggaatagttcctttcctgctttgtccaaaacagtagccgctagctacgtgtgactgttgagctctttaattcagctagggtggccaaaatgttatttcaactaatttaaatgtaaataaccacatgtagctgatagctattgcatagacagcatagttgcagtccaagcccttcctcgtggacaccacttttgccaccttgtatgtatcattctagacctttctcttgtgcatgcgtgtatgtgggcacagaaacatttattgtgggaatttgtttacacataatatattctgtacataatgtttggcttcctttttttcctaaactatactaaattagaacaaatagcactggactaaaaataaagaatgtgtcaggttcctagttttagtgtaattatttgtttgactttgtaatttagactttttctgtctctatttctttattcattttctctgttatcagtaggcgactttttaatcttctgggggtttttttggttggttggttggttggttggttggttggttggttggttggttggttttccagacaccaggctggagtgcagtggtgccatcttggcttactgcagtcttgacctcccaggctcaaccaatccttttacctcagtctcctgagtagttgggactacaggtgcacgccaccacacctggctaatgttttttatttttttgtagagacagactctcactatgttgcctaggctggcctacaactcctgggctcaagtg

SEQ ID NO: 26116 - DNA, 1046 bp, Homo sapiens
agtgccaggcacttttgtttttaccagtgaaaacagagatgcttatcatacatactctggggagtttgggtgaagtcagcagcagagggaaggcaagcatgataaataagtaaattttataagatcttagaagatgttacaaggtcagaagaaaagtataagatcagagacttaggtgtgcacagggaaggcggtaccattttaaatagggtggtcagggtaggctttattcagaaggtgacatttgaacaaagactcgaagggcgtgaggtaggactgtttggaggaaagtgaaatatatggaagaagagcattctagccggaaggaccaagcagtataaagtctccattgttgaaagcaggcctgttgtgcaaagacagccagaccagagtgagcatgggtgagaggagaagtaagggggcagactatgaagggtcttacaaactatggtttgacttgactctttttcctgaatgatgtggaaagccatcaaagggttttgaacagaggaatgaaattgtagctttaggttttaataggatcattgttcatcaaaaataggacaagggacaccagtcacattggctgttgtcatactccagggtaagaagatgattagatgattactctgaccagagtggtacgtggaagaggtgaagaaaggagttggacttgggatacagggataccttggagatattatgggttccgttccagaccactgcagtaagccagtcacagaatttttttgtttccccatatatataaaagttatgtttatactatactgtggcctattaagtgcagtagcattgtgtctaaaaaatgtacataccttaatttcaaaaatactttattgctaaaaactgctgatgatcatgtcagccttctgcaagtcgtcatctttttgctggtggagggccttccctcaatgttgacagccactgactgatcagggtagtggttgctgaaggttgggatggccgtgacagttgcttaaaataagacagcagtaaagtttgccacattcattgattcttctttt

SEQ ID NO: 26117 - DNA, 1014 bp, Homo sapiens
aacacttcaagcttcacctgtgttaaaggccagggtttttatttttttcattgctaccgtaatacagagactagaacaagagttgcaaacagattcttaaactgggctaggtaaacaatataaatgagggaagcaagccaagtgggatgtgggggtgtcctagagaacatgtgacccattcgaagagatcagcccccaccgggctccagcccagtggttaccatgttgggagtctaagcccatgtgcagttctgctgattcccaagaagagtcagaaataagaagtttcatgtatctgccagtctttacacattgaaaatcagttcaattttagaaagacagtatgggccaaacaacataggctaaaggctactaacttgacgtttctgaactagactctcccagggactatttctatatatgaatgttaggcaaagagaatagtttctctggaaattttttaaaagataaactaaatgtgtaggtaatcaaggaacaagttaaccaatctgttttgtgctgtcagatgatggaattaaacaataaaaataattacacctatcaaaatccacatttaaatagtcaagatttagctcaaaggagatagccaaaatctttactctctcctcttatccttttttcttcttcttgctttgcatctttttttccctacaataagacactgacttaagctcgagacgtagaggggagagatagaatgaactcttgggggaagaaataacctatttcctctccacttcagctttatgccaacaataagagccttggggaaagatgaatagagtttcttatgtcgaggagagcaaaatctttctgtatgtttactctaattgcctttgtcatgctcggaattcctggtcaggtcttatttctttgacaataaaacattgtctataactcagagtttttagttattaactgttatctgtacgttaaccaaaaagtaggaaatacagaaaagactattttttaattattgttcaaactaagttt

SEQ ID NO: 26118 - DNA, 1048 bp, Homo sapiens
gatcatttgaggtcaggagtttgagaccagcctgaccaacatggtgaaactccatctctactaaaaattaaaaaaaattagctgggcgtgctggcacatgcctgtagtcccagctacttgggaggctgaggcaggagaattgcttgatctcgtgaggcagaggttgcagtgagttgagatcactccactgcattccagcctgggcaacaggcaaaattttattttattaaaataaaataagaaacagccttaaaaactaggaataaagaataccacagaatactaaaatggtatgcaaagtctgaatatagaaagatctcacaccttaaacaaaaactaactcaaaatggatcatggacttaatgtaaaactataataaaacctttagggagaataaaactaagaggaaagcttcagcttacagggctaggcaaagagttcttgacaccaaagaattaataccagatgtgcaatgtataaaggaaagatcgatgaatttaaaacttgctctgggccagacgcagtacctcatgcctgtaattctagcactttgggaggccaagggaagaggagccattgagcccaggagtttaattaagaccagcttaggcaacatagtgagaccttgtctctagtaaaataaaaagtaagtaaataaaataaataaaaaattgtccaggtgtggtggtgtgcacctgtagtcccagctactcaggagtcagaagcagagaatcttttgagcctgggacatcaagcctgcagtgagccatgatcacactgctgcactccagcctgggcaacagagccagactggtctcacaaaaacaaacaaacaaaacctttctctgcaaaagaccatgtgaagatgtaaagataaatatagactaggagaaaatatttgcaagtcacacacctgacaatggacctagtttctggaatatagaaagaactctcgaaactcaatagtataaaaataaaggaaacagggaaaagagatgagcacacatttccctgaaggggaaatacagatggtaaaaacgacatgaaa

SEQ ID NO: 26119 - DNA, 1048 bp, Homo sapiens
actatctcaaaattctttttatgaattatctattacaaagggaaaaatacatctttgtgatgcaaagatctggtggatactacattaagcaagtgatccaatttaatatcaccagtagtgacaaattgaaatatcagtctcttgttagggttgcatgtcatttctatattattcttaccaaaaatatttgccctgaatctaatcatgaggaaacaataaagcaaatcaagattgtgggatattctgtaaaacactaggtcttgattctccaaaaattatgtcatgaaagacaaaaacttttgagggggactgttgtaatttaaaggagactaaagtgacaaccaaatataatgctgtaatgcatgatccttgattggatgctggactgaaaaaaaaggttataaaggacattttggggtggaaacttaaataccgactgtattttttaaatgttatatgtcagtattaaaatggttggctgtggtaataaaattgtgattatgtaggagaatgtctttgttcttaagggatctgtgctgaaagtatttactgggaagtgttgtggtgtctgtagcctgctttcaaatggtttgaccatatatagatacacacacacacacacacgcagacatatatatatttttttctcatatatatgagagagagagaaagggagaatgtgctgaaacaaatctgataaatacagttgttttaactattctgtaggttaaccttttctacagtaaaaggtgcgccaagaaaatacttccctgtttgagagtcaggaccacagtggctcttccaggccttgaccatggggctgaagcagttggttcttcaaacctgtccagctcttccccacctccccagagacacagatgaccttgtatcttagctcattgaaacagaccctccagcgtcagctccttctatttctcccttcttgtaacctcagtttgtgtctccccccacgtttctttacttcagtcttcagatagagcttttcttctcctttctcttctcctgttttcttgactttccaaggcat

SEQ ID NO: 26120 - DNA, 1024 bp, Homo sapiens
ccatgttttattaggctattttcttatttttgagatttgagagttctttatatgttctgggtaccagtattctggagatacatatttacaaggattccttccaagtctgaggtttgtgtttttattctcataacagtcttttgaagagcagaagtttttaattgattgaatcaactttaccaatttgctcttttatagatcatgtttttggtatcgtatctaagaaatctctgcctaatgcaaggtcacaaagattttctcctgtattcttttctggaagttttatagtggtaggtctttcatttagatctgtgattgattttgagttcattttacatatgatatgagttttgtacccaagttcttttttttttttttttttgcatataaataaccagttcttctagtgtctattaaaaagtcaattaaaaagactactacccttttcccactgtattgtgcttgtacttgttgaaaagcaattgcatgtacatgtgtgagtttatttctggttgtctgtctctcttttgttctgttaatctatttttctgccttgatgccagtaccacactgtcttgactgcagctgtattatagttaccgaaacagtgtcagttcaccaactttgttctgtttcagagttttgcctattcaagatccttcacatttcattatgaattttagaatcagcttatcaatttgtacaacagagccttcttgggtattgattgggactgtgttgaatctatagatgaatttgtggggggaactgacttcttaacagtatttagttttctgacacatgaacagggatattttcaccatttatttaggtctttaatgtagttttcagtataaaatttttaaagtatcttttgtcatatttatctctaagtatttcatatttttgatactagtttattaataaatgatatttttttaaaatctcaatttctggttcattgctagtatatagaagtaaattttatgttgatcttgtattctgtaatcttgctaaactgact

SEQ ID NO: 26121 - DNA, 1065 bp, Homo sapiens
tatttttatattgtggttttgtttttaactaaaactctttttaaaaagctattatatcgatatgatccctcatgagtattgatgtatcaatatatagtaattattatagtaatatatcattatatataatatatattaataatccctcatgaatagattaatgccctccccagggggatggggaactaagttctcacatttaatttccaagagagttcacctgagacctggtattaaaatgagcctgtcaccaccccccttgccgccatgtgatctgcacactcctttgccttctaggagtggaagcagcctgaggccctcagcagaagcagatgttggtaccacacttcctgtacagcctgcagaaccatgagtcaagtaaacctcttttctttataaattacccagcctccagtactcctttaaagcaactcaaatggactgagacatcagtttgctgtcaattaatttgatatttaaaaaaaaaataccaagaaaacttcttatggaattaggaaagttgctgttaaattttctatgaaaaaatgaaaatgtagaaatactgggaaaattctggaaaagttatgaggaatgactagcacaagcagttattaaaacttgctcttaaactattatgtaattggtataattagaataagtactggtatataaatagacaaattaatggaatagaatagaaattctagtaatagacctaagtatatatggtttatgttaacctacttttcttctgggagtctggaactttggtatgtgttaggcagaggggtaccgtgtggctagccccaagtaaaaaccttgggactctgtgttagtttcctattgtgcctgtagctaattatcacaagttgagtgggttaaaacacaagtctattctcttatcattccaaagggcagaagtctaaagtcagggtgtgtggctgactgccacagttatggtttgagacaatcattacagcagttaactcctgttattgcttgagactgtcattactgcagttactactggagaccatcattacaagactgaacgaagggacgaac

SEQ ID NO: 26122 - DNA, 1083 bp, Homo sapiens
cagtggcctgggtgaatcagatatcctttgtggcccatgcttttctgtatgaacaatttgtgtgtgcggttatccaagatattaatggagatgatgctgatatagaacataggcctctacccatcataaacagatctggttctaatcaaatattctgtgaaggtatctccagaaatggcttctcctttaaaactgatcatattccagtattgtttctgagtaagtaggggaaaagcaatttattttcttacgtgattgtgacactgtgagtctggcatctgatgaggcacaaatacagtatttgtcctaaaaggtactgttgagtttttcagcaagtttgggcagatttctgaagatggctgagttcagtttgatcattcacacccggaggaattttgtgtctattgaagtagcataaactagtttaaaatttcaaagttaagatttacctgcagttttaatgatgattctgcaggtattttgtatgtttgtatttcttttccttcattactgtataatttcactgcaaaatctttaaaagacaataaaactcattgtctcctgaagaaaagctgcagaaataaattacctaatgtagtttttcatgtttggacttgatgttgattttcttgagtcagaagcatggaccattccttgtcttaacatcctatatgacttaactgagctatgggagtgtgctatcactagtccagaggaaaggtacctttgagatggttttggctgtgatgtaaagtttgtaaggactttgaaagagtttccagagatagaagttgttataatcactacaaataactagttctagattggtggcaagattttgtcttgaggctaacatctagatactgagaatagcaaaaatgtgtgtgagttgtgaaaatatatttttaaaatatatagtgaaaatacatgtgtatgtgtatatattaaatgtatacttttagtagtcttttgaattataaagcagcccattatgactggcaaataagaccttttttaaaaaagcattatatatcatgtaatataatttcattgtgaagtgggtttttggaaggcatttattat

SEQ ID NO: 26123 - DNA, 1045 bp, Homo sapiens
ggagagagagaacttcctttttcagggtccacaaatcaaatctataaaaggactctggtcttcccaggatcacctgcccttgcattggaccagtccctgtggaagaggggatgggggcctgtgatcttggccaggcctgggctatctatctgcactgtcattgctaactcctgtcagaatcacatggatgagtagtgggctgaatcccaaaaggaaaggggtttagagcaagtggaaacaacagatgttcactatagaaagcaagaatgaaaaccatgaagtggttgaagattagccttacagtaattttattctgatcacttaatacagtagagtcaaacaggaatccaagtttccaactttattatttttggcactgaagaattacaaagaactctagcgtctttatacctccgtggttcactggagttaaagcaatcggggcgttgtacagctcacttgagtttttaaaggttctactaaaaagtgagaattccacagcaatatgggtcattgttgcagaatatcacaaaggtctgttgtgtatactccttttcaccaggaaagggacaataatagtttttttcaatgtatatatatataagtgatctaactttttattaataaaagtaaacaactctaaaatgtatattataaagccctgtcatctttgttgagtaatagctttattgagctttatttggagaaatacacataccgtaaaattcacactgaaacttaccaattcagtgttttttattatatctacagagttgtgcaaccatcaccactaattccagaacatttgcatcactacaaagagcaacctgtacccattagcagtcacttcccttctccctcagcctctaaaaaccactaagacactttttatataacatgtagccttttgtgactggcttctttcacttttaccataatgttttcaaggctcatccacatgtagaatctatctgtacttcattaccttttgtgaataatattccatagtatagatgcaccacatttttttatccattcatcagtt

SEQ ID NO: 26124 - DNA, 1026 bp, Homo sapiens
agaaagtacactgagtaggactgaggaaagaaactccaagtggaggacaatagcagcagcacagagaattccaagctggctttctgcagcggttgatacagcaaacatgtacggagcgccaggctccagttcagggaacaaatactgatgaatggaacatggtctctccagtatagaaagcggagctgtttggctagaatgctgtaggcagagattatggttgggacagctggtacagactttgcttttcccgccattgaatatgtggccttaccagtgctcagtttggtcagccagaaaacgtgatgcttataagcagttctttagatggaagttcgtatacagtttgtgttaaattcattctgaatgctgacttcagctggattgtaaaagggcaatagtgaggaggtttgcaggtccagaacaatctcctacaatctgttggcagctactgcccactgctcctcactggggactctgaaagaccaaggaaagctctgctgaggtctgtgcttgctctgtgtggcaaccttaattatgatggaaatttttgatttcttaagttcttgaataaaaaggttaatctgatcctatggcaggttggtgctgtagtctcttcttgccagtctttaacccacctgaaacctgcagcacctcgctctagggaggaattcaacataaacatgtatttagttctaggtgctgctttgggagactgtcaaggagttagagggcctcagagaaactcagggtaatggtaaggatgtaaattccagtggggctggaggaaagcagggaaaaagcagattcaaaaggcatctcttgaagagacttcttaggatttaatgactcctggatgatcaggacaatgaaactctgccagaggaacttcactcatcatagggtatcttcgtctccactaacagcttccagatccactgactcttcatcagaatcacctagaagtggtgtggctttttaaaagtacagattccactgctgccctcaccctacccccaataagtt

SEQ ID NO: 26125 - DNA, 1029 bp, Homo sapiens
tttttcgtgtatatgtgtttctgtgatgacttatgtgtggacttcagatggactctggagaaatctttgagctatttgaagcaattcgtgctcttaaaccttatttataatacagaacatacatagtttcctagtggatactttaggagtatctggcctgtttcttctctgagaaatcctggtcagagtaagatgagggcaagtgatctctctttctgtgctcttctttatctgataattaaattgacatatgtatctaattgattgcctctaaatttgcataatttttctagattagcatactttttcatttagcttcacctgttttaaaaacacatgaattcctctcatctccagatccactgcctcaccttatttataaagttgcgtgctccttctcctcctgctgataaactttgcattatgtcaccctgatgttgaaactcatggactagtgtagataaaaaataaatcaccgataaacctgatgccaagtgatttctactaacattttttgtttccttctagtattttttccgtgaatgtttttcttcaaaattgttattgtgtatgatggcctgattttcactcttgaaattatactatgagcattttaaaactttgtcattaatcttcaaaatattatttttagtggctgtgaatgtgccagctatatataccacaatatattaaacatttttttctacagttattcaaatgggtttttctgggttgtttttcccccctagtttataactctgatgaacatatttgtatataaagcaatcatatttctggtaacctttaagttattttcattagattatgatcttcttagaaataggatctgtgttttgatgacttcatttttgaacaaatgatacatttgctggaataaaatagataatcactaaatatttgttgaatgcatagaagctaaattcttaaaagggaaattactgagtaataggacagaaatgttttaaggtttttgctgctgttttgaatagttggaacatttatcttgtt

SEQ ID NO: 26126 - DNA, 1065 bp, Homo sapiens
tttgatgttgcaagattccttcctttatcatttcctttcttttttaagaacttcctttagccattcttttcagataggtttgctgatggcaaattccatcagttttcttttttataagaatatcttgattttccctttattccttacagatagttttgccagagatggtatttgagattgacagttctttttcttttcttttagtgcttaaaaaatgtgccatttccttctgatctccatggtttctgatgagaaatttgctgtaattcaaaatcttttccccagtaggtcatgtgtgttttccctctggttgatttcaagatttcttctttgtctctagttttctaacgttcaattgtggtgtttcttttcatgggtttcttcaggtttatcctgtttgggttttgctcagcttcttgaatctttatgtaggtttatgtgttttaccaaatttgggaaattctagctattatttctccaagtacagtcatgtgtcactaaatgatggggatgtgttctgagaaatgcatcgttaggtggttttgttgtgtgaacatcatagggtatacttacacaaacctagatggtacagcccactacacacctacgtactgctcctaggctacaaacctatatagcatgttactgtactgaattccataggcaattataacacaatggtaagtatttgtgtatctaaatatatttaaacatagaaaagataaagtaaaaataccgtataaaaggcgaaacagtatacctgtagagagcacttaccatgaatggagcttgcaggagtagaagttgctctggatgagtcagtgagtgagtggggagtgaatgtgaaggtctaagacattactgtacaccactgtagactgccatagccttcacaaatactgaactaaggatatactcagtttataaaaatattattctttcttcaaaaataaattaacctggctaggggtagtggctcacatatggaatcctagcactttgggaggctgaggcgggaggatcacttgagcccaggagttcaagaccagcctgggcaatatagtg

SEQ ID NO: 26127 - DNA, 1047 bp, Homo sapiens
tatactagcttaattttagtaatatataggagtgttgctcctatgtaggtctgttcctttttacccttttggggggtattgttgtacttattacatctgttaatgttgcaaaccaaacaatatattgttataattattatttttatgtgttattatttccttagcccattacagttttatttccacctacctcctctgtgctattactggcaattatattactgatatatttccacacgttatagacccagcaatgaattacataaatattttataccattgactttttaaatcgttaacagaaagaagaaaaaaatacattaatagtgtatattctaatttcataattattgctgctttttgtgtggatttgaaccaccatctggggtaacttcctttcagcctgaagaatttcccttagtgtttcttataaggcatgtctgctaacaatgaattccctcagtttttgtttatttaggtatgtctttatttcacctttatttttgaaagatagcttttctggacataggattcttggttaacaaggacttttgttggttttgaacactgtgtgattgcattgcctttgtcctctattatttctgctgagaagtcagctattaatcttatggaagttcccttgtaagtaatgtcatttttctcttgcagctttcaagattttcttgtgtttgacttttttcatttccaccatgtgtttgtgggtctcttttattgaccctgtttggagtctgttgagcttcctggatgaatagcttattgttcttcagtaaatttgggaagtattaagtcattatttctttgaattattttcttctcctttctctctcctttccttctggtattcccattacacatgtggtggtgtgcttattggtgttccacctttctctgaggctgtgttcatttttcatttttttctccctcttgagcttatataatctctaccgacctgccttcaagtttgctaattctttctccattgtgtacaaatctattcttgaggcatgtattagttagggttcatca

SEQ ID NO: 26128 - DNA, 1038 bp, Homo sapiens
agggtccaggtcttttgacccttatatattgtattctgtcaattttcttattaaaaaaatttcctattattgtgcaataggaaaactggagagagtgaagattatgttactcaggaaccattgtgtgatcattagagttctcatcttggaatctgtgagctccacttttccctttaaaatcagtcaccataactttctttttacagacaaaacaaaaccaatgaggagggaatatagtttgaagctgttttgtatttttttccaggaggagaaggaccatataattccagtatgttaaatgagtagtttcgatgtagggataatctttatagatgcaatttagccctgccaaaagtctgtttataatgatgaatagtaaatgaagaaacttacattttgcattaccgaatgagcttgactttctcttttcccctgaataggaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaaggtaaggaaaatgactcggaaaatgtgcatgaaatgtactagggtttttgcttggttaaggtgcctaaatgcttaggtcaaataccctggcaatctgcatgttacatgctatctgctggcagtttctttctgatataaaaatgaaacagtattcttggacagaggacacagaatttctaattccagtggggcttgttttgttttcagtttcttataattgtacttggagaaacagatactgatcagtgttttatattctaaaagacagcc

SEQ ID NO: 26129 - DNA, 1032 bp, Homo sapiens
cacgcacgcatgcacacgcccacacacatgcacaaacgtgtgcacacagaggggacaggccctactcccacccctgttctttttctcacctagtcccccagactcctttgaaaagccagaggaggagggtattggaggtgtggttgctgggtgggttttgtggcctgcctctgccacaggggtaccagggcactcctcccactgagcctccatcctcctgcctcccctcccactgagcctccatccccctgcctcccctcccactgagcctccatcctctgcctcccctcctactgagcctttgtccccctgcctcccctcctactgagcctctgtcccctacctcccctcccactgagcctctgtcccctgccttccctcctactgagcctctgtcccctgcctcccctcccactgagcctctgtccccctgcctcccctcctactgagcctctgtccatctgcctccccttcccactgagcctctgtccccctgcctcccctcctgctgagcctctgtccatctgcctcccctcctgctgagcctctgtccatctgcctcccctcctactgagcctctgtccatctgcctcccctcctgctgagcctctgtcctcctgcctcccctcctgctgagcctctgtccatctgtgtcccctcctactgagcctctgtccatctgcctcccctcctactgagcctctgtccatctgcctcccctcctgctgagcctctgtccatctgcctcccctcccactgagcctccattccctgcctcccctcctgctgagcctctgtccatctgcctcccctcccactgagcctccattccctgcctcccctcctgctgagcctctgtccacctgcttccccactgagctaagacttctcagacatacttcttaacagcgccagcctcgggcctccagcatcaggccaccctggcctttcagcccttttctctcatttcctccatagatgcctttttttttcactccagtctcactgggcccctctgactgctgagcacat

SEQ ID NO: 26130 - DNA, 1018 bp, Homo sapiens
tctactaaaaatagaaaaaaattagccgggcatggtggtgggtgcctgtagtcccagctacttaggaggccgaggcaggagaattgtgtgaacccgggaggcagaggttgcagtgagccaagatcatgccgctgcactccagcctgggcgacagaccgagattctgtctcaaaaaaatatatatatataatgtaacagtattatttcatcaattgtaacaaatataccacattaatacaaaatgtaaataatagaggaaactgtgttgaggaagagagagaggagtgtgtgggaactctttgtacttcctaatcaattttttgtaaacctaaaactactccaaaaacttagtctgttaactacatgagagaaaatatttccaaattacatatctgaaaagggcttaatatctagaatatacaaaggactcctacaattagcccctttccccccagaaaaatctaattcaaaaatgggcaaaggacttgaacagacatttctccaaagaagatatacaaatgtcaataaatacatgaaaaagatgctcaacatcatcaaccattaaagaaatgcaaatcaaaaccatgagataccacttcatacccattagggtggttgttataatggaaaataacaagtgttggtgaggatgtgaagaaattggaacacttgcattgccgatgggaatgtaaaatggagccaccttggtgaaaatcatttgatggtttctcaaaattttaaagacagactaataatatgatccagctattccactcctaggtatatatcctaaagagttgaaaacacggactccagtagatacgtatatacaaatgctcatagcagcattattcacagtagccaagaggtagaaaaaacccaaatgtcaacaaatgaatggataaacaaaatatggcatgtgcttacaatggaatataactcagattcaaaaaggaatgacattctgatacatgctgcaaaatgaatgaacctcaaaaacatactaagtacaataagc

SEQ ID NO: 26131 - DNA, 1043 bp, Homo sapiens
ggagaaaatatttgcaatctacccatctgacaaaaggttaatatctagaatctataaggaacttaaacaaatttacaagaaaaaaacagacgaccccatcaaaaagtgggcaaaggatatgaacagacacttctcaaaagaagacatttatgcagcgaacaaacatgaaaaaaagctcatcattggtcattagagaaatgcaaatcaaaaccacaatgagataccatctcataccagtttgaatggcgatcattaaaaagtcgggaaacagcagatgctggagaagttgtggagaaataggaacgcttttacactgttggtgggagtgtaaattcaactaatttgtggaagacagtgtggcgattcctcagggatctagaatcagaaataccatttgacacagcaatcccattactgggtatatacccaaaggattataagtcactctaaagacatattcacatgtatgtttattgcagcactgttcataatagtaaagacttggaaccaacctaaatgcccaccaatgatagactagataaagaaaatgtggcacatatacaccatggatactgtgcagccattaagaaggatgagttcatgtcctttgcagggacatggatgaagctggaaaccatcattctcagcaaactaacacaagaacagaaaaccaaacacagcatgttcttactcataagtgggagttaaacagtgagaactcatggacacagggaggggaacatcatataccagggcctgtcagggagttgggggcctaggggagggatagcataaaaaagaaaaaataattttttttaagaaggaacattgtttcacttgccttctctgagaacggtacaggagcacaagttccattctaatgatgagattgcagcaaggttgaggatatttatgtggcctgaggtagggaagctggcagaccaggcatgggaatttcagatacactgatgtgtctttcctctagtgatattgcccccaaagctggtggagggaggatagcaactccagcatgattggttagg

SEQ ID NO: 26132 - DNA, 1024 bp, Homo sapiens
acatggctcaaggtgataaagggggtctgtgattccaggctggggttagagcagtgggaaacgtcttccaaccagtgtacattccagggcactgaggaaagcgtggtctttcctcaaacctgaagaagaagggacctaaattccaagaagtcaccaatacaaaattctccttttgataatggagataataaaaaggctcttgggatgaggtatgggcatcagaaatttgcttttcagggtctggagccaggtcagtatgtttcttggtggttgagattcaaagtgtcttgccttcttgaaataaagtagttagtaacttgactgtatgttgagttcctgtgggctgagtaagagtcttctcatttttagattaattgaaaggatgaatggagcacttacttgtcctacttttgcttttttttcactatgattcaaataattcattttcttaggtcagatatggggaaatttgttcttttcacccctgcttctgtggaaatattacatgtggttatgatgatgactgatatttttgtattctcaagctaatttttgttttaaaagtgtttcaggagccgtagagccagatcgtcatcatgtctgcattgtggctgctgctgggcctccttgccctgatgggtgagtgtggctgatttttacaaatgactttggagatgggaaggataagcacaggaacacaatggcacttctaatacttgaaaatgcaacaaaaaagattattttttccctaaactgtccaacaaatcctggagttaggaacagccaccaacaatcagcctctccccaaatgtcccacaaaagattggggttctctggaatgcaaggtgggcttaaaacagcactgcttgaagccagactttaaatatacaccatcaatagctgctcattgtccactataaaaaatgccaaattgaatttattcctaaagcatttatttccatagaagaattgaggtggttgccagaataagactaatgaataagactaattcaaatagaaaacc

SEQ ID NO: 26133 - DNA, 1030 bp, Homo sapiens
taccaaaaatgcagcacatttagttattacgtctttagttaccattgttattctttggttcttaagactgatgtttttgaagagtacaaactgtttattttggagaacatctcccagtttgggtttgtcttaaatttcctcaagattagattcagattatcgatttttgacgggcatattatggaagtgatgcatcatatcgggaggtgtgtgatggtttctctcatttccggtgacaactgagcactgtgttaaccaaatgttaatccataattaatgataaaaaggaaaataggtctggtgcagtggctcatacctataatcccagcactttgggatgccaaagcaggaggattgcttgagcctaagagttcaagacaagcctgggcaatgtagtgagatgtcatcactacaaaaaatgtaaaaattaactgagcatggtggcacacgcctgtagtccaagctactcgggaggctgaggtgggaggatcgcttgagcccaggaactggaggttgcagtgagctgtgatcacaccactgcacatcagcctgggccacagagtgagaccctgtctcaaaaagaaaggaaaataaaattgatctaaaacattcagtaggacacaataaggtttaaggctattaaccatcaatatcaatataagcattatacctcttccctgacaccagcattttaaagaaattttattctatgttacaggaagaaaacaaagatagatttttgtgcagtttagtatactagtactaaatcataaagaataaaatgcttttttttttttttaagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcg

SEQ ID NO: 26134 - DNA, 1059 bp, Homo sapiens
tggcagtccccagaagttaattgatgggtttctaaaacatgaaggacctcctgcagagaaacccctggtaattccttaactttgacctttatgagatcttaatatacctggataatgtgtgaatatagcaattttatcctttgttttcttaacaggaagaactctctgcttctacttcaggtgtgccaggcctttctagtttgcagtctgacccagctggctgtgtgagacctccagcacccaatctagctggagctgttgaattcaatgatgtgaagaccttgctcagagaatggataactacaatttcaggttggcttggcctgtgttagatggcccaaggctgagatgtagtcgtctcatgatttgagaacataaacagactaaactatgcagatttaacccatttctctaactctgataagcttaaagcagctacccccaaatcttttaaattctgggacttgctttgaaaagtaacaaagcccattcctttgatagctgttagtgacatagttgtagaaatgcagttttcctttatccatgcagatctctgactttctccttcaaaaagactggtcctcatttgaagtttttcccccttcctagatccaatggaagaagacattctccaagttgtgaaatactgtactgatctaatagaagaaaaagatttggaaaaactggatctagttataaaatacatgaaaaggtagtaattcatcacttttatcaaatgggaaaaaatggcatgtcacaatggctgagggtgtactgagttgttttaaactttctgggaaactgtactcattagggttaatgagaaagtgatatcctttattttgccatgttgactaagtagcaaataaggttccaaatatgttgccctcaaggtcttacatgtgattaaaaaaccataggaagtgggctgggcacagtggctcacgcctgtacttcacttcgggaggctggggtgggtggatcgtttgagaccagcctggccaaaatggcataaccccatctctactgaaaaatacaaaaaataaataatctgggggg

SEQ ID NO: 26135 - DNA, 1033 bp, Homo sapiens
aaattagagtttttctttctccctatagggatcttcagggaagaatattcatcttcagctgaaggatatgtcatcgaagactaatgtaggcaggatctgtattgggcattttctaaatttttatctgtatttattccttgttaatgaatggaaattttatggtggctcttgtctttgagacttgggtcactatgctttctcttgagcaaataacttgattaactgtcctgatgcccatgaacatcccaactttttgattgtaggatagttttgcattattgaatattgctaaaatgtgttaagtcgtctggacagtctttgtcttagtgaaattgcagatatttgtgaactagtcagtattttaaaaagcatacattctgggtttttcagtgtttacctctgtctgaaagagataacttagtgttttcttctgagaatcaattcttcccttaaataaggaatcactatggcacagaagctgctgtgttaaaaccaggactttatttttgtcatgggtagtagttcctcagctctgaaaggagtttttagaatgttaaataattgattttcatagagtagctttttaatgcattgttgattttatttcttggtcctcagaataatgcattaagtaaatatatatttatccctgctattgctttacaaatttatagtaatcttgtaacttaacatgcatacaaaaggaaatgatacaggaaagtaagtttatactaaagcaaaaattgaggggctgtatgctcatgtttgataatgtggtaggtcagattgtgattcctatgcatatgtatttagtttctgttgcgtaaaattgagagataagtatagatgttaactctagaaatacaaaaaaaaatttagtttttctttccccactacttaagtctgaatctagactcttgagttgcctctttcctacagtacgaaatcaaacaaaaaccatggaaggctgagttgactgctgctttcaggttgaataaatgtatcaaaatggtcacaaataattggcttttct

SEQ ID NO: 26136 - DNA, 1032 bp, Homo sapiens
cttggtgaaaccctgtctctgctaaaaatacaaaattagctgggcgtggtggcgcgcgcctgtagtcccagctacccgggaggctgaggcaggagaatcgcttgaacctgggaggcagaggttgcagtagacaaaggttacaatgagctgagatcacgccactgcactccagcctggcgacaaagtgagactctgtctaaaaaaaaaaaaaagtcaaataaataacattttacatattaaggattttttaaacctggagggataaagtcaaaggctcgtccctataacatcccactgattccttcctttgcactgtggtctcatgacctaaccactgtctatcaatgatatagtattgattaaaatggcttttaggtatgtgtctcttcaaaggacttggtcttagtatatgaagttggatcactcagagttgagctgtgttgtcactagagctagagtttttatctgggggcaatagttaggctttggagggaatggggaatttctgtggacaggaggagagttgaggggaaagcgatcttgctggggggaattgatttacttagaaaaatggtgttttccggccgggtgcgatagctcatgcatgtaatccccccactttgggaggccaaggtgggtggatcacgaggtcaggagttcaagaccagcctggccaatatggtgaaagcctgtctctactaaaaatacaaaaattagccaggcatggtgttgggtgcctgtaatcccagctactcaggaggctgaggcaggagaattgcttgaacctgggaggtggaggttgcagtgagccgagatcacgccagtacactccagcctgggtggtagagcgagactgtctcaaaaaaaagaaaaagaaaagaaaatgctattttccattacagttgcttgttttgcacgtgttctttttgccagatgcgcctagggagatcataagatagaaaaagcaacttagatagttaaaattcactttaatggattttatcttagtctggactgaggtttaatcatttg

SEQ ID NO: 26137 - DNA, 1185 bp, Homo sapiens
gatctcctgacctcgtgatctgcccgcctcggccccccagagtgctaggaaatatcatttttacatgaaaatgaatgttcctggtgataaacataattctcggggtagatagtaaaatctaccaataactatagtaaaaagaaagcagaataaagtttagaatgaactgatagtagtgtgttccagcaaaagataaaacattaggaaaaatgcatgcataagtagtcttgttatatttttaaataagcatgtccttgatgagactcttgatagagttttgaacatccctattgagagaatggaaagaggaagtcttgtgtaggcattcaggatccctgggctcctcatagacagagctgctctcccatttgccttaaccttacctcacctggctagttgttactgcatgttagcactggggactggacatggctgtattgacagcctgtaattcagttggtctttataatttgattacttgagttttagctggtaggtgagttttagcttgtgaacctttcgagggttgggagatttccacatgtgactgtcttacagagtcacatggaaacagaaaagaaccaagaaattttgtacttagtttttagttcattactcttagttatcagtctttttcaagttgtcgtgctttttcttcaagaacaatcttgttcagaccctaaacctaaaacttacgggggaaaaaaagcatggctgctaaaattgaaggtgggcttagagactggaaccttgcttgcttgctgtttttacccccaacttttttcttctccccaccatatccacccttcatccagtcatggccccacaaagattctgcagtcgaactttgttttatagatgaagaaatgttaggctcagtgctgttagactcactctgaatcacattgttaggcagtcgtagaattgggatttgagtccgtatctagtctactgttatcattatgttgtagaccatggataactgacttaaaataatgatgttctctgtgttatagttttcaaagggtttccacgtgtgtagtctcactcgattttcactctgtagactggcagagtagattactataacagtagttaatgtttattgaaggtgtaccctaaatgttaagggtaagggtacttttgcattcatgtattcactcttcatccgttttttaaactaat

SEQ ID NO: 26138 - DNA, 1033 bp, Homo sapiens
aagttctagaatgttgtcctaaacatctttttgtattttttatgaggcagagtcttgctctatagtctaggcctgagtgcagtgacgtgatgatggctcactacagtcttaacctcccaggctcaagcagttctcccatcccactctcccaagtagctgtggccatgggcgtgcaccaccatgactggctaattaaaaacaaattttttgtggagacaagggtctcacttcattgcccaggctgatctcgaattcctgggcttgagcagtcctcctgccgtaaccccgcaaagtgctgagatacaggtgtgagccactgcactcggcccttttatgtttttaattatgaatttttcttcttcctgaaatctttgccttcatgtcaccccttcccacctaccttctatcctaccttctatcctgtaaaatcctactgattgttcttagttcagatctacctctcagtgatgctttcttgggtgtcttctcgaacatgagatttatggctgttttctctgtgcatttattgcattccattagtgcctataatgcaggatcttgtattattattattattattattatttttacttttttggtcttgttctgtctcccaggccaagtgcagtggttcactgcagccttgaccttccaggctcaagcgatcctcccacctcagcctcctgactacaggtgtgtgccaccatgcctggctctttttattatttttattttttttgtagagatgaggtcttgctgtgttgctcaggctggtctcacgcaagagatcttcccaccttggcctccaaaaatgctgggattacagatctcatattatagttatatgcaaatctctgataaccttggattgtggtttattctcattttactcaccttgaaaactatagattatagtaaattctaagtgaatggagaaaaaccattagctcagacctggaatttggggtaaggggaagtggggggcaggacaggcgagattttgttgcctgtaatctttttgtttttttttttt

SEQ ID NO: 26139 - DNA, 1034 bp, Homo sapiens
agttgggagactccaagagtagagttttccaggaatcagacaatggccagtcaaatttttttgtttttgtttttttagggacggggtctcactgtgtcacagtggtgctatcatagctcactgtagcctccagctttcaggccaaagtgatcctcctgcctcagcctccccagtagctaggactacaggcacacaccaccgcacctggctaatttaaatttttgtgtgtgtgtgtgtgtagggatctccccatgttgcccaggctggtttcagactcctggcctcaagtgatcctcctgccttggcctcccagagtgctggtatacaggcatgtgccactgtgcctgggccccaaattctttattacacaatgctggctaaagaagtgagaacagacacttgctcaatttatgacagctaaaactagtagtagtgatagtaacccagttacctctgttgtattaaaaattggaacaggttgcatttgaatatggatagaaggattgccttctgttgagaattactacataacattttttttattgatacaatataatttaaaacttgggttattcacttgagttaaatgttttaattacataaattttgtagcttgggttataaactgtatacttgatactttaaagcttaataattggctgtaaaaaatctgaattttggtattggtcttgaatttgtacttttagatgtacgtaattattcattagttatttggaagaagaaattatgaagtgagatatttatgggtagggtggaggcattgataatctatttgtgttagggttgtaaaatgtttcagtaacttaattgctgttttgaattttagcacttgagtcaaagttactaacacttcaagtttactgtgttggaggttaatattcttttgcatattatttatgcctaatcttatttcagattgtcacttgaagattatattgaattatcttggaactcactgttcctcagagattatagtgtgctaaattgttacattgaataagacttctggtgtc

SEQ ID NO: 26140 - DNA, 1033 bp, Homo sapiens
aaaataaactgttgagaatggtgactggtgtttggtcttaatgtgtaagtcaggttttttatttttcaatctgtagaagatgctaagagtgattatctcaacaaccgcccaccagagtggcttttatagagttccctttgaagttcagctggagatctgattgtggtgatgaaaggacttgctggaggcttcgtgtcttcagacaggaaagtccttgaagatccagttgaaatatgagtcttgtagtatttgggaaggaaatttttatcatctttagttgtgttcagtttctcccttctttcactgggtttttcccctcagattatatttggttattaattggaacttaaagtaacccagctgtgctctgtatctttctgttcttttcataatgatttatttttctttagcagatacagaaataagagaagaaagaattgatggagacagtgactttgtaataatagatattttcagctaatacaacttgaattattctcataaactaagattctgcctgtggtaattgaacttgcataataccagttattttaaattcacttgtccttagtaaaatgcttctttgtaggattgttatttcatttctcagtctgaactttaacaagtaataggatcctaaaccctaggtgtaaatttttttttaaaagtcaaagggctgctgctttgtgtaacatttcttccaaaatttaataattgtgagttattatttactgtgtgctaggctctttcctaggtgcagtgtcttaattaatatctacagctaccgtataaggttggcaccattataaagaaacagatttagagaggtgttgttatttggctggttacacaagaaaggaggcaagatttcaggccagttcccgaggtcataaccggtctgctgtgggacaccttaaaatgacaaggtttttgtttggaagcttgccgttaaatttatctcattatttgtgagtgtgtgttgttaactactggcagcttcatcattatttatggctaattttttgtttttttt

SEQ ID NO: 26141 - DNA, 1019 bp, Homo sapiens
actagattgaacacatggaatgcaatgcaatgagactttctgcactaaaacttatcctcatatgtacaacaatgatgtgtgtattatataacagtgatgtgtacatttctgacaccccatacataatatacacagtttgtataaatgcatacatttaaaaatatatatgtacaatacagctaacataaaactgtagtacgcctgaaggatattactagtgcctaatattgagtatgagtcactgcgtgttcgcatcaacttggaagtgcagtaattgttataaaattaatcagtgcagccaacattatttatgaatcacatctttgaaactgtgcagtagcatatacatatatatttttaaataacatttttcacagttttccagagttactgttgaaatctgcatcaccaaaaaaaaaaaaaagcaagatttttttaacaatgtagacactcttcagacccagtaatctgcgtgtgatttcctatttgtagattcccaagagactttagcagtcaccagccttaatgcatgtacaggatattattgtgacttaatttatctgcagtttttaatccatgtgaaattggaatttataaacggacttggattaaacatgtctgcctttctaaggttgcaaatgttacattaaatgatttatgttgtaaatgagagaagttgagttgtacgtaaaagacatccaccaatttctgtgaatatttttacacggaaacttgagaatcaaaatacgttcaagtcagttgttctggctcccagtttataatctcgaaaagcaatctttttgtttcataaatggcttaaatgtagctcccacagattatcagtatgaagtctgacatttttcatggaaaagaagtatgtttttcttcattataactatagtttactatttgtctttgctatttcctgatacatacacatacgcacacacgcgcgcacatgcatgcacgtatgcacatgcacgctcccagtgtcccagtgaaggctcaacaggaagctt

SEQ ID NO: 26142 - DNA, 1058 bp, Homo sapiens
gctaactggaatcctggaaagcccattacctcacagatatactgagagaatgtttcactatgaacataacatttaaagcactcaactttctatccttaacatttttacagcctcatttcatttgagtcatttttctcacgaggctgtgtacattcttggtaacatgtccttttcaggtttggtatacacccttgtaaaatctgagcttaattctcataatagcagtttttaaatgaatgaattaatgcctaatttgactaggtgataaaatgggcaggaactatagcagagacttttgtaattgtttcattcgtcagcttttgagataattaactagagctggaggttggaagtattgagagagggttcctttctacttgctaaataccaagtgggtggttgcctgttctgggacaagatgttaatgcactttttcctcttcctcctgctaagtacagctaaactccatggatgttacatataaaacaaacataataaggctgaaaggcggggagaaggcaaatcagcttgggccttcgggcctgaggaaaagacatggtggtgacttccccaggtttccttttttccttgtatagcacagagtggatgctggagaagctggcaacctggcagtaggcacagacggaagccacaggaaagccagttctctgtagtgaaagggtcaggaaattcatatcctagcaagaataaatttttttttttttgagatgatatctcactctgtcgcccaggctggagtgcagtaacgcaacctcagctcactgcaacctctgcctttcatgttcaagcgattctcctgcctcagccttccaagtagctgggattacaggcgcgcgccaccacacccagctaatttttgtatttttagtagagatggggttttaccatgttggccaggctgctctcgaactcctgacctcaagtgatccaccagcctcggcctccccagtgtgttgggattacaggtgtgagccaccgtgggaaacttgtagacaataaccaccctattccagacaaacaccgtggggggaaaaaaa

SEQ ID NO: 26143 - DNA, 1029 bp, Homo sapiens
atgtgtcagccccagattcagaatttgggaaattctctcagtgcccctcaaatgttttaattttttttttgcttgtcaaaaaaagcatttttaaaatttaaaatcaggccaattattgcttctcatcatgagcacgagatttgaaggagtgccagaaactagcaggtgtctgtatattgcagcagggactccgtggtgaagttggagtcacctgggtttaacaagagtcactcagtccatgcagctgtatactcagcagcaaaaccatcttcctaaaattctgaagacccaatctaaatgttactactttgaatattttaatgcaatgctcagttctaagaacaatctgcaagttaaagaatgagaatcatattattttttaaacacaagtaataaaatgaacattgaaaaccaggtggatcgaagaataaatttttttaatgtttcatttttattgttcaaaaaagtttcaagtaaataaatagaacaggaatgtacttgacacagagagataataagacaggtgactctcatcctctgccccaaaagaaagctggaaaaatgcaaaacgagaacaagaattctccagaaaggtccaaaattaagggatctagcatgaaacaaacttttaaggtgaagactgtatcttgacttttctcaatgttctaatcctctctgtggagagttcagtttccagggaagctgaagtcaaggaggtgaaaggtagggtctccagtggcatggaattgacttccctgcaataaggagtgcttttgatgatgcaaaggaagtaatgaaaggccagatgccctgtggcctctgcttttagataagtgagaatctacagaccaaggagcaagtgggatgcacaggtctgagttaccctcagtgtttccagtttgaatggctactttcgtacttgtcagtctgcaaaacctgaactgaaagctgcctctcaaactgattctattgattgttacccccattttatcctttgatgattaacctcatcgcaggcaggggcagagt

SEQ ID NO: 26144 - DNA, 1058 bp, Homo sapiens
ttttttcttgtaaatttgtttaagttctttatagatgctggatgttaaacctttgtcagaggcatagattgcaaaaattttctcccattctgtaggttgtctgtttactctgttggtagtttcttttgctgtacagaagctttttagtttaattagatcccgtttgtcaatttttgcttttgttgcaattgcttttggcatctttgtcatgaaatttttgctcatgcctatgtcctgaatggtattgcttaggtttttttctagagcttttttagttttgggttttgcatttaagtctttaatccatcttgagttgattttttgtatatggtgtaaggaaggggtccagtttcagttttctgcatatcgctagtcagttctctcagcacaatttattaaatagggaatcctttctccgttgcttgtttttgtcaggtttgtcaaagatcagatgattgtgggtgtgtggtcttatttctgggttctctattctgttccattggtctgtatgtctgttcttgtaccagtaccatgctgttttggttactgtagtcttgtattatagtttaaagttgggcagtgtgatgcctccagctttattctttttgcttaggattaggattgccttggctatttgggctcttttttggttccatatgaattttaaaatagttttttctaattctgtgaagaatgtcaatggtagtttaatgggaatagcattgaatctataaattgctttgggcagtgtggccattttcatgatatcgattcttcctgtgcatgagcatggaatgtttttccatttgtttgtgtcatctctgatttctttgaacagtggtttgtagttcttcttgaagaggtccttcacttcccctgttagctatattcctaggtattttattctctttgtggcagttgtgaatgggaatgggaattctttcatgatttggttctcagcttgcctgttgttggtgtataggaatccttgtgatttctgcacattgattttatatgctgagactttgctgaaattgcttatcagcttaagaagcttt

SEQ ID NO: 26145 - DNA, 1051 bp, Homo sapiens
agatactaaacaatcttctaaattgcccctgttcctcatcctttatccaatttttcacaaatattgtttctggattaatttttctaaaacagatttcttgatttttctctcactttctcaaaaacctagtctagaagaggaggcaacatgcaaataaattaatagaatagcatgaggtgcaagccaaatcaggtgcaaagcaccgtgtagacctagaggaagttaatgtttcaaccacctggagggcagaagaggagtttactagatgaacaggagaggagagttgctacacgtaagaaatacagcactgtagaggcattcaagctaaaggaatgaaggtgggagggaaatgaggaggggaagtaatgagagcctagaagccgagccgaggagtttagcagtgacagaagtgctagttttcctgtgatcatcctggtttatgctcattatccccacacctttttcttggataaatttaaggactacaagtgctgttttgttatgggagtatattgtgtagtggtaaaatctgggcgtttagtgtatccaccatctgaataatgtagattatgcccattagtaatttcgcatccctcactgccctcccacctgccccccagccattgcccttctgagtccccagtgtctgtcattccacatactgtgtccatgtgtgcacattatttagttcccacttataagtgagactatcagtatttgactttctgtattgtttcacttaagataatggcctccagtgcagccagggatgttgctgcaaaagacatgatttcattctttttcatggctgagtagtgttccatggtgtgtgtgtgtgtgtttatatgcacactactttttctctgtccaatcatccattgatgggcacttaggttgattccatatcattgctattgtgaatcaccagcacttcttctggttagcattttagcacttcagaaatataccagtatagacagcaaattatatagtcagcatggaagggttttaagctggagagtgatatcatcaggttcgtacttttgagtga

SEQ ID NO: 26146 - DNA, 1033 bp, Homo sapiens
ttcttatcaatacataacaagaaattgcaactaatttggctcatgaccttcttcttttatcattaatggttgaactggtgtttgcttagccattaatgcattcagttcagtaaactaaagctgtttgaaattttcactaatccttttccattgagggtttccctggaccaaatcacttctgaataaaacaaaaaagtgaatgcgtgcacaggtttctcagattttccggatcaaacatcatttacagggcataccattttaaaatgcgattttttttttcttttcaaatcaccaatcccatagtactggagaatgaatgaactgtttactgaaaatatgaattgcatgaacttaccccataaagtgttcaagtactgagggctttttttcaatgaaaaaatgaaacaatatatagaataaaagtagaaaaaatggtttaacacctagctttttttttttttttgaaaagatgcttttcaaatgaatccgtctttgctatttaatttacattttgagggctcattaggatgatgaatgatgaggcaggagaataaaatatacttcctgaacaaaagacaatctctgtagcctaataacattttatgccagcacttacatttgtcagaagtggatgctatttatccctatgattatttaaaaatcatttttattgtcctttgtgctgtgtcctcttctgggaattttaattcagagtttgacacctacttattaacttccatgaagtatagagtacaaaggcctatactctataaagaattctaaatagccgtgtttatattgcctgcagctgtacacaaattagctcagtttggatttgtttctatcagaaatagaaagcctgttggaatagcgggtagcctctgcttcctccgtgaagtaagtgctctctgctgtctgcccccatctgaaccaagtgggacttgcggggtagacagaaggggaattttcctaattatgatacagcccttatgcataagtacattacttccatttcctttgcctcctccaactg

SEQ ID NO: 26147 - DNA, 1048 bp, Homo sapiens
agggggaaaatgagggaaaggcctttgtgtgtgaggtagggtaaagtggatgaatttgaatcacattttgaaaggcattgcaggtgggatggatgagcagatgttcccaataggaacgcctgtagactgttcagaagaaattgcccaaatgagccagatgagaaggctgagggcagggctgcttttggctctgaggactatagatttatcctctaggtgatgaggggctattaacggctggtgagtctggagaactgaacagtggaagctctattttaagattcacgtggcagtagaggatagaggtgtttggaagcggtgggcagttggcaagctatatgggagacatttctggcttaagaacacaaaaaatgtgggaatacaaatggatggttccagtgaatcccccaggtagagggagaggctgggattggaggatggtagaagcgaatatggtgaacccagccaccccctcaccagaatgtgtctcctctgggagctggctaatgtggtcttcacagtgaaaattgttggatgagtggtatagacatattatcctttaattaaacatctaactttgaaaatcttgattaataagcaggccgggtgcagtggctcatgcctgtaattccagcactttgggaggccaaggctggcagatcacttgaggccaggagtttgagactagcctggccaacatggtgaaaccccatctctaccaaaaaaaaaatacaaaaattagccaggtgtggtgttatgtgcctgtagtcccagctactggggaggctggggcaggagaatctcttgaaccccataggcagaggttgcagtgagccgagatcatgccactgcactccagcctgggagacagggtgagagtctgtctcaaaaataaatacatacatacataagcaaataagcgtggtaactatagttaatagcaatgtatatatcaaaattgctaagcagattttaaatgttcaagccgtacaacgaaagtacgtgaggtgatggatgtgttaaatagcttgatttaatcattccataa

SEQ ID NO: 26148 - DNA, 1026 bp, Homo sapiens
ttttagaatacaaataatggagatttttttaaagatttatgtttgaatttatattcttacttcctacctcctcctgcttttattcagtgattcatcatgaaactcccttaactgaggacgagtaaccgggttacttactgggaagaccttttatttgaagttgtattgtttcacgtagacggtctcagttccttcctccatgtcgctggggactctgatgtcttactctcctagctcctttaagtggaatggaaaaaactgaagtgtattcaaattgtgaggggatgcccaggtgatgctcaacaaccacagcttctcttgagggcagaccctgccaaaatagaaaagtggcactagagtattcaggtagataatagctctttgatatggtctatttatggggtcctagaaacactgatggtggagccaaggtctcaggaagttgtcagtcatcatatggaatgtaagattgtcacagtccatcattgggatggcccaccatctctgcacactttggaatgtttcagtccccttcttcctaaattgtacatgctactgtagtgagaatgtgtcttctcagtaaggttcatggtactttgttcttagtacttccttatttcagagaagatccttaaagaaaatacctgctcccctctcccttaaaagagttataaagtgcttatgaaatatttgtagaatggctgaatgagaataatgactataggtaaattgtttggctaagcacagtaagaaggggttcttccgaaagtgacatggccagtgtcccataggcaaaggtcagccataacaaataggtgatatttcatgttgcagtggtggccaccaagtagctgccccgccatgaataccatgttgacagggattctgatgggtcttcatggctctggagaatgccacatgtgcaagagaaggcagtagacatttgccatccctgtgctaatgcgaaacattagatgacctcccatgttcagacatgaatgtgctgggattttaagaggctcataa

SEQ ID NO: 26149 - DNA, 1077 bp, Homo sapiens
caatatatttttaaagcatctttgcagccaaaaaaaaaaaaagactaaatgaggaggaagatgaaatacaattggatttttgaaggctgttctccacacacagttctcagtttttctgcttttatttttcctttctgatgcctgtacatgataattttacctactaaagtcatgttcattttccagtggttaaaacatttgtcagtataaaaatatattctattctcctctcacccccagcagcagtgtaaagaagtttatgtttacaactgcctctatgtagagaattctcaatactctctgaatatgctagaaaaaggccaaaaggagagatttttgtacccttttaaagacattatgcttcccataagacactggaatgatttcatggaacagtgtcccgcttccttaaatgatgaagaaacaaacttgtataaaaaatttggcctgataattattcataaaaatatattctgtcactctttctgcagaatgttatttttgcattaacattaaatttttcttcaatattagactgtgctcagatttggctatagaagaattagacattttcaactggagcaaaagtcaatcctgtggacaccagaaatatgacaaatatagcagagtcctaagcatcttaaaattcatcttttttttgtatataacacacatatttaaatttatggcagtacttcttgttaagatgttaaacaatcataagaattttttggaggcaattctcactcaaaacatcttgagttcacagtagtaaagcgtcacagaagaaacttaacagttttctataaatttaattgctgccttggaataattatgtctagaggacagaatactctatatattttattatccatcagtttccttttaataggagtgctgtgctttgtacaggtcaattatttttgatagtttctgtaatgaatgtttaattatattttattatccttatttaactacatcaccttggtgataattgaagcatttctaaacactatacttccctacagtgttttgtatgttatacaattaccttgttaacatttccacaaagtttca

SEQ ID NO: 26150 - DNA, 1066 bp, Homo sapiens
agcctgacagtggtttattgtctgtcacagacagcactagtgaaagatctttctaacctggatgggccagttggtccttttaaaacttcatgccatctttggagactgtgctgcctcgtgagtgctctgtaggccaacaccaaagggccggtgtctttgtgactgcaccgtgtcattttgattctgtaaagaaatacaatgactccctctgtgttctgttttctcccccttccacagcacacacacatacataaatgaattttctaatttgacaggctgtggaggttcatttaagtgaaatatcatgctggattattgtctttagattttaattgatttctgcatgcaaccctaaggtgttaagcattacttcctttccagtaagagtgataaattgtttaacaataacaggggaatgacctcccagattttcaggggtctatgttgaattgaataaggtatctaattggtctctacctaaaaatgcgcgcgcgcgcacacacacacacgcacacacacacgtacatgcacacacacacacacacgtatgtccacacacagcctgtgaatgtgagggtgtctttgcagttcatgcagttacagacccctttcagatttcacaggcaacagaatgtatgttatcttcataacccaaggctttagcacaaggcctgggatttattaagcaccactctcagctgtttctgccgaatcttccataaattttaatttttgtgggtaggtgcttatattattttgttttatgcttaacctattttacattatgattcttatggcatagaactcacgttgcctcttcagtcacggcagcaacagtggtgaatttccatatagtatcaatgacttccttattccattttctgttcctctctcagaaactccttgccagaattacctagtgctgcactccaggtataaaaaattgcctcttgctcagttattgctgaaatgttctgtcatgaatagagatggatgatgaacacacatgtctctggaatttctttagtggtataattttgagttgtcaaaatctggcatatttaag

SEQ ID NO: 26151 - DNA, 1022 bp, Homo sapiens
atttccagtatgcaaatgcctcacatctgtgtatttgttttgctgcagacataaccaggaagagtttagtgatgaaatctgttcttaattacgagagcagctgttagagtggtagccattttttttcctcctgatgtgaagttgcctgatttactcatttttgcctgcatttttcaggcttgctagtgcagaacggggctgctttgtgagaggttgcaatttgttttctgtctgagagccagtgcaaatggactaaatctacacagcagggtggttttatctgtcctcctcacacactgcaagctgtcctacctcagctcagcaccagagacctataaaaccacccaacaaatgagggggctgttaagtgttctggcaagaatttcaggcagcaagcagttcctgtgaattaactagatccttgtgatggggttggggggttggtggggtgggcagacttggaccatatagaactggaacagatggtattaatacactattttgtctttagatttgtagatttttaatatgcatctttccatttctattccattatttttacgttcttagagctgtagcatgtttttgatcctataggttacccaaacaaagcaaaaacacatttagatgatctttcaggttagttcttaagcaaccttaatacttggtccaggctgccacagaaggggactatatttatttcctctcaatatgtttcctagcatactaaagtaaggacttcgcataaaactggaaatggaagctgagtgaaagtgatctctttcactgttataattttctactcaggactggatttagaagctcatagattcctttcctgtagagaagtcaatgaactgtttcactggaagcaattgatacctacatatcaatcttggatacattgtgtatttcttcactgtccatattatgttcagctctagccacaattgccttaacacttgaagtttcacattttaaattttaatttacactatgttgtgaaattaaaaaataaaaga

SEQ ID NO: 26152 - DNA, 1027 bp, Homo sapiens
tccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggtgagtctttatcagcaccgttcacatgcaactgcatagttacaagtgacaatttgaccctcgtgaattcagtttccatgtttcttttttttcagtgatgtggttaacttcatgtggtaggatttgtagcagtcactgaaaggggaggcagacttaaatagtgatttcttaaaatctcaaatttattataatttgaatttttagagttccagcaaatgcagttgtgtgtgtatgtattagttagggaaggaatgtccccttcactatagtttgagaattttcttctgaatagctagtgttcactgagggtataaataaaattaagaaataagtgaataagtgattcagaagtaagaaaagcacttaaaggctataatttcagtatctatttacctatttaaggtaaatttttatgtaaaagagttccaaaactcttaacattttcgtgttttgaaatattttaacacaaactttaccaaataaacctcataatagtttttaaattaattgtttaaattattcaactttgaatatggtgaactattcaaatgttttggaaatcctgtcctgtctcagaccatattccaaattgatgatggttgtgaagagtacatgaagaaaaaaatatgaccatgcatacatattttttgctgtgatattgtatactaactaaaattaaatgtgagttctagaacattatacttaggaactgttcagttttttctctttttaacatattctttaaagactgagtaacagtgtggccagaatattctttgtatcttaatttgatttaataaccaa

SEQ ID NO: 26153 - DNA, 1047 bp, Homo sapiens
tttgcttatttcttagactccccacaaccctggagacatatcagtagtttggatagttttttaaaaataagaataaaacattttgatgattctagtcaagggatacaattggcttcatatacccttgcctaaaagtctcctccatgggaaatgcagtttgcttggagcgagtgctccaagcaaactgcatttcatcagatttcatcaggctgcatgtggatgagtgcagtgggaaggaggtcatccccccctggctggctgggtctgctgaatcaacctgtgactcagccagagggcaggctgtcctggctccagcacctttctcaccagtagggcagcctagggagagattggagcaggctaatgaatgggtagcacttgataaaaatagtgacatcagtagccctcgctgggcaactttagaatcttatcattttttatttttttattcacttctctatcttccattccacaattctaggttacataggtctgctttgtgtgtgagctgtggaaagagactgatttctatcctttgtcagttgggggctgtaaaaaattataacagctgagactttattccagaattctccttatggttctctctgtctgactgggaaatagcttgccttatttcatttattcctgttttgcctctggggctcatgttaactacttctcactactgggcttgtcagacatcagggtttaagaggtgccaccacttcttggctccaggatagctcctgttctctgggcagagctgagtaaggtactttggacattgctgttccttttacacagtgtgtctttatgacattgttttgatgatcaaactcttatcctaagtttcttgatctttaaaagagttaacctagtcataatattcaccatcagtgtctttctccaaggggcattgtgaggataattaagggacatataggtgaaatgttttgagctcaatggaagagaaaagccatcgggctcatagatgttacttttatttagtttcatgctgttaccgtatgatcaagaatagatgaattt

SEQ ID NO: 26154 - DNA, 1058 bp, Homo sapiens
gtcctcttgacccgctgagacttccagctaagctgacaaactgcctgtaccaaaacaggtcattctctcttcacacagggtgtcctttcctctcaggtacattagtgagcttattctgttggtttccacctgtgttgtctccgtggagaaccgtgatggttggcctgtcagggtgattagctatcatgaggcatttggggccatacatctccttttaattcttcctttttgaaaagtcggttccatttatcttctttctagcctagggcttgttctctacctcacaggtaagttgattcagttcaatggatagcagtagttcaaggtgactcttagtccttttcagaaaccccatttcaaccacagcctatctccttagtagtcctgggagaaaaagaagtcgagttggattcgggaagagcatgagcctttttttacggctaacgttgagggtctctgggctttctgggtccgtgagactgaccaacctgaagtatggggattggatgagaggactcagacacccttctcccttctgacttcaggcaccagcccatgagcctgagtggccacagcaaggattgcagggaagggcatcatggttaaaacataagcatgttataaaatatgactcattgtgtagatagcttttaaaattcctaggagctgaagttcagaaactggtgctgtaaagtgaaaatgaaatttaactgagcatttgttggaggaaaaatagtttattggctctcccatgaaaagccctgagagtcagcatccttctcatcgcagacacctgtgattgatgacggccctgtgctgctgccgggaagggagctctttgaaatagcatagtagggactttgcaagtgggtctcatttggttaagttactgcctttgtgaggctctgctgcatctttatattctaccaaggagaagatggtaaatcagagtaattgcttcatcccaaggcacttttatattgtaaaggaaaaaggtcctgttaagaaactcaaattaacttctgctgtttatactatatagaaagactctgaaagct

SEQ ID NO: 26155 - DNA, 1048 bp, Homo sapiens
gtgggctcagctcgtattctccagctctctttcaaaatactttttacctcccttattagggctggtctaccccaggggtttcatccagggctggggtgggagtgggtgcgcatttaaacaaaggggcttgatgtctgccctaaccggcaggataaccacatttaaagaagactacctgaatgactatttgaggtggaagaaatgggctttgccgtggggagaaatcaggactcttgtaaataacttccccagcatttctaaaaacgacataggttgctggaaagctttgtgtcagtcacaaggattagcggagagcatgttgggcagtttctctgtctgggtaggagaggatgggagacagggaacctggaatgtggcattcttctggcaggtcttctttccgcgggactgttcccttgttggctgttactccacattagtcaatagcagcatccccagaagaggttgtcagcatcagctcctgcatggaaattggtgcatcagtcaagcccatctgcatctgcaggggcagtgtggaaatgtgaagcagggactgctgggagatgagggggtaatgatctgccctttagggtgcttggggatttctctcggtcagacaaaatcctacgtgcactgacgtttactttcctttaagaaagtgtgtttttgcacacttgtgcacagtgctgtgtagtggaccttatagtaaggatcttaaaattgaaacacactctgcagttacatcttttctagacagcaagtacaggaactctcacctaagctggcaagatgcatgagtctttatacaagaaacatcttggctgctctgtggcatggattctttctgggatctaaaaacaagaatattcgatccaggagtcttgaactgcaagacggcagtgagctatgatcaagacttcagtgagctatgatcgtgccactgcactctagcctgggtgacagagcaagaccctatcccaaaaataaaaagtaaaataaaacataagaatgtttatgtgacaatgtgaagaatgtgcttcatgggaat

SEQ ID NO: 26156 - DNA, 1030 bp, Homo sapiens
tttgctttgcatgctaacctgtccacaaaccagatttaacactacctggaatggcagagagacactggccagggtcttaaaggagaatctgagctgcctttgggtgtggctgtgtcttaagtagccaggtcacaccaagctccatcctacgggccccaaagcatttggacagcactatgcctccaaaggcacaaaacatctcatcgagggtgggaactatggagaaacaagcagtgcaaacaactgaaatataatattctgtgtttgccatcacttgagacatcatcagataaatgcattctgggaatttggccagaacctatcagaaaaagtaaaagctggaaacataaaatacagaatttgagattttccctaattatagtgaaatttccataattatttccctaataaacagtttttttggccactgttgttgccgtttctagaaatgggattattctggtctgacagtttctaggaaatataagtacttattctccaagctcttgtctggtggtgctctgtggaagggcattctttagtgaagaatcttaatagaatgttctgagaaagagaagcacacagcctggataataatttgttgcactttctgcatattgtttttctttaattctcagggctttaatataaagaaatgccccctcactagagggggcaaaatgattgccccaaacacgagctgtggttcttgaagacgtctttgctaaatgaagacactgatcatggtgtttcttaagagagttttagaagaggtggattggggagtcagggatgtttgccctggtttacctgggggccttgaattttaacttagttcatggtctgcttctgtttgcccatggtccccgtaaatgggtcttctgcaaacttatcccatcgcccacctacaaacatgagaagttagctcaggtccttcttgtgaaagctgtaatactctttggagcagagagctcctgtcttttctttctagagtggttgtatttatactcattgtcatctaagtacatgc

SEQ ID NO: 26157 - DNA, 1029 bp, Homo sapiens
cttaatgacagaatcagagggcatgagtactgaggtcccatgcgaccttaaaatatatgtgatataggctgggcgtggtggctcacgcctgtaatcccagcactttgggaggccgaggtgggtagatcacctgaggtcaggagttccagaccagcctggccaatgtggtgaaaccctgcctactaaaaatacaaaatttaaaaatacaaaaattagctaggcgtggtggtggacgcctgtaatcccagctcatcgggatcctgaggcaggagaatcacttgaacctgggaagcagaggttgcagtgagcctagatcgcaccattgcactccagcctgggtgtcacagcgagactccttctcaaaaacaaacatatatatatatatgtatgtatgtatgtaaatggtctccagcaggtacagtgaggtatatatggaaaaacatcttgagatttattttgaactttcaaactcagaatgaatagtatattgtgttcaagctattacagattttagactagtggaattctaattaaacaggcttcactgtgcatggattgtctgtagttcactgtcattaagtcctgctgtttttgttagtatttaaaatgttaaaaatacactgcctatataatttcttgcaattagttgtatactccataaaacctctaatttgacaaattttatggatgaagacaatggtaacaactgtttgccacatctggtcaaatctaccataacacctaaatgtaacttcattaataacaataatgatggtacagcaatacaatttataaaaccacttcatgaaagtcatctgaaattgtaaggtgattttttttttcatgtagatcattttgctgtttcttcttagaaatggaactacacatggtgtacaaatggtctgtacaaagtcagaccatctcttctagttgtatgactctaattctagaaagaagcattgcttcagtgacctggaaagagtaaacaggcttaatttatatcacgagatagttgggtaaagtaaaaat

SEQ ID NO: 26158 - DNA, 1038 bp, Homo sapiens
cctacatactctggttagtttgtttgtttatttatttatttattttcttcttgggggacatggtcttgctgtgtcatccaggctggagggcagtggtacaagcatagctcactgcagcctcaacctcttgggttcaaaggattgtcctgcctcaaccttctgagtagctgggaccacaggtgcatgccgctatacccggctaatttttttactttctatggagacgaggtctagctgtgttgcccaagctggtctcaaattcctgggctcaagcagttctcccaccttggcctcccaaagtgtgagattgcaggcataagccactgcacctaaccctgcatactctttgatcatctttttcttcttaggacaatcttgtgttggttactaaagagagaatgatatttaagttcttcctctaacatggatatggggcaaaaatcatagactaaaagtttcagttttcacaagtcattattggtaatgtcatttaaataggatggttgtcaaatctgggaaaacctctgatgaagtcttttatatgtgagttgtaaggatcaggcattttcccgcttcctcatgcagtgactaatcttaactccttcagcactgttggatgaaactttctgtgatgacggacattgttggaaataaagctcggagtcataaggaaaatgagtacttagacatgctctgtatttgtgctgtacagtatggtagccaccagccacatgtcacttttgagcactgacgatgtggttagtgtggctgagaaactaaattttttatttaatttgattttaacatttggcttttcctccagaaagctgccccctcccggccccgtggcccacctctgtgtccccagctgggcctccctccaggcccagtgactgtgtccactgactggggcctgagccagtggatttggtgaaaactaaccaaggtttattataaacaaaactgtccacctcactcacccacctgaatatgcttggaatgactattgaatcaatatgtttaaaaatgaacaggcgt

SEQ ID NO: 26159 - DNA, 1778 bp, Homo sapiens
aattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaa

SEQ ID NO: 26160 - DNA, 1038 bp, Homo sapiens
ttgtggattccgagaagtggcatgtgtgtctcagtgacttccagtgatgcctgccactctgaagagatgaaggagtgtcctggcaagacctggaatcccagctgtagcacctgtggagagatgtgatttagatttggatttggggtatctgtgaggaagagtcccagagtttttcatcctgaagggggcaactcttgggcagtggtccaacagttggccataaatgtgaagctggggcgctgtgctgaccagggcatccagcgttaagacgactgcctaactttggccacatgcgttgttttttgggttccgtttcgtatcagggcatgctggctaaaagatgggaagcagcaacattctcttgggctccatcatttatatgagggttggcaatgccatctgtaccctctgtgaactcccactgctgttcactcagttaatctaagggacaccaaggggtctgcgggaggatgacctcacaagggactgaggacatgggagaccaccctcctgtgggtagaatacaccagagggcccaggcttgactctgtcctgtgttaaggaggcatcggtagttttgctgagcttgtcaggtgtttataatggacagttggagattggggtcctaggcttaggtctttgagagcctctgtgtccaggagagcccagtaggcatccagccatttactgctttaatagggtagcatgaggctgagagggatagtttcttgcatccaaagcccttaggcaccttatgtccatcctaagtgggccagagactccagggctgcatagagcttgccagagcttctataatgaaggggtctctgagggcaccaacaggagtgcccatggattttaaggtttgattatagaggttgtttatggagggtgccccatttaaagcaagctgatttgtaagcagcagcaagaagattaagtaaaatttgtaaatgaggactacattgccatcagaacctcgaaagtatctaaagatgttggacttgtatgtccttaatgagtgtgacaatgagtttc

SEQ ID NO: 26161 - DNA, 1033 bp, Homo sapiens
gttgtaaattgcatgttgtaatcaaacgaatgtcaaaacataagaaagtataccttggatatagaaaaacctgagaacagtatcattcacttgaggatatatatatatatatttacacacaataaagtgagttaaaattgtatatgcattgggatgtcaaacataaaaccaccaagtgcaaagaatgctttgaaagtagaaccttgtctcattgatcagtggttactaagcatttaggaaacagtcatctttttctattgggatttgcattagaaattagccccatcagtaaatttcagtttactatccatttattaatatacaaaaacattaaaaaatctgccatgccatggtaatctatctattccaggaaaatagatcagaatatatgaagggaggatggccggtatgggatgtaaatattcagtaagtttttctccaacaccaacctaaaattatctttatttttttgaaagaaagttttacggtgatcagaccaggtgttatctgttaaaggacagtagtatgacttccatcctgtaatgcacgttggtgatattgattggaataactgaatctgagatactcatatgttctctctggcccaaccagctggtgcatttggttggcttcctcgtctgtaaggtggacattcttaaccagagggtcacgaccacatcacagctgcaagttttgctttgttcattgaaggtgattttttagttttaaaatatatatatctcataatatacaatgttgatggtatatcaatccatcaagcattttattagaaagactttataatattattaatttttctttagttttcagtagataaagtagtttcagtagataaagactttataatattattaatttttcttttagttttcagtctcatcatgggagttagaaaataccagcatcacttaattgtaaagagaaaatgtgaaagtattttccaatccaatgtttcaagtgcctcacttattgtgaatctcaaatatcatcttgagatggtttaatggcagtt

SEQ ID NO: 26162 - DNA, 1030 bp, Homo sapiens
acactcatttgccacattgagtatgtcactcaaacttgtacacatacttttagcctttataatattatgctttatatggcatgcttaagacataaaaaataatagcacagaacattggaaagtgaaggttaaagtgatagtattctcctctgactggtatatactcttaactgaaagcttgagagaacagaagcaactaattcatagaatctccccatggaagatgcttctctttgcaggctcttccttttgtgagttcccccacctttaaatgtgtaccataaaagtaaactatgtattttgagagctgaatgaattgtgaattagccctaaaatacaaggtggcatttaattcttgctcacgtgtctgttggtggagcaaaagactgtgttggggaacaggcttgcatttccagtgttaaccttgctttcccctcatctcttttgcagagtaatcccagcggccctgcctggtcctggtggatcctggccgtgctgcccctggagcgcaaggctcagctggccatcctcggcatgacctcgctcaaagagcggctccttgccatccgacggatattagtcatcatcacgcgtaagatgaatagtcggcaagagctggctaatgccagggagagaaataattgatttttctctctgtcaaggtttctggcagcccttgtgcttttataaatgtcaggcatggacgaatagccgtccattcattgtgcttcatcaagtgcttgtggatgaggttccaaaatgggacgcttgccaaacattgagtcctcctcaaaaatgacaattctgtgtctggtgggatctgaccttgtgtgaggttagcctgaagtctgaatggagcccatagttggaaaacaacctaagaaaatctcttagaagcaggtgcttggggaatgcagttcactgacagcacaggaccctgcagatggtttacatgtggtttgggtttcacgagaaagaaggattcacttcccagtcagcatctggctctgccagatggtaaaggcgtgct

SEQ ID NO: 26163 - DNA, 1034 bp, Homo sapiens
ctaaggattggggaagaagtgccattggaaggtaaggtaaggggatgggaagtaagttcactgaggggaagactaaggtggctgagtgtgatcaagctgagatggaagctgttttagaaccaagcactttgagaagcacttctagattctggggggaggtgggttacagcagtgtgtctcactcaagcaaaactgccctttcaagcatccaggcatggctaatattcatcatggctaatgattcaaagcttttggagcaactggagataatccattgccagcaaaatatttgcccatttgcagaaatagatataggcacatgattagtttgatcttacccaaacagcgaacttataagacttaaaattacttaaaagccagttaattcagttaataaatatttactgatacactgtggtataaaaaatgcaaatctcaattgagattctgtgcacatgtatgaaaaacttgaaactttacgtgaagttctttgtgcgtataagacagtattattttctcagaacttttgataatcgaagcaaatttagacactactgaaacatgaaagttggggacttttataaggcctgaaaggggccctagcaactttgtattcttaattttgtacttttcctgaccaggtgtggtggctcacacctgtaatcccagcactttgggaggctgaggcagaaggatcacttgaggtcaggagttcaagaccagcctggccaacatggtgaaaccccgcctctactaaaaatacacacacacacaaaaaatagccaagaaaaaattagccaggtgtggtggtgcacagctataatcccagctactccggaggctgaggcaggagaatcacttgaacctgggaggtggaggttgcagtgagccgagatggcaccacttcactccagcctgggcgacagagcgagactccatctcaaaaaataataataataacaattttgtacttttccttaaacagactttccaaattatgtaagattcaggctccacaaaagctgaatcttttg

SEQ ID NO: 26164 - DNA, 1020 bp, Homo sapiens
cacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgc

SEQ ID NO: 26165 - DNA, 1035 bp, Homo sapiens
ggattcatgtaggcattaaaatttaagaaggggtgaggtcctggaccagcaattctcagtcccagctgctcattagagtcacgaacagagctcttaaaaaatgcctgggtactgcctccagagatttgtgttgtcttggctggggtattcttggggcccggggtatcactgtatttcttggaagtttcccaggtaccgccccagacataaagccagacaccttcaggtagatgtctagattcagaaggcacataatcccgaagcaaatgacaccatgcttagctgggcacaccactctttaggattcatcaaaacccaccacaccagataatgtggatcctcgtagctcatccgctggcttctagagccacagccagagatgatgggatgtggagcacccaaccggggttgcttgtgccgggttagaattctccctcctccatgaatgaaaatgaccttgagactgggcagtggctgagtgggcatttgctttttgtacctctgactctgctgctgaagaaactgtttcaaaatttaaatcagatcatgacatcaccacccctcttttcatgtaaaactctcttcaggggctcccattgcttgcaaagaaaagaccataatagccctggcaggccccatgttgtctggcctgcatctgcctcagcctgtgccccagaactccagccacatgggcctgcgtttagttactcaggggcccattcccttggcctggaaccctgcccttcaccttaggtaactgtgctgtcccagaccactctgcccaaggcacatcccattgtattttctccccacagcaccatgtccctctcacaccatcaagtaccactcctcagatagcttctttccttcgtgtgggcctgttagacgacaagctctgtaaggacaagaactgtgtgtgtttagttagggactcagggtcatatccttggcagctgttttactgcatgaatgaatacactggatactggataatgaataatgagcttgaagtcattatttttaggttattttgtc

SEQ ID NO: 26166 - DNA, 1025 bp, Homo sapiens
tagggctggtcttcagcggaggaggggtggggctgggtggaggaggagcccggggccgtgtgccttttccagctgccggcccaaacctgtaaagacgtctcgctctgactagcctaacaagtcagaaatagaaaattgcctctaggccgggcgcggtggcacacgcctgtgatcccaggccgaggcgggcggatcacttgaggtcaggagttcgagatcagcctggccaacatggtgaaaccccgtctctactaaaaatacaaaaaaattagccgggcgtagtggtggttgcctgtaatcccagctactctggaggctgaggcagaagaattgcttgaacgggggaggcggagcttgcagtgagctgagatctctccactgcactccagcctgggttacagagcgagactccgtcttaaataaataaataaataaaaatgatgcagggtcttctggaattcacccacgatcacttcagccttggaaaaggcaactcattaataagacattgagagcctgctgtgtaccaggcaccattctaggctctgcagatgcagcagtgagcaaaacactaaaacaaaggtgaaagtcatctgccgtgcctgagtatcaggagacccatgtatgcaggcacacaggcactgagcaaaaagcagcaatctgacttgtaaaatgcaggtattgggctccagagcttctgcccaggcacactccaagtttaagagagcaatattcctacctggtatggaaggaagcatcttgcacacgtgggctaacttgctgcctcctggcaactaagcggacacagagagtagagacccacacacctgtgagataggcgcagggcttccaaccgtggctatgcattagaatcacctggaagccctcaaaaactaggaatgtcctggggctccatccccagacaaattaaatccttggaaatgaggcctagcacagatactttcttaaagatcctcaggtgatgctaaagtgcacagtcgttgatatagagtgaatcaaatgat

SEQ ID NO: 26167 - DNA, 1062 bp, Homo sapiens
agaaaaaaaccttaataaaaaaaccaacgtgaaaattacatgttcatgtgggtaaggatgtcagggtaacaagggaacacttttacgtatccagttagagtggtgagattgtgagtaatttattattgtatttgtttgtgttaataacgtggcttgttcaataagtggtaagaactccctttccccctcttgtttgaagagagaacatatgatgagctgttactgggagcagcccaggcccatggcctcacgccacgaccccagccggccctatgctgagcagtaccgcatagatgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcggtatgcctctgtgggatttcgcagtgatgtgctttggggtgtgggtctgtgagcagaacacaaagtggatcttcggagcaggcagatgcacatggtgtaacacttttgtgactggcctgacatgaacttatgattttgaaatatcactctgcaggcccctctcaggatctactttctgaagggggatgggagaggggcccacgctctcaacatacgaggctgttcaccttgctttccttggcatccacgatgtggtggtggcttgttgggagccatgttcctaacttttgtccataaaattaaaatgttttggaaggtatgaggccagacaacattcacaaagttccgtggagctcacatagtcaccagcccagtctttaacactttcattgctaccatggtgtgtgtctggggcaggagagttgggggtggcaggtattgaccttccccagtgttctctccacagtgagtttgtgtcctgacaaatggactttcagcattggcatcaactcactctttttaaactttttgcagatattatgtataatggagaaatgaatgagaagattaaactattatacaggcttcatatccctccaggtaagaaagtccaagtagcaaa

SEQ ID NO: 26168 - DNA, 1031 bp, Homo sapiens
atccaccctcctcggcctcccagagtgctgggattacaagtgtgagccactgcctggcccctgtggaagttttctgttcgtctcagcctcttgacattctgtggcctcccaagccagtttgccatgtggcactgtcccaggcatggggtgaagggtgccattgtccctcactcctttccacagtgagaaactccaggaagagcagggccatagatgcttttctttaagaagattaaatgtcttgcatttagatggactcacagtggccttgaacagggctcgggggacaccaggcatcatgggcatcaggcagccagctagaggttgcagacattttctgcataaggctagtgagcagcagtgagggaaaaggcccactaggttgagcgccagagctgggctttctaggagctgagggcaagtcagatgacattgaaagagggggttctctttcagagcatgatggaagcttaaccttgcatgtatgcgcagaatgttgggcttacttcactggagagtttcaggcctggaaagccacctgtggagcccaatccacaagccgggcttcatgactgcctctcgcttctctaaaataagccgagcagctgcagccttgccctcctcccaggtgttggtgtttggaagtgccctggcatgtctgacactgtgaaggcagcccgtgttgtggtacccgaatgaggatggacttgggcgttgacggggcggtgtgttcaggtttctagatcacattaagaatgaggacagcccagggcccccagttggcagccaccatgcctttttctccgacgaccaggagccctaccctgtgactgatatttcggacctgatccgggattcctatgaggtaacgggaacccccgccccatgccccgttgcagcccctaaccccccgggaattgtgactgggggatggatgtggaaggaggttcctgggccacttcctgtttccacactttggatgagcaggggactgagcaagtggtcccttttttccctgcagaaatttggag

SEQ ID NO: 26169 - DNA, 1041 bp, Homo sapiens
tctggaaattttaaggaatttatgtaaagggatcatactgtaggtactatgcctagtttctgttttaccatattgtggggatcattttagattcacagggatcccttgaagcagagcattcagacattattcccattttgtagcaatcaaaatgagatacagagagtctcattcggggttacagagtacataagcaagccaagaattcatattcctgactttaagcaagtgctaatttcatccttatatttataaggaactttataaagtgcaagagaagaatctttccctctgtatgttggaatttcccccttactagaattttggaatatgacataacttgatcagtattttcaaacattgtgatttggttgctttctttactggtttcagagccaaaaatcaggatatgtggggttgcctgggggttaggatccttctttcctcctcatcaacattctctcttgtcattactgatgtgatgcatgagccactgcacccgacctggattcttaaaatatatatttttaaaaagataataataataactaatgtttattgattacttactgtgtgtcagatatgcatctcaacttttttttttttgagtcagggtctcactgtgtcgcccaggctagagtgcagtggcgcgatctcgactcactgcaacctctatctcctgggctcaagtgatccttttatctcagccggtggagtagctgggactacaggtgtgaaccaacacacccagctgatgtttgtatttttttgtagagatggggttttgccatgttgtccaggctggtctcaaactcctgagctcaagtgatccacctgcacggcctcccaaagtgctgagattacaggcatgagccaccgtgcctggccgcattaaattttttaattttttttttgagatttaatttacataccatgtaattattatccatcctttaaaagtgtaccattcagtggtttttaccatgttcacagagttgtgcaaccatcaccacaatcaattttagagcatttcatcacccc

SEQ ID NO: 26170 - DNA, 1334 bp, Homo sapiens
tgggctgggcgcggtaatcccagcactttgggaggccgaggtgggcagatcacgaggtcaggagtttgagaccagcctggccaacatggcgaaaccccatctctcctaaaaatacaaaaattagctgggcatggtggtgggcacctgtaatcccagctactcaggaggctgagacaagagaatcccatgaacccaggatgtggagctttcagtgagccgagattgcaccacagcactccagcctgggcaacagagtgcaactgtctcaaaaacaaaaacaaaaaggtgattggtggcgctttctcccactagtcttagctgtagctctctcttagagtgattgctttggcttgtgtgtgcagcactggagggtaggtgtagctggggtagctgggatggtctccatcctcataggggtgcttctgcggtgacctacaggcttgtgtggccacgttctgaatgtcaggtcatcaccaatgtctgttcttctctacggaggaaaagtgaaggcacttaggaagtactggaaagtctgagaagcgggctgtgagcagtggctttgttgttgatggtgttcagtaaaaggagttgatatatttagcatcaaaactaacatctgctttgaaacagacctaaaggataggatggtcttattctaaacttcataaagagctgatttctcgaggatttctcattttttcaaagtcacgatatcttcatctcagttatgctggaaatttaactatcttgtatataatacatatttaacgaatggtgaaattggaagacaactttctagtagggaggaaggaaactaactcagatcttaggaaagtcccccctgttgcttatttgtttgtaacttgaggtttctggtctctggctacccaaatgtgcaaaagacagatgtctacagggaaagtgaggacagccctgaaaggggaatggagactgtgtgcagcttgcccaggctgctctgaagccactgagagagaagccgattgaactcaggcagcaggtgcactgggtagaacaaaatggtttagttgcctcagatacgggagcaccttattcttttttttttgtttgttttttgagacagacttttgctcttgttgcccaggctggagtgcaatggcacgatctcagctcactgcaacctctgcctcccgggttcaagcgattctcttgcctcagcctcctgagcagctgggtttacaggcacccgtcaccatgcccagttaatttttgtatttttagtagaggcggggtttcaccatgttggccaggctggtctcaaactcctggcctcgtgatctgcccagctcggcctc

SEQ ID NO: 26171 - DNA, 1045 bp, Homo sapiens
gccttagtaagatatccttatgaaaaggtactgcattttatggtttgtttcttagttaggaacttttcggtgtgcataagagtatttaaggtaagttgtaggtaatggagcaaacactatatatctaccacctgtaagtaaaaaaataagagtatatcctatgcctgagagaccccttctgtgttttcctgattacatttccctcccttccttgcaggcaccactaccctggattatgtgttaatactgacttgcttttctttatagttttaacacatttatatgtattcgtaatcaatacatagttcagttttgtgtgtttttgtaactttattacaaaatatacttttattcatgctttatgtatttttctgtcacttgatcaccccaccccctgcattatgtttttctcactttgacccatggtagctgccgtggttcattcattttcatggatgtgtagtaatccattgagtgaatgtattattatttattcattctcctgtccttggatatttgggttgtagttgttttagtagataaagctgctgtgaacattttcctgtagtgttcacacaggtatacatttctctagagaatatttctatgagtgaccttgttgggtgtatccatcaggatgagttaggttatgctgcagtaacaaacaccccgacacataaatttatttctctgtcatgctgtatattcaatgtgggtcagcaaggatctcttctgacggagaactgggacttttgtgaacagccctaatactgggtcatagctatgtgtattttcaacctttctagataattccaaattgtttccaagcagagcatggtggtgcatgcctataatcccatctacttgggaggctgaggcaagtggattgcttgaacctaggagtttaagtccagcctgggcaacatagtgagaccactgtctctaagaaaaaacttcccacagtggtacatccttgctaatgcttgatattgtcagagatgttactttttgccaatctggtaggtatttacatagtatcttagaa

SEQ ID NO: 26172 - DNA, 1033 bp, Homo sapiens
gcggccgggcccggggcctcgcaccccgccgggcccgcggcccccagtcccgggctgcgtcgccagaggcgatttcttgggagacgcggggcccggacggccctgccgcgggcttgttttccttttttctgcgtttctcccgcgggctcccgtcgaggtggtggtagagggggctcccgggcgcgtgcgttttccgggcgaggcaggtgtcttcgccgcctggcccggtgagctggaggccggactcgacttgggaatcgaaggagaaacgccgggtggagcggggccggagggctcggggccgccctggagcagcgaggctgctgtgtggggccaggtgacagcggggtgcgccgagccagcccggactcggccatctggaggcgccggaggctccaggtggtgtcgtggctgggggcgcgcggcgatgcgcgcggggcgcagctcttggaggccgcggtgagcgggaactgtctccacgcccggaggggaaactgagggtgggcgaatcccaagctcgtgatctcagtagagaaattgaacagatcagttttttcctctctttcagtgtcttacaaggaatgataggaaaaaaaacccaggctcgtaaagttgatgataaaacaaagcattttttttctaaaagttttgttccaaagctctttgaaattgacgccaacttgcagtagctaggacacctgtttaaaggtcagtgaaggaacaattagactttttcatttgtatctagggggcctatatttttctttccaattttggaatcggaataaaagagagcttagatctcctgtcttgttcctgttctactgaggagaagacagaggccagagagaggtcaaaggacctaggttaggtccccgggttagtggttggcggctctttctgctctcagaccagtctagggaaggcctttttgaggttgagtctggtaggagatgtactaacacgcctggaaaccgcagaaccaagtgcaaaggaactggattttgctggactttagcttctgagaaagctg

SEQ ID NO: 26173 - DNA, 1050 bp, Homo sapiens
gaagtcttttgatgaaaaaatgaaatactatgccctcacacatcctattcttagttaccactatttgttcagctgccactatgatttgtactagttttatctttgcatcttataactgaagtaacaaattacgtggcgatgaagcagcaggaggaaaagtatggttgccttttgatatttcgaaacgaatgtggaaaccgtcacgaatccctaaattcacaaatactatattcattttcagaaaacaatagaagtacaaaaggaaaatgaagtggttcaactcaactattttataaaacaagattcatccctgagttacaaacccactgaaataaatgctggctaggacttctgctgaaccaatttcacatctcacatagtttccacatagggcaggagtggcttattcctgtcatggatcctagccctgccaaatttgagagtctactgttgagtttacagaaaatattttttagttaaaaatcatcactttatcttaaacatctccactgcctcttcacttacctcaccaggactagcatctgaatctcccttcaaccacttacaaaaataaagtttttaacaatttatgagaaatactacttatgtgatagagagttcttgcgaggtggggacacctggtgtttggctagacccacttattatgagtgatctgcttttcatatatcttcctggtgacctatgcaatttagagttctgcccgagcaaatatttaaaagaagccattacatgccatggacatttcagtcacacttgtgaccagcagaaacttcaaatattaaacctatgtatgtcaaagatctactgtaaaccaaatggtacaaaagtcactgtgtgaacttcaaactcatggtgatactacactatcatctggtaaacatgttctcatcccaaagcagaaagcttgccttcataattcaaagcacacagaagcctataaaacagatgccaggtagagtggtgcatgcctgtaattccaactatgtgggagtctgaggtaggaggatcccctgagcctcaagggattga

SEQ ID NO: 26174 - DNA, 1050 bp, Homo sapiens
tccgggattatacaggtactgttggaagtatcttggggattttcctgataagaacagtagtgattgcataaaaaggacaggatgtaaagtgaaatcagtaaaatatcttagtagacagagggtgctgaaattttaacaaatgtgtaaaaagttcttcctatgcattaattttccagatacccttaaaatgtttaaggaatgtaattcaaaatactgtttaaaagagacatgtgaccatcattctcccagcgaatgtgaatcatttagtgtgctactcaaaattaggtgtaaatgtatatgtacactataagaataaaaatcgataccatttctttaaagctttctaaaataaacttaattatttctaatagttacattttaggctctcaaactatttttcttttgaaataactgctttctaccctaagatgttactcattgctgtcttctttttaacaggtgatttgaagatattaaagctagaaattggaactagaaaatcaaaagaattcaaggcatcttaacgtgacagttgaactcatttgattatacttaaaaaagtttattgcagttattgactctcaattttttttttttttttttgagtgcagtggtgccattgttgctcactgcagcctcaatcttccaggctcaagaaatcctcccacctcagcttccagagtagctgggactacaggtgcatgccacaccctgataatttttttttccccaatataaacgaggtcttgctatgtcctccagtctggtcttgaactcaagtgatccacccaccttggcctcccaaagtgctgggattacaggcgtgagccaccaaacccagccaccaattttactttaggtaaacttttattttcaagcttttgttggtgttgcaagtgtaaatctgttttataaaatgttctataaatataaccactattccttgtaagctatttaaaataaattttaaagtctttcaagtaaacaccaatattgtgattttgatcctcacttacgaagtccctatttgagaacctccctactaaaatg

SEQ ID NO: 26175 - DNA, 2012 bp, Homo sapiens
ggcctggaaagcaagaagtgactgctcatctaatccataaaactatgttaacagattggagctgtttgcagacaaggttccaaagacagcagaaaatttccatgctctgagcactggagaaaaaggatttggttataagggttcctgctttcacagaattattccagggtttacgtgtcagagtggtgacttcacacgccatacagcattggtggcaagtccatctgcagggagaaatttgatgacaagaacttcatcctgaagcatacgggtcctggcatcttgtccatggcaaatgctggacccagcgtgaacgtttcccagttttttatctgccctgccaagatgccaagacagagtggttggattgcaagcatgtggtctttggcaaggtgaaagatggcatgaatattgtggaggtcatggagcacttggggtccaagaatggcaagatcagcaatcagcaagaagatcaccattgctgactggacaactgcaataaatttgacgggtgtttctcttaaaaaaaaaaaaaaaatactgtgacagaccaaggtaaattgtttttgataattacagaagtgtgatttcttaatcagcagctgtcaaacatagtgttccttaatttaaaagcttgaacactaaattataaattggagaggttggaataattacggtcatatctctagaaacacaagtctttagtagcaaaaaagaaattagcaagagaagaaaactgttcagtactttgaaaggaaaaagttttcagtgatagtttttttagatgaaaattaacatgataaagaagtgacaggccaggtgtggtggttgacgcttttaacaccaacaatttgggaggccaagatgggaggatctcttgagcccaggaattcaagactagcctaggcaacaaggcaaaactcatctctactaaaaatttaaaaaattagccaggtgtggtggcatctgcctgtagtcccagctgcttgggaagctgaggtgggaggatcgcttgagcccaagaggttgaggctgcagtgagctgtgatcacaccactgtactccagcctgggcaagagtgagaccctgtcaaaaaaaaaaaaaaaaaagaaacaaatattacaagagtttttgctgaaagttttaagttgataagatgcagagaattgggggaatgtataataaatcaggtttcattgttatattatttaccacatgaatcaccttcctcctaaccattataggagccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccacttggcaggtaataatttccccgcatgctatctttttagggatcctgaacacacagcctttcccagaagactgctccctccagctactgaggaatgatgacaagaaaaggccgaattgcagtgtctccatcagcagtttgctctccatgggcacacgatgacaaaatatcctgaagcgaaccactagtctgacctcagtagcaggattggaagcttcatgccatgggagctgtcaagaaaggcatcccaaagagaactgaaatttaaaaataataatagaccttcaggaataggtgattgtccccatatactggggatgaaatacccaatgtaaccaaattccccagtaagatcacttagtttggcaatagtcttttcttttgagcatgttgaagtttatttgctcaatgaaggctgaaattataagtcagtatatatgtattactaagtagaacttgaggtaattatatgttttagtcaaaagcagtttctgtgggcttggtataaaccctactttgtgatttgctaaagcacaggatgttgactcaaaccaaaactagt

SEQ ID NO: 26176 - DNA, 1051 bp, Homo sapiens
gagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcacatgagcattaagttcttcattgccttgttaaggaaaatgagtaggcagactcagaatctgttatattgatttcagttacaatttaatctttacaattaaaagggcgaaagatgtagaattttagtttttgttgttgactcgaaataaccagttttcttgattagagtttaagcagatttaataccatgaccttgcttaaccgtttcttcttttttacttgcttgctgttcttttgggtcaaaggagcaggctaatgcaaagcttttggagactgctaagtgttaaaaagtgattaaacacacactctgctattttttcacttcttggaggtagaagtcgagtatgaggcagttattttttagagtgtggaattatagtctttccttgctcctagttattctgtatatctttactttgtaggtaaaaataaatgtttatttaaaacaatttttaaaattataaatttatttttatagccatatgtaggatataaagatttatatagattattttctcaagctacttaatgctttaattctagctactcatcatgaaat

SEQ ID NO: 26177 - DNA, 1127 bp, Homo sapiens
gtgaccaagagttcaggctgcagtgagctatgatcctgtcactgtactccagcctgagcctgggtgacagagcaagaccctgtctcttaaaaaaaaaaaaaaaaaaaaaaggaattttattagtagctgtgaaagaaaataaagaaatacataaagtgcagaaaagcataaggaaaaaatgaaaatagtcgtcccccacgtagagatgtcatcttaacactttgataattacctttccagatgtttttctggaaatcgaaaggtgtttaagggtcggtgaatatcacttatgggctgttaggtaacctactttttacttaatatatgaagctctttctatgttgataaatagataattttttacagctacagagtattacattttgaattttctataatttcttgaaactaattaatgagtgtttgtattatcagtagcactttgaaatcattatgtatatatacttatgccttgtctaattgttttctgtcactctgataggtaaaatgtagtgaactgcatgttttttgttttgttttgttttttgtgttttattttggtttttgagacagggtcttgctctgtcaccctggctggagtgtagtgatgagaacacagctcactgcagcctcaaactcctgggcttaaccaatcctgccacctctgcctcccaagtagctgagaccacaggcgtgtgccaccacatctagctaactttttaaatttttttgaagtgatgaagtctcaccatgttgtctagactcattgcattttttaaattacatttttgtcctcttttcacattgttggtcatctttattctttgatgaactgcttattttatccctagcttatttttttatggagatagtaattttttcatattgatccttagagctttttatacattgaaaatactagggctttgtcatatattttatgtatttctcccccaatttctgtatcctttggcttttcattgtactttccagatagaaattatgtagtttagtttcccgttctctcatgattctgcctttgattgcatgctgacttaggaaggtctttcttatgttaggattgtaaagatattgacctgtactttgctagtatttgtgggttttgt

SEQ ID NO: 26178 - DNA, 1050 bp, Homo sapiens
tacatacagatgaggaaactgatgctcaaggagtttaaaagattagccagagacgacacagtaatctagtaatctagggccagataattctttgttctctctccctctccccctcctctccctctccctccctgttcatacccccctcaccccatgtatgtgtctgtgtgtgttggggcgggggttgccctgtgcatttaggatatcttagctgcatccctggcctccacccactaaattccacttctgacaatcaaagatgtctccagatattgccaaatgtttagagagtaggggagaggccgacaaaattatccaacattttgaagcactgattaaagggaaattagtttggtagcagtgtgatacatggattaaacagagcaaaagctggaaacagaatccacttagactgtggggctagtctaagtagaaatataagggccagtactatagtcgtgactgcagaaatgaaaagacccttacagaatttggccacattgggtataactttttgagaatggaattaattcacaaggtgactgtgtacagacagccttgaagacagctcagacttaggtttctgtatttagtcagtgtgactagagccaggaaagaccactgattcagtggttctcactgttctgtgtaacactggttttctgtgaaataggtagaggtggcctgcctgtaaaattgaatactaggccgagtgcgttggctcatgcctgtaatccccagcacatcaggaggccgatgctggtggatcatgaggtcaagaaattgagaccagcctggccaacatggtgaaaccctgtctctactaaaaatgcaaaaattagccgggcatggtggtgtgtgcctgtagtcctagttactcaggaggctgaggcaggagaatcgcttgaacctgggaggcagaggttgcagtaagccgagattgtgccactgtactctagcctgggtgacagagtgagaccctgtctcaaaaaaaaaaaaaaaaaaaaaaatactagtagtctcttcccaagcctcaggagaatgtctcca

SEQ ID NO: 26179 - DNA, 1069 bp, Homo sapiens
ggaaggggcgggaagagcaagagacagagaagatgaagagggcgatgaggaaggaaaggggaagaggaagaggcagaggaaggtgagaaggaagaggaggagaaagagaaacaggaggatggaggatgaggaagaagataatagggaagaggaggaaggaaatgagaaaggataagaaaaggaggaagaggaggatataggagagaaaaaagtaaaggaggaagaggaagaagaggaggaagacgtaggtaagaaagaagaagaaattaagcagacataaaagaatccacaacagcagaaagggaatgacaaaaggaaagccccattcaattagtgagtgttacatatgtccagttagcaaacaagcactcattacccagggctcgccacatgaggcagaaggccagggtgaagcagacgaaggcccagttccactcgtggttcttgcccacggtagacacacccatgaagatgaagatcaaggtttcgctgacactgctcagcatcttcatgaagtacttgatggtcgtgtaggatttctgagatacattttcttctacgtacttattcatagtcattgcacaagcagtgattctgaaagggaagattcagcttctattgaaacctaacaatgatcttaatcagaatgcaagagatagcacttaagagctaaattatggctctactcttctgcccaagactacaacatcatcgaatgatttttataggtgaatgtgatttgcatgcaaacctcggaaatcctgcaatctccggaggtcttctttagcaaccctggctgaactacccggctctgcccagcattctggtccctcaattcccttaccccagattcacacttaaaggtctatggacgtcgacaccatcagctctcctttctgtatctcaaataaaacaagtccaaaataaatttgaaactcattatctttctgtaaactgatttattttcccacatatgccctgttcctctattatctaaaaggattctattgtataaaatcctaaacttgaaaatgggcttgcattagacttctctccctgtcacatctta

SEQ ID NO: 26180 - DNA, 1029 bp, Homo sapiens
gtgaattttacccatctgcctttcgacaaactgcgcattgcacagcgtaggtttggtttcatcatgatgtgtgtgcctgtggtttgcttttttaccagaccaggctggagaagccgctgttgatgaccccacttgtacagaattgggtgcattttcactagagctctcggttgacttgaatgtttaaaaatgcagatcagagtgaattgtacccatctacctttggacaaagggtgtgcattgcacaatggcggtttggtttcatcgtgtgtgtgtgtgtgtgtgtgtgcgcgcgcgcgtgtcctggtttgctccctgagtgctaatttcccacgtagaatggaaagtttagtaagctgattcatggcatttctgaacacctgccatgtggcaggtgctgcggagcttcactattgtaatccacagttctgccacagaagaattcagtcttacaagtaagctgatgttggtagtttctgggccattatctgcaagaaccctagatccacctctgcactcctccctttccaaggctaggcctgattcagccctgagtgtgagctaatccagtatcttgagggtaaggaagctgcgataagtgtcaatgggagaaggctgcctttgaggccttgaagatagtatctgatggcactgggccctggcagggagtcatcgttttctgcccagatgcagatcaagaccaccacttctcccagtttcatgcactctccatgccaccacctccatgcaaggcgttcagttggtagcaactctatgttgagttaatagttaagatcaccatgaaagcatgttcatcaaattgctgcaagcccagaaacacaaggtcttcagggagggcggctttttagagaggatttctctgcctctaggccattgcaggatccaccctccagctccatgcctttaacttcagagactggcactccttctgaccactattcctttaatctagtagttcattctcagcatggggatgcttcttctacttttcagtctaggcacctagaa

SEQ ID NO: 26181 - DNA, 1047 bp, Homo sapiens
gaaatgtttatgagtgaaatttacctgtaactttcttttattgtaatgtctttctcaaatgtgttatcaacgttccactggctcataaaacaagttgagaagtatatagtcttttagaaattaaaacataaatgagtctaatatcacatagtaattaaacatatatgtagtttatcctgagaaggactcactacagttttctgtctttctatgtttctgtgtattttaacttagatttttagcaggaagctggttttgtgtgagttttgcatgggaaagtaaataggaattagactatcttctaggagtttccatatggcactcagcagtatgttcatgtgcccaaggctgaaatttgttactgcatctcaatcctggaacccataatcaaggctcatcagttgagaaacctttttggacatatgacaagtgttcagataaaatatctgatccctgccaagaatcttctaggccaatttaatctctgacttttgaccttatctgtcactgctccaaagactttttaatttttatttttaaaatatcctgtagtagcatgcatatcattcctcatcccagctctcttttcctacttagtattgtcccagttcaaggccttgtcacctcttgcctgggcaatggcgtctatgggatactattctccatttatcttcttctcagccatgcagatgctgactctgaaatagaaagctaaccacattagtcctttgctgaaaaccaggtgatttctgtattgctctgcaagatgaagtccaggtttatcaatgtggtgcaggttcttgcatgatctgatgtcttagtccattcaggttgcttaacaaaatatcttagactgagtaatttataaacaatagaaatatatcgctggtagttctggaggatggggagtccaagatccaggcgtcagcagatttggtgtctggtagggcttcatagatggcaccttgttgctgcattcttacatggtggaaggggcaaggaagccccctggatcttcttttataagggcaccagtcctactcatta

SEQ ID NO: 26182 - DNA, 1054 bp, Homo sapiens
ccttgcaagctccgcctcctgggttcacgccattctcctgcctcagcctcccgagtagctgggactacaggcgcccgccaccacgcttggctaattttttttgtatttttagtagagacggtgtttcaccatgttagccaggatggtctcgatctcctgacctcgtgatccacccgcctcagcctcccaaagtgctgggattacaggtgtgagccaccgtgcccggccacaactaaattattttaatttggaaataccacttgtgtattgtgattttttttttggttgaatattatgattcagaactggggatggaactttactttggagaggttatgtatttgcataggtgagaattgagagccataaactcagatttctactctgggatatgcccagagaatactttcttatgtctcatgaactttgagagttatttcattaattcattatttatgtgaattccagggcagttttgctacatatgaagtaaatatgaaacatccagtctgaatgaaaaaaaaaattaaatgttctgtcaccttactcctctctagcaaaatctctgagattagaactctaaatgattcttctacagatgctatttagaaaatatgacccacaacattacaaaaatgagccaatacagtttcagtaaactgcatttttgtttggggctggaaaatgttatgttaaattgtaggaagaattccttttttttcactagttgttctaagggtactatacactgtctcaaatttcctgttttcatcatattatcaataggaagattttgctgatggaaataattactgaaggagatcaggaaatgttctcttaaaggtataattctccataagaaaatacatgagctacaaaattatccctctaactttgggaatttatgggttggtgagtgcaataatgaatgttcatattgtagatccagatcttaagaaaagccattttgccaataatccgctgtgaggaagcagtgcaaattaattaatattgaagaaagcacattatgtgtctgtatgcttaaatggctggc

SEQ ID NO: 26183 - DNA, 1137 bp, Homo sapiens
tttgcaaaatgtaggtcatgttctgcttctttccagtaaatcccaggaaatcaataaatgatatatgttttactgcctcctctattttttgtttaggtagtcaagaggcagataatataaagatctcagaaaggttccttatatttaggggtataaaaattcatgtgtcctctgccacaaccagcctagtgacttggtggcctcccataaccctcttggtttcagttttctcatctgtaaaataagggtgtgggatttggttgatctttaagttgccttctggtcataaaattctgtgttttgaattttctgtcatctagagaatctattaatgtaagcatgattttttatatctagttatattcaattgttatagaacttgcatgtaaagaagaatacagggcattccattatgcagtgtaaatcaataaaatgaaaatgtatacattgacaacatttgtattttcacctattacagagctgtgccatctctttgaatacaatacacttttatgccccattaaagcatgcttgacatagctttcaactacttgcaaatgctgagaagttgaaaaacataacatttacaaaagatacatctggtgcatatttatatgacttggaataaggaatcatttaaatactgctgagccatctccatattaggagaaaagatattccatgtccatatgtgaaattggtgataaaatacacgtaggtttaaatttctcttgcacatttttttccttgacacgttaaaaatatggaaatattgattagggattaaatcatctatttgagttgtgggaattgcttttcctttgaattttatagattacttcattaaatctaagtttatatgctaaaggtggtaagttttcaaagggattaaaagtagcacttcatatttagaaaagctgcttattcaggtgcaagagttcttaacctggagatcagagactccttaaacatccaaaggtgtttaaggggttctatgagccccctgagtttatatgctagcattgtatgtatatgtgtatatgacttttttttcctggaaaatatctaacttacatcagtatctcaaagtggtttatggccctaaaacttggagttataagaaatacctggggttac

SEQ ID NO: 26184 - DNA, 1026 bp, Homo sapiens
accctactgtttgcatctaatgattttcacgaatttggaaatacctgttatatacattttttctgtcttggatttattaatattggatggttttactgttagccataattctttataggacctgttgtcctagagaaaggttctaagtaacatttagacacactcactagcttctgccaaaggccctccccagctagtgtcttgacacactttcaatcactgtttttcaaaagataatttataggcaggtaaattttaacaaagaatgttaatggtaaaatgtgggtgtttaacttgatgagcttttgtttttagaatcaaggtttagcttttctttgaattatttatcaagctgtttgcccataggccttcctaaaagaagggaaaggtgaagaggaagggatcacttttatttatttaaagcatatgttgacataaaattttaaaactagccttttggaaaacagcgaattactaaaccaggtctgtaaacacccacctttgggactgtgaaaagcaaaaaacaaaaaacaacctaattactttcacaggaaacagtactcagttaactaaaatattgtatggcaatccttggaagctcctcctcctccttaagtatagtacagtttggtaatatactacacatatttatacatgatgtaaatatacatatgcacaagggtagatgtttatgtacataacataacaaaatatatacataccccaactgaatacatttgcatataacatgcccatgtgtaatatagcaaacttctatgattaacaatacgttctataacagatagtcttaaaataagaagtgagtgaattttattcatattgaaaaaaattcaaaatttgttttgaaatctgaattgtgctaactgtagatggcaccacagaaatcagtaaataataggttcgtagtattaatattttatacacactccctctaaaatatgaacttaaataactcgttttacaaaaaataaaatggacagcatatttaaaatataaacattccat

SEQ ID NO: 26185 - DNA, 1050 bp, Homo sapiens
aagtttcctcttcccttcaccagccggcccccttctctgatcggcgggggtgggaagcgggggctcgcatcgccaagagctctggtcgtggccacgctccttggaaatccgccaccgcaactttccgcagccgttgcgcgccggcggcagccccctttgtttaagttctcggatgccatcatctgggaaacctgcagcccaggaccagcgcggtgcccgcgcgtgcgagacggaccgctcgctgccgccgctccctggctcctccaccccctctctccctccttcgctctccctcccttcctccctcctccctcctctgggattcgtgcaagtagcgtgcgtgcccttgtgagtttggagggtgccggtcagcggagccgtgcgatgtatttgaaaagcaatcagtccgaccttcccccatagattcatcgtaagtgtattcgaccccaatggctttaggaattccctgtggcagcaggagccgggcgaaagaaccgggatcggctagccgcgcccttctctgctccaccgcttcctcgtgtgtgtgtgtgtgtgtgtgtgtgtgtgtgtgtgtgattagcggtgggggggtttgctcgctctctattcttaggcatggtggtgcttttttttctttcctttctgtctcagatggatttgcgtggtggatggggctggcggcgacaaatgctttctcagctctaacccagctgaaagagttaagggggatgggagggggagtgcacccggtaggcgagagaagcgggggtggggtggggtggggtggggggacgcggccaagcggaaacgctgcacagaggaacctcagcgaaccaagaaaaaagagaaagtggcaacgaaaacaagggcaaattgagccctcctcggggatttccaatgaactaacccaactcggacattcaataaatacatggctcttaatgagcgtgcgtgtgcgtgcaccccgcacccctagctgcgggtgcgcccgcttgcgcccgccgcccccagccagagcctgcatctggcagtcccgagcccgagcggcag

SEQ ID NO: 26186 - DNA, 1050 bp, Homo sapiens
acagggcagctgctgccctgtaggtcagagcagatgacagagtggccacctgccctgtgtgtttcattagcaggtcccctaatgaaggtttgcacattttccatcttttttcccaacccctcttcatataaacctctacaacatcttttgggaagggaaggaggtgtgttgtgtgcccagatctctagtcatgccccttcttggatggttgcttcagctagtagggttccaattcctgtttttgagagggtcaccactgcatgacatctggaagtgcagagagctgctgaagctgatcacaggacagtaaggggacatttatcctcactttcctgggagggcaagaagtgactttgcaggcagtatagacagcatgcgtgtttgtgtctgggcttgggaggggaagggctggtattcacttctccctgtgtatcagtcggggcgcagcgcctcagcaaattagaaccagcctgtttccttggtcaggctccttctcccactgctgtggtgtcttgatgctgtagatttcctaacatatttccacacctgcattgcaggccagtgtcctgggcgattccgtgtggaatagaccacagcaaaggttatgcaattacagagggaaggttggctgtcacatcacatcaaacttgagagcctcctgtaaacccatcattatctctgctcccataactgtaatttcatgcaactcaacattggaaacatgcagtggcagtgccagtttcccatctgtgctcgatttgcgcctactggtgtaattttcaggtatcttgtgtttacacaaatgctggaaaacaagctgcttcttaagcagcaaccgacagggaaggtcagcttttcccactgccatggccgtgccaggatgcacattgcaacaggcagggttctccagagaaagagaaccaataggagagagagagagacagtgtgtgtgtgtgtgtgtgtgtgtgtgtgtgtgtgtgtgtgtgtaggggtggggagagaaagggcgtgtgattgagagactgatttattgtgaggaattggttcagg

SEQ ID NO: 26187 - DNA, 1032 bp, Homo sapiens
cttcatttaaagcaagggctggtttcgcttctctgagttctgaattagcaaggggtttgtcaagaagtttgactgtggggctgggattaaggatcgtttcttcaggagatccaaaagggttgttcagaactttagaaagcaagccttaaattatattacagtttagaatgctgtatttaaaataagagacagtaaagggacatcttgctttatagacaaagatttgtgtcacacacacaaaatattacctgatttctgtcacataatatggatggtgtttatatttaagcttgggctccgatagatttttttttccatttcatctaaaaacatttcaatacatgtctctaaaagcacggatgccccctttgaaatgtaaccgcagtaccattgtcgtcattcccccatatcagcactgattcctttgtgtgctgggtatctggtcagtgctcatatttccaaactcgtccagtgaatgtttttgctttttttttttaatccttagggaaaaatctcgctagcctgtacactcaaattactgttttaatgtcacatgggatagttctcctctgtgtggttctgccaccaactcttacatatgtagttaggttcatttgtttcatttgacttttggttttttggggattgctttttaaaatttaatttgttttataattttataaaatatttacatagctcaaaagtcaaatcagtaaaacaaagtatattcaaagaagtctaaactcagtttctctccttcactctgttcactgcctccccccttttactgtctggtctgttttatttgcatatattctttctctctctctctccctccttctccctctccccctcccacctttctacccgcctcgttctttctttcccttcccactgtccctctgtgtctctctctctgcctcccttcttctctgccttttgatgtgaatgtttgtgttgtattttttgttttaatgattaccttgatattattcatcttataaaattcctttatgttctcttttttgggag

SEQ ID NO: 26188 - DNA, 1044 bp, Homo sapiens
gtttgctggcaattttttactatctggacctttacagaaaaacctgccacctgtgctgtactgtgtatcttgatctgggtagtgatacacacacacacacacacacacacacacacacacacacacacacacaaaattttttctcctgagctatataacttagaacttttctaactttacagcattttattgtaactcagtaaaaattttaaaagtttaaaatatgttacactttgaacttgagtgcacttgagtacactctgagttactttaaagcttgtcttttttttcattaaacagcaagccaacttgtttgatctttacttgattattacaatatgtgaaacctttgggggtcagtctctactgcctgatgtttctgttgcagcccacactgggtccactgttttcttgtatgcaaggataactctgacttgtgttaatcactacctttaaaaagttatccggggtgtttcttgagacttagaataaggatgtcttcctgcagagacgattgtcattgtctttaccagacacatgggctaccaccagactagaactacttcccagtcatttccagagttactttcaccttcctggggatgtaaatcttagctacaagtctgtatgagagtcggcttgcctgcctccaccccactgtgtcccctttccctttcctattcttccttccttcttttccttctttttcttccctccctccatgcatgaaaaggaaagatgtatttctaattcacacttatatgtggtggtgttttttgaggtcatacctattaggttcccctcttggaacactcagagatttgacttctctctcccttacattacagtcacctaaactacagctgagtttcaacagagcatcaaacaagattgcctgcttctctgggttcttgctgtctcttagcctgtcagctcttctgtgcttttatgtttgaaaaacccatgttttttcccagcagaattgctccttccatttaacagcaagcatttttctctgtttagcaaatgaaaaacctaattata

SEQ ID NO: 26189 - DNA, 1032 bp, Homo sapiens
aatcaagcagggtcctaggatcagaagcaaagctgtctggatggatttcatgagaagggcctgtcagtgcacgaacttggcctgtcagtgcataaaaccaaaagttcagccacaagacatagcagcagaggtgcacagcgctcagcagtgacctcgcatgcaccgaggctggaccccggaaccaaatctccctggctccacctttgacaagctgcgcgaaggggacaagtcctgccacctataagcctccgtttccatgtctatacactggggttcctagctcacgggactgtcggggtaattgagtgagttaacgtctagggagcacctgtgacatgccaacacagtgctgtcatttctgctgttgtccatttttctgcatctttatttgtaaggatttgaaagaatgtacagttggaaacctgatgatctcaagcagaaaatatcttttcataacgctgagcatgaatgacatgagaatccatgtctgaagtgaaatcgtatggatctgaagaatggttggtgccagccctggtggaatggggtgcgaaggagggaggatgagagccagacgtttcagtctgggtgaccctgccacccagagccaccttccattaactgaggggtccagggctccctccaggccacttgccactaaagctcagctaaagtctcaaaaaggacacattcggagccaagcaacaggcacagcccatgttaggaatgtttctgcaatggaaaaatacaaaaccagaaaggaagtgtgtgggcctaatcgtacatgtttatcaacattttactgcaatgtatgacatttctgtgagcacaagattagccttggtatttttttctgggaagtataaaagactttttttttctttctttttgttttcaatttctctctagaggaatttaaaaccggatatttccatcttaaagttcttgagcaagtctgtcaaggtgtccatatttcttaccctgttcctctcagcatcgaagtgctatctctgttacactcatgtttgctgttca

SEQ ID NO: 26190 - DNA, 1042 bp, Homo sapiens
cgtgttagccaggatggtctcaatctcctgacctcgtgtttcacccgcctcagcctcccaaagtgctgggattacaggcgtgagccaccgcacctggccagattttttttgtttttgtttttttctgtcctggtcctgtagaatcagaggaagtggaaaacacatatcaggtatatgagcaccgtgatcacgattattacctcagaggaaaacaggtgtacccctttcaccagctgccaacataaatggagctctgcagacattaacagaggctgtagactgtctcccttccctagcagggctggtgcttgtcctgacccacacagacggcctttcaagttagactgggagttcattttctgtaagtcagacggctatttgagaaagctcagtggaccctctttttcataaatatgcgtgggcttcagtttttccatccatagaatgaggaagttgtcatagataatctggggatttgtttccagcttttacaattccgcaatttatagttctctgtcctttcatcgttcttatttcaaattcccaaattattattcttatgtttgtgggcatggaatgggcagtgagcctcttgtcccacagctaaatcacaccctttattggaaaaacatatatgttggaaaaacagctctcaattgtgatgaaataaatgacagcaactttcaaggccaataactgaacaattacaggaaagcattgaatcttgtgccagcatggctgctccaactcgagatggctgcggtacaaaggatatttatacgttgggcttcagaataataattcaagtgctcaagagcctcatcttgtgatgttatcacaagaatgtccagacaatgttttctttaactccaggaagagtgatttagaaggacggatcttgccgcatgtgtccagctgcatatttattgctcttggaagagaattattctgtaaacacagaaatatccaagaatgaattcttgaaagatgatcttttccttgcttacagttgtcaggatcgtgtatacgcaatagtacaaaa

SEQ ID NO: 26191 - DNA, 1049 bp, Homo sapiens
catgaaaaacactacagcccctccccatcccttccagcaaagaccaagtgggacctggagctccaccctcacctaacgttaagaagatgcctcaacctgcccctacccccactctttgctctggtgctgtcagcaaaggcctgtaggggcttgggactagaaggcctgagctgagatttgcatctccactgggtagtaatgaccccaaccccatggcatcaactgcctagtggagagtcagggctttcagcactttcaataatcagcaataataaggcaacctcagtgaaggccacatggggagcagtaacaagctccccacccctgacagcctgagtgttaccagtggaggcctggagggaaacctgggtttccacctgctacctggcagtaaaaaggcaggttccccacttcactccctggagcagtcagagtaggcctgctaaaattcaagatttaaatcagacccagagtcttacagcactcagaactgatgaggtttaaatcaaaaattattcaccacaccagaaaccaagaagatctcaaggtaaattagaaaagataatgaacagataccagcaccaagatcacacagacattagaattatcagacaaattgttttaaaacagccattgtaaaaatgcttcaattagcaattacaaacatggttgaaacatgaatagaaaactgcagcaaagagaagatacgaagaactaaatggaaattttagaactgaaaaagtaacagataaaaagctctgtggataagttcaacagcagagtggagagaacagaagatagaacaatcaaaattacccggtctaaataacaaatagaaaacagactgacaaaaatgaacagagccttggagatatgtggaacaaagcatctgtcatgtcattggggtcatagaaagaagaaagaggatggagttgaagaaaatttaaggaagaagggctgacaatttcccaaatttgaccaaaaaaaaaaaaatcaaaatgctgagtaaccaccaaagaagataagcccaaagaaatacatgccaagat

SEQ ID NO: 26192 - DNA, 1776 bp, Homo sapiens
agaaaaaaaaatctacaggtagttctgaaattatgaacacaatagggcaggaaaaagaattctgaacttggagtcaagataaatttcactctgctgaatgcaggtcactccagcgctttgaccttccattacctcatctccaaaataaggttgtaaaaaacaaaaagagttacacctacggcactggtgtagaggggagtttccaggctgagggagctggcagtgggtggacctcctgtcctaccaactcaggcccactgcttcctaccttcctcacatgtatcagaagtatcagccaggccagagaatcaggttcaggcagaactgtcaaggaattcccctctgcttccaagaggcccatgcccatccttcctcaatgttcctttactgagatttgttgcagctgtagtttctgtgttgacaggaatccccattcctcagtatccccagccttttctcagtgtaaggccttccccccaagaacagaacctacatagatagaactgatacacctgtggaattggcatataaatgtttattaagaaaacagagatagcctttgaacctgctttttaaataaataaataaggctttcagggggtttgatgcatgtgctttttttttttttttttgagacggagtttcactcttgttgcccaggctggagtgcaatggcacgatctcggctcactgcaacctccgcctcccaggttcaagcaattctcctgcctcagcctccctagtagctgggattacaggcgcccaccaccacacccagctaattttgtaattttagcagagacagggtttctccatgttggtcaggctggtgtcgaactcccgacctccggtgatctgcccatctcggcctcccaaggtgctgggattacaggcttgagccaccgcgccaggccatgcgtgtgcttttcttctccacctgatccttccccttttccttctcagagctggagcggggagctctgggaaagccaggctgagtgtctggtgctgagggggctggtgctgttcacagagctgctggcaggggctcttttttgctgtcaggcgggaagagaccccagggttgttataatcaagcttgttcccaaaggcagtcccttcttcccagctgcctgctttccaccacagggaggtacacaagcaaacaaaacccccgagggcactcttgttcctgtgatgccgcgcttaggagatctccccaagcacctctgttgccgtctccgcctcagtgagtggcgtgatccgtggcgctccgcaggtcattcagcagatgctcatcccatgctggtatcgcacctcacatcgtgctgggctccagcagggcaaagggggttcggacaccagtccttctggggagttcacagttgggggcagttggcaaagggctttccctgggcaatgagccagagaagcttctccaggaggtggcatcagagcttgtccctaaaggatgagtagcactctgccaggtggaaagtagacaagacggtctcagctggcagagcaaagaacacaagccaagctatggaagtgtggagcaaatgtgcagtggaaacaaaggggaatgtgaccctcctcctgccacctccgcatcactttcagagtctcctgcatgcctctccaccttggccttatattagaatctcctggggagctagctgtaacaataccaggagatgccggcctcatcccaaacagtctgtgaaccagcctgggcggcatccccagctctgctgttgggcagtcagtgtgagg

SEQ ID NO: 26193 - DNA, 1045 bp, Homo sapiens
tattcctttctcttttctgatactcccagtgcagcatgcatgttgatgcacttattggtgtcctgtatttgtctgaggctctgtttagtttcctgcatttcctctgatctttgggttgcataagccctttcagtccaagtttgctgattctttagcctagttccaattgactgttgaatccctttgttgaatttttagtttcaactgtggtatttttcaactccagaattcaatttgtttctattttgtaatctctctttattatctatgtacttctttaagcatggtttcctttcgttctttgaacacttgccataacttttaatggcaaaaactgcaattgcttttgcaccaacctaatatttacagtggttgctttggtgtctttgttatatccaacacctgggacttcacacagacagtttttattgctttgttgttttttctgtttatgggtcacccatttctgtttctttgcatgtcttgtaatttgttgtagaaaactgggcattttaggtagtatattgtagcacttctggatactgtgccctcatcccaacccccaccttccccaacttgttttattttatttatttatttatttgtttagtgacttctctggtctactttagtgaagtgtttcctattccgtccccgccactccagtgtgaagctttaactgttgttccttggaggatgtagccttggccaaaccccctgggatgatggtgggtctaacaggctcatgctgacagtctctttccctgatttctctattaagcctgtgcagtatctcacccagctgttaggctgcagtggttgctagctaattgctttatttttcaacaatgctgtgggttttaaattgctcttcagcctgatccagttaaattctatccccttggcaggggtagattttgagaccagtctttgagatttgttctgaccccaggaggtttcttaagtgtcctctccttggttctctctgttaaacaagctggcctcggatttagctttttattctcatagatctattgccttctat

SEQ ID NO: 26194 - DNA, 1050 bp, Homo sapiens
tccgtggattcagctaaccacgaatcgaaaatgtagttaggtgcacaatggttatggctgtactgaacatgtgcagactttttttcaggttattattccctaaacaatacagtataacatttttacataacatttacattgtattaggtattataattatctagagatgatttaaagtatacaggcggatgtgtgtgggttatatgcaaatactacactattttatatgcggaacctgagcatctttgcgtttaggtatgggggtggggtgcggtcctggaaccaattccttgtggatactgagggatgactgtacgtttgttatatgtgtcatagggtgactctctttaaccttttgaggaactgctgtttgccagagcagctgcgccattgtacatttccaccagcagcatatgagtgttccagtttctctacatcctcaacgccacttcttattgtctgtctttttgattgtagcctttctactgggtgtgaagtgatatctttttgtggtttggatttgcatttctctgatagctcatggtgttgagcatctttttgtgtgcttattggtcatttctgtatcttctttggagaaatttctattagatattatcctattctttaattgggttatttttcttttcatcattgaattaagttctttatatattcttaattcaagtttcttatcaggtatattatttgtaaatattttatctcattctgtgggttctctttttactttcttgatgacattctttgaagcacaaatgctttaaatatggataaagtctgtttttttctcttgctgcttgtacttggatgtcatatttaggaaatcttgcctaaactaagggcacaaagatttaccatgtttttttcctaagagttttatagattttgttcttaaatttaggcctgtgatccattttgagctaatttttgaatagggtattaggtcatcattcttttggatatggctgtccggttgtccagcacaatttgttgaaaagactattcattgcccattgaattttcctggcaccc

SEQ ID NO: 26195 - DNA, 1027 bp, Homo sapiens
tggtaagtttgcacacctgaatagtatttgtaatattaagaaactttcttttttcgttgagagataattcacatatcatagaattcacgcttctcaaagatacgattcagtggcttatagtatgtccacagagttagcaccgcattctgattccacagtttcttcatcaccccaaaaaagagtcctgtactcattagtagtcacttccatttcccagtcccctcccgccagctctgggaaaccactaaaactactctctatctctatgaatctgccttttttgaacatttcgtctgaaagaaataatgtgatatttgatctgtcttcaagactcagctgtagcatcaatcagtacacttcattccttttcatggctaaacaatgctccattgtatgggtgtaccacatactgtttccctgtttctcaattgatgggtatttggagttgtttccaccttgaggctatcgtgaataatgctgctatgaatgcatgtgtgtaagttttcgtgtggacacaggattttcattcttttaggtatactttggagtggaattactggattgtatggaaaccctgtgtttaactttttgaggaagtatgaaatttgagagcagtggtttttaaccttttctagctcacagaccactttgaagaatacccaggggtatccttggctaatagtgctcttgttaaacatcagtataaactcaccaatgaaagaaacccttttaactattaggtaacaaattatgtccaaaaagatttcatgttgcattttttttaaagtaacagctttattgggatataattcacataccatacagttcacccttaaaatgtataattcagtagtttttaatgtattcacagagttgtgcaaccattaccacatccaattgtaggccccccccaaggaaagcctatacccattagcagtcactctccattttccccttaggccttccacaccccaatctctaggcaaccactaatctgttttttgtccatgtagatttgccaattctg

SEQ ID NO: 26196 - DNA, 1063 bp, Homo sapiens
gagttcaaatggacagtttatctgttcaattctagcattgtgatgcaagtggtgtatcttaatttcaaactggaagttaatttgtagaagaaattaaaacctgttttgccttatctgaaacatcagaatggggtgaaaggggttgagaactgtgtttttgctttaaaactgatttttgttattattgttctagatggttgaaccactaagagagaaaatcagagatttagaaaaaaggtatgtgtactttttgtcttaaagtcaatagttaaaataagtttgtctcaattgagtaattaattctgtttgtttgctccaaactctgccaacctaaataaatgtctgtatacgcatttcccccactttgagtgtaatacccagatagaacatggggagaagaatcaatctagatgtgttaagatcttccttcttcaaactctgaacgtctgaatttctgcaaatttattacatagaagttgaggccaggcctcacattttccttgaacttctgcatatattgatcagtgggatagaattccaaaataggaggacaatccagtgggcctgaaatgtaccatatgcaaacaccacaaaataaggatgtggagcctatggtgtgtcatgtgtagtcatttagctgcttttgtcaccagagttcatgaggaggtttccagaatttagtccaggtgaagtgagagggcagaagaattatgtaatatgatagaaatgtttatttgagtcagatttcggagagaacccctcctcaccctttgggacactattgccctcaggttctctctcaggcactcccgaggccgctgagcctcagcctccaggactttcctcttgcacgtactgtatgtggaaaactatctagagtagcagttgaatcttcagaaattttagaaagaaaaatgacagcatttattaaagttgatgtgattttttccccttattgggatgagtttggacgatgtgtgtcagcattgaatgagccttttatcaagtccagaacaaaaatgaaaaaatgaagagcagttttcctttgattttcattaaatga

SEQ ID NO: 26197 - DNA, 1045 bp, Homo sapiens
ctgtgtgtgtgtgtctgttctttggtctgggctgggtattgaattatctctcaagcaaagcaggtagagcttttgataatttgaaaggaggccacaacacttgacatgaaaacattgtaaagattaattggttatagcgcgtctgaagataaaaagtaataagcaagagataaatgtaagaaaagggaaaaattacttggcatgcattcaacgaattttagtgcttggaccatgtatgcctggtgtaacaaatgtaaatatgaaaacgcctcatcttgcagtgagacccacctgtaaggtaccaattagaacaaaacatgcagcagaccttggccacacaggagggccaccagtgtctcctggagcaggagggaaggttgaaggtgctttctggagaatcagatgctcagatgagtcttggaggtgcaggtgcccaggacactacctgtagacgagctgaagggttggggacagcaagtggtttagggaaggtggagagtcacatgcagggggctgcttgcaggggcctgctctggaggtctgagtggcgaagcgtggaggtctgagtggggaaggaagggattcatgaagcctcctttgcagcatgaatcaggaggtgcagctggggaggagagggcacgtctccaggtgcatctccagcctccaggggcagtggaagaggtctgagacacagaagtggatctggtccatatctgcttacatccattcttatccatttatgaagggtggtaaagctttggctgtggcttggacatcattccccagggctgatcctgggaagcatgggcgtcacctgcttccccaggaagagatgattaaggagaagcagtgggcaaggggaaagggctcaggacatcatggtcaaggaaacagaaggtgtctgggatgggtggcagccttcactgctgtgaaatggactgaggatagaaggattgagagatttttgtgaaatcaactttttttcttttttctgagacagggtctcacttttgtcacccaggctggagtagtggcgctttctcag

SEQ ID NO: 26198 - DNA, 1025 bp, Homo sapiens
tccagcctggccaagaagagcgagactccgtcttgaaaaaaaaaaaaaaaaaagagagagagagagaaaagaaacgttaatctaagtgtttaattagcaaatgcctagatctcaggcctagaacttctttccaaataaattattctcttcattgcaaggtgatccaaactcccaagacatacttttatcttttctaatagaaaataagtcttagcttttaggctaagcagttaatatttataagtcactggaaattcaagagctcatgtacatatactaaaaaaaaaaggtgctaagatctttttccttctggaataaaaagaaaactgaatagggaatcaatcaacttcagcaggtaaacatacttcaatatctgtaaatggaagtcttttattattttaattgaggaagctttccatctctttgggcttatcttctgtctctaacatttcaactgacttctcttgaaaaaacactttactcagaactcagaagaatctaaagtctacatgaaggaaaaacacacttaacttacacaaactttaaaaatcctcctccctgactttaacaactcaaaagtcactgtggtttagagatgtgggaataatttagaaatcagaggtaaatttttagaatgttaaataacagattctactacactaaggtgtacttggaatcactggaaaacaaacaaaaacaagccaatgcattattttaaaaactaccattttaaaccacgattaaagagactgtgatcaagatgagtattttcaacccaatacctgtacaccttgatttagctttctgtattagcatcatctgtttcttggcaaacttgatgaggtcttctttgggcaatgtttccagctgaaagatgtggtcatgttaccaacttgttataactcatgtttctagtataccacaaaaaagaaacaatgtctgctagaaaacaaaaacattctacagaataaatctttatgccaaccgcatactttgttccacattttttttttgagacagagtct

SEQ ID NO: 26199 - DNA, 1078 bp, Homo sapiens
gatcctatgctattgcacccacctagaatcaaagccactgtgctctacccaagcaatactaaagatacatcttcaggaaaaagttcttccctacaaaagtaaattaaaaaaactggaaaaagtgactattataccagatgcacagatatcaaggtaaaggacatagaaaacattaaaaagcatggaaatatgacatctccaaaggaacacaataattctctagcaacagatctcaatctaaaagaaattcataagatcctagaaaaagaattcaaaatttcgatactaaaggagctcagtgagatacaaaaagtttccaaaaaacaatacaaagaaatcagaaaaacaattcaggatatgaatgacaaatttaccagagaatagatatcagaaaaaaagaaccacatagaaattctagaactgaagaattcatagaataaaaaacaaaatacattcaaaagcttcaacaatggactagatcaagcaaaagaaagaatgtcagaacttaaagacaggtcttttttttctgatatagtcaaaaaaaaaaataagggtaaaagaatttttaaaaatgagcaaagtcggccagatgcggtggctcatgcctgtaatcccagcactttgggaggccgaggcaggtggatcatctgaggtcatgagttcaagaccagcctggccaacatggtgaaaccctgtctctactaaaattacagaaattagctgggcgtggtgatgggcatctgtaatctcagctactcacgagcttgaggcaggagaatcgcttgaacccaggaggtagaggttgcagtgagccgagatcacgtcattgcactccagcctgggcgacagagcaagactctgtctcaaaaaaaaaaaaaaaaaaaagaagcgaagtctttgtgacatatgcaactccataaagtgaccaaatatttatttatttatttattttgagactgagtctcgctctgccccccaggctggagtgcagtggcatgatctcggctcactgcaagctctgcctcccgggttcacgccattctcctgcctcagcctcctgagtagctgggactacagg

SEQ ID NO: 26200 - DNA, 1108 bp, Homo sapiens
ctgtgttttcatacgtatatatgtatgtcagtttgaccttaggcagagtagcattttcaaaattttacatggggaaattttctagagttaaagccattttatttttctgttctgtctggttttatctgcgtgttatttacaatctgctgcgtaacaaattacaaagttagtaccttaacacatatttatttcacagtttctgtgggtcaggagatcagaaatggttctatttcaaggactctcacagggctgcaatcaagatgttggcatggctggggtctcatctgaaggctggactggagaagaatctacttccaaacttatgtggtagttggaagaatttagttcctcaaggccgctaaactgatggcctgtgttccttgcctatgggatggtagcttgcttcaacaaagtgtgcaagcagagaagacagagagtccgctagcaagatagaagccacaatctcttgtaatctatcatttttgctgtattctactggttaaaaataactcattaggttagcctactggctctcaaggggaagagattatacaaaggcatgaatttctggaggagggaatgagggcaaagaattctgagaagtctgtcttccacaatctgaagaacttctagaaagtaggaggaagcgatattgcttagggatggacaacttggcactggttatgtatttcaagtgaggtaaccttgttcccaagaataaagagaaccagacgactgtaaacatttccctaaactgaaatgcagactgttgtatgttcccctgaaatgaatggtgtaagctgaatataagatttttgacaaaaattttgctgtgttctcagatctggcaggcccctgcccttgtgcaaacaatgttcctggcagctattcatctccttaggtaaataagaattggagaaaagctgtgctaagataggatgcatttgctcttgccttggaaggttgttttctgataaggttctatatcctcagcaaatcaaatcaggcacttacagtgtgagtatgcattctctgcctgccagtctggagatgatcaaaaagcctataacaggcttggcctattttcctattgggttgctgggctttt

SEQ ID NO: 26201 - DNA, 1019 bp, Homo sapiens
tcaacaatttataacaatctgtaactctgaccttgcaataaatagtcataaaacgttatttttattttattactattatttttagagacaaggtctcgctctgttccccgagctggagtgcagtgggagtcacagctcactagcctcaagcaattctccagcctcagcctcccaaagtagtgggatttcaggcatgaatcaccacacctggccttgaaacattatttttaaagcctaaattccagttggtatggtaccaaaatttagtttaacttcaaaattcacagtactgccgagaaatgggcgggtcctgaggttccagagaagtggggagtgaattcattcctggtggttttattctggcagcatgcatgggaaatcacatgagttagagggctgtggcctgctatcaacacttcaagctgttgtacttttacttcaagatgaaacttttaaaatacatctgtcatatagatgtacaaatatatgtagatgcaaacatatatacacactttttgacaaaagaattgtggtaatatacgtgaaccatttttgtaaatagattctatttggttaataaaaatattccttccatcaacctatcgaagtccagaccaactatgaagataggatgcccatccagaagaacgggaagcattttcttcctcacctttggaaagtaaaacaaaaaaaaaaagaaaaataaaagaaaaaagagagtattaaaatttctcaatgtaaaatctatattttagaatcactctacaatataagcaaataatgtgttttttactgattacatgccttttttttgggggggggggttctttttttttgagacagggtcttgctctgtcacccaggctggagtgcagtggcgtgatgagacttcaatgcagccttgatctcccaggctcaagtgattctcccacctcagcctcccaagcaactgggaccacaaggtgtgtgccaccatgcctgggtaattttttgttttttttgtggagatgcgggtctca

SEQ ID NO: 26202 - DNA, 1025 bp, Homo sapiens
aaggaaggggtttatctggccgggggcatcagcaagtctcctgtctcaagggccaagcaccccgagtgagcaattcctgtcctttttaagggctcacaactctaagggggtgtacgtgagagggtcgtgatcgattgagcaagcagggggtacgtgagtggaggctgcatgcaccagtaattagaccggaacaaaacaggatagggattttcacagtgcttttctatacagtgtctgtaatctatagataacataactgattaggtcagaggtcgatctttaactaccaggcctagggtgtggggccgggctgtctgcttgtggatttcatttctgccttttagtttttactttttctttctttagaggcagaaattgggcataagacaatatgaggggtggtctcctgccttattcctcccctttgagactctcactcaatagtaggagttttcactttcattttcttatctatgtcttcctgcaagacagatcgatagtgattcattcatatagtacacttctgctgaagcattttggtgaactaaggtagcgatgaaactttttatcatttgaagaagtacaggtagcaaacaagggagcagtaagcaggttcctattactattataacttttattataagagttttaaatcttcgtagtgctgggaaccattttctaaacatggcctcaggatcaaatccatgccacacttgtacgggcacatgtgtcaattttgttatatctgtaactatgtcttcaactacttgcccttgattatctatgtataggcagtaattagtatggttaaatttcctacagacctcaccttcagctgctagcaagtagtcgagagctaatctatttcgatagatagcatttctcatctgagtttattgccgggccagaagagtcaaggctctgccagttttattagtggttatttttaagacagcttgtaaccgtatgattcagttgatcatgcaaatgggggtctggtatcctcacgagccgtcttgtgccta

SEQ ID NO: 26203 - DNA, 1026 bp, Homo sapiens
gcccagccaccctccctggcagccctgcccacacttgtcacattgccctgtcggatcttcctagcgcttcttacttctgcttccttatgctttgtcttccttctccaactaaatgtcagctcctggagaggagagaccttgtccctcttgttcactgctgtttccccagcatccagaacagcacctggcacatgttatgtgttcagtatttgccaaaatgaatgaatgaacaaaataaaaatacatcacagtgtgaaaaggatcagttagctgggggaaaatggctgctcttattgaatagcccagccgtggccctagtacacagctaatggctgctgacctaccatgagttattttgaatttcatgtctaaataaagctgtgccctttgttggggaattatagacataagatagtattttattgaattaattcttaggttcagttttttagaacaaattctactgatactgattttgtgagaatttttattttaataagggaaccaggctgtcgattcgaactcctgtgcattgatgtcagagcttgtgaaaccaatggtggacgtaaagacgcagagaaaggtagagagggccacagtgcaagggggcagccatgagtagcatgtggatgataatcgcaaggcgtgtaggtttggggtatgtgttaaaatcagttacccaagttttagaaaataagtttatttttcctttttgataatttccttctgtactttgtgtcccttgttttatttctcccacttaagtatccctgtcggtttaactatttggctcttgaggaaattcatcatgccttgttctattcagaatgctcatttgggggactctgcctcagtttactctagctacctctgtgctagcagcgttgcatgctcccatgttccccacagagcaacacatctggtttaatgctctcactgcatctatttcagacccattttcagaatattgcaactcaactttaaaataggaaaacataaccttggcccattggtggctttcaattt

SEQ ID NO: 26204 - DNA, 1027 bp, Homo sapiens
tcccttggaatacttctcctatcaggtggtcactggctcacaggacaacctattccatatttggaacataacagttttattagaccagagtttagctctctggtttcttctctcagtctctgattttcagtgaaatatttcctcaaatattatgtctttttttttttttttttttttttttttgagatggagcctaactctgtggcccaagctggagtgcaatggcgctatctcggctcactgcaacctcggcctcccggcttcaggcaattctcctgtctcagcctcccgagtagctgggactacaggcgcacactgccacacctggttaattttttgtattttagtagagacggggtttccccgtgttgcccaggctggtcttgaactcctgagctcaggcaatccacccacctcggcctcccaaacgtctccccctttctagacaacttggtgtcttagaaaaagataacatagccaggcgctgtggctcatgcgtgtaaacctccgtgagccaatgagcctgtaaacctcaatgagccatcacgcccagctatgtcgtctttttctagacaccaagtcctgctttgtttgcatgaatgccaggtttctacccagaactaaaatgttaatgtcagatttacctaaccagatcagaggaccaaaaataaggttatcttttaaaatgtagattctagacactgtggttgtgttgttagagggcacagcacacagctgattcctatggagctggcttaagaccctagttttttttttttttgaggtaagccacaattaaaccaggtccacctacattctccttggaccttgtctctctgaactgcatgcagaacttcacataactttcatctgtatttcctctcattactagttcttctacatcttttagaattcttttatgagcagtattgtgtgctgtgctgggggtataaaaatgaaaaagacatagctcctaagtaatcctcagggagacgttgctcccacagttaccccagcacatgtgtgc

SEQ ID NO: 26205 - DNA, 1055 bp, Homo sapiens
ctcagcctcctgagtagctgggactacaggtgcgtgccaccacacctggctaattttttgtatttttagtagacacagggtttcaccgtgttagccaggatggtctcaatctcctgaccttgttatccacccgcctcggcctcccaaagtgctgggattacaggcgtgagccaccacaccaggcctaaagttttcattatccttgttttttagcagtttgctgtgatgtccctagatgtgagttcctttggatatttcctgtttgtagtttgctgaaattcttgtatctctgagttcaagtttagaaaattagaaagttttcagtcactattatttagatatttttttccctccctcctaccccccactttcaccttctctctttctctaacttttctccttgtattccaattactggtatgttagatcatttgatactctcacacaagtttttaagactgtcatagttttatcttttttctttctgtgagatttttagcttggataataactattgaacaaatctgtcttccattatttgatctgctgttagtactaaatatattttttacttcagatgttgcatttttacattctagaaattctgtctgctgctttttgtcgttgcgagctctttcatatctttctgtaattccccgtcatgccacccattatatccatctttttcctgtagattctttagcatatttgttatcattatttaaagttcttacctgctaattaaacatctggttcattgtggctctctttctgttgactttctttcttgactgtgaatcacatttttctgtttttttcctgtcataatttttttattgtatagtagatactgtagagatgctagattctgttttcttcttctgcagagtcttgaactttgttctaacaggcaattaaattgctgactgatcacattgatcatgttgagccttgttacaggctttgttaaggcaggtctgcttcagctgtgctttctgattgctgagttatggaccttactcctaaaatgtggcccatctagggtttcagtagaa

SEQ ID NO: 26206 - DNA, 1319 bp, Homo sapiens
ttaagatgttagttttgcctgtcaaattgacagaaatttaaaaattgttaataccctgtactgatgaatatataatgaaatggacccttttatacacttgtgtttattgtgaaatatgtatttggtctttgacccctgacatacaactgctgaaatccttaaaacttccaaagtgatgtcttttgtatgctaatgagatgactggtggctggcagcccctaggtagcttaaggatggggctggtcaccagaaagaacaaggcaagattagagggttgggactttcagtttcatcccccagtctctaggaaagggagaggggctgaaagttaattgataccagtgaccagtggttaatcaaccatgcctgtataatggaggctccttaagaaccaagaaggactgggttcagagagcttgcagatggccaaacacatggaggcttacacacatccatgtgttgggagggtggcataccctcctccatggggacagaagcccctgggcttgggactcttccacatgttgagctttgtatctctttatctggctgtttatttgtatcttttaaaatattctttgtaataaactggtaaatggagcaaatgaacaaattaattgaacccgagatgggggttgtggggaccctgatttctagccatttgttagaagcattggaaaataacctggggctggcgatgagcagaggtggagtgggaatggggcagagtcttggggactagccctcagtctgtgggatctcactctattgccaagtagagaagtcagaattaaattagagggcacccagctagtgtctactacaaaactgattgcttggtgggtgggtgggaaaaaacttcccacatttggtcacaaaattatcctgtgttgtgtgagagcagaggaaaaacagtttgtggttttttttttttttcaactcattgctaatattagaaatataagcaggtaggtccagtctttttgaggggcagtttggcagtatgcttggaacaggaattatattctaggaatttatcatgaagatattgtcagatgcacagaataattgatggttatacaggtgagttgggtggaattctgcaagcagacatgtaggaggagctagcagtgtaggagatttcttggagatgaggggcaggggtagtattgcctgtgaaagttgaagagggaagaaagcaggacatgtgggtgctggggagaaagccttcaggccctgatccagatcttaatagccgtgcaaggaaagaagggaggaagcccaattgagcagtgagagctgcagaaccgtgtggatct

SEQ ID NO: 26207 - DNA, 1039 bp, Homo sapiens
cctaggggtgaacacaggtaggtagttttgatttagggcaggttgggtgagaagtcaggggaggaaagactaaactttgcctttttcaaggtttatctagaacagtgtttctcaacattttttcattattaccccctcaggagaaaaattacatttaaataaaatgtaattaataacagatttaatttttattaaattagcccaggtaattaagttctccctaatgggaggaatccagtactaaagaatatacatttttcagataaggttgagctttggtgagggccacagaccatttgtttatttatttatttttgtcctcccaagaaccgatttctgctctctttagggggagagataatacaggtactgcccccattgagaatgcatgatccatggttagccatcctagcaatagggcaacatatgttttttcttctgagtctgctactagatttgaaaacagtctaagactaaatactctgtacattataagttaaatgaggcattcaagaacttactcaggaccttagctgtttgtaatattgtttctatggagactgtagtcttactccaagcagcttactaatatgaatttttggaaaatacaaattatttgtgtgattatgatttatactacctttaaataagtagaatgaaagctttttacaaaaagctcaatattgagctaaatagtaaacgaagcgatggccatggattagcggagaagagcaggctagacattttagacaggaagaatattcactgtctgacactgtttatatgctgaaacttaaaataacatgagaagcctttcaattcttcactattcatgaaagaaatagctttgctgggcgtggtggctcatgcctgtaatcccagcactttgggaggctgaggtgggtgggtcacctccggtcaggagtttgagaccagcctggtcaacatggtaaaaccctgtgcctagtggtgcgtgcctgtagtcccagctactcgggaggctaaggcaggagaatcgcttgaacctgcgagacggagg

SEQ ID NO: 26208 - DNA, 1024 bp, Homo sapiens
gataagagtagaaattaatgaaatagaaaacagatggaccaaagagaaaattttaaaaaagacaaaagttgattctttgaaaacattaataaaactgaaagatgcatagtgagactattaagacttttttaaaaagtaaaagaaaacaaactattaacatctgacatggaaatagagacattatcacagatccttcagacattaagaggccaataaggagatattataaacagctttataccagtaaatttgacaacattgatgaaatagataaattcctggagaaccataatttactgaaactggcataagaagaaatagaaaatgtgaataacctctggtaaagatattaaacctataattaaaaaaaaatcttgccacaaagaaaacttcaggcctaggtggcttcacctgtgaatttcttcaaacatttaaagaagaaataataccaatcttatacaaattcttccaaggaacagatgaaggagaaatgtttcccaacttatttcataaggccagaaaaaacatgaccccagaatatgacaagacattacaagaaaggaaaattaccagacagtatccttcatagatatagaaagtaaaattctaaacaaaatattattaaattgaatctagcaatatataaaaaggacattatgtcataaccaattggggtttatttcaggaattcaaatgtacattcctgggtaatcacatttaacatttgaaaatcaatcattataatttgccataagaaaaatcatatgatcatcttaagaggtaaggaaaaaacatttgacaaatttcaacacccatttatgatttttaaaaaattatctacaaactaggaatagaagggagagtcctcaaattgcaaaatgcaacaagaaaaaacctaaaactagcattatcttacttaacagtgaaatactgaacacttttttcctaagaccaggaacaagtcaaagatatccaagaaataaaaagataactcagttttctaaagggacaaaagacttgaata

SEQ ID NO: 26209 - DNA, 1032 bp, Homo sapiens
ccttttctctgatcttcttccaagcaagacttttccaaagaattatctccatttggaattttcattttccttactcattcttggctttccctgtatttggcaacttttgtctataagctcattttaaagaggattcatgctgggggacaaggggtgtcctgtataccctgagttgttgagttgtcatggaagggctgctttgaggatgcctttgctgggaaggttcttcccagtactccctaaattcccatcttttcatccttcaggtctcgcggtaaattctgccttcccagagatgccttccttgagtaatgtgggtttcccttactcccattcatgtgaacaccctttatagctctatgtcccctaataattattttatttatttgcttgtctacttattttctaagaaaattttcctcccattcaactgtaaactatggagggcaggggacatatctctgatttatctttgtatttctagaacctggtgtagcatctggcaagagtagaagctcaaaaattatttctcgaatggataaatgatgttattaaaagtattattcatgactaaagcatggaggaagagcataaaatgcttttgtgttaagaagtaaaactaacgactttgttttttctgaagtctccaaaaagtgctcatagatttctgcattttacaaaaatatttgaatgaatccttgtcatcatggggcatattattggcctaaaagtctttcttaaaggtgctttaagatgatcttttatgtgtttgtatctgtaagttttgtactgctgtttttatccataaatctatattggcgcttctattttggaaagcaagttcttagtaagcagcgtggcattttggaagtgcctgtactctagttcatagcataacattatggatttttgatttggagtttctttctttgtaagaaaatgaagaaaaaatgattttttcagggaatcaatttcgagcaaattacttcttacaaccagagctcatgccttcacaactggccttcagagatc

SEQ ID NO: 26210 - DNA, 1075 bp, Homo sapiens
tccagattatccaattctagcagtattgtatgtatggctagccagaagcagatagtttgggtttttatttaaagggagagagagaaaattttttgacttgcagtattgctaaaagattacttatcttattttttggaacaagatgtataagacagttaattgggtctttaatctctctcatgtataatagatatagtgtttccatacttgctgcattgtattgtgtttaggtgagagttgttatactaaactgtccaagcctgtggaagtcagatgcaggggtggggttatcctgcatattgaaggctacattttagccattatttatgctttgtctttttcaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaacttagttgttataaatatttcaacaaaatatacaaccccataaggtccctatatagcaggctgattgggctgcttctgggatgcaagcatttgtgagaataattcagacatgagcattctctagaaatcactttttaaacactgacctgtttaagccaaaaaagggccaagacagctattttccaaatttgaagtttggtgtctgtgtaaacacacacacacacacacacacacacacacacacacttccctaacatttccaagggacttcaagtttttatgaataaagcttgcctgtcctttattgtacctgttcttcattgctctctacgaagtacaaatcctaagcctgtttattttttaaaagtaccaaaggaaaatctctgatcttaaagtctttctt

SEQ ID NO: 26211 - DNA, 1050 bp, Homo sapiens
gctatcatttttcagaatacgagattggatatgaatttcacatacctgatttgcaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattagtaagtattcatttttatgatgagcacatgaatttaaaatggatttttggcttgtaccttgcacgtacttttgtggttggggcttttgtggagtggtgggcaggggcaaagctctcaatttgaaattttattaatcttgtgcaactaactcaggattccactttccattgttcctagaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacgggcaagtgttatgcttttaacagggttcttctcttcctatttccatagcagcctttcatcatttgtgctcatgcagcctggctttgtttgtgtttaatatagatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccaggtataaaactaaagtgagggacttggaaatatttttctgtgttgcgcttatcagattttcaaaatgaatttggggatctaggtagtttgaggtggtcttttgaggagcagttgaaggagagatgagcctaaggccaacatggcagggatagaattctattcctgaagaatactctgctttcttattagtccattatagatcctgttatcaggaaaggggggcag

SEQ ID NO: 26212 - DNA, 1093 bp, Homo sapiens
ctgttatctttgggtttccctacggactttttaaataaggtctcagatgtgcagttctttacattataactcccccagtactggttccagcagtggtttctgttcctgggcttctagtttggcaagctgtgattctctgcgtccacttgtctgtctctaattttggaggaagcagattgtcctttgacctcagttctctaatggatctcagaagcgtcgttgattttcagccatttggcttactgtgagggtggagtgatgactccaagctcctcatatgctggaccaggaaccagaaatctactactttacatctgattttgaacatgtgaattcttgtttttaatttaatttaaaaatctactagtacagtctaggtgtgttagctcactcctgtaatcccaacactttgggaggccaaggcaggaggatcacttgaagccaggaatttgagacaagcctgggcaacatggtaagaccccatctctacaaaaaatttaagaattagctgggcatggtggtgcacgcctgtggtcctggcttctcaggagcctgaggtgggaggatcacttgggcccaggaggtcaaagctggagtgagctattaccttgccacagcaacccagactgggcaacagcaagaccctgtctctaaagaacaaacaaaaaactactacaacttcacctctgtggtcttccccccaaaatccaataactccaaagtaaccacaagaaatgtatcaaacaaacccaatttgagggccattctacaacatacctgactagtactctttggaactgtcaaggtcatcaaaaacaaggaacatctgagaaactgtcacagtccagaagtggctaagtggacatgatgactaaacataaagtatcctagaacacaggcaaaaactagtgaaagtgagtaagatgtagagcttagttaataggagcatactactttggttgattgattatttgtgacaaatataccatggttatgtaagagttaacaactgcagacagtggatgcgaagtatacagaaaactctatgtctttgtaacttctttgtaaattgaaaactatttaaaataaaagg

SEQ ID NO: 26213 - DNA, 1098 bp, Homo sapiens
gcatccttcaagcctctaataacaacattttgttaaaaaacaccttatttattatatattgtcaattcattaacattgaatttatgtccagcaacactgacttacatctaaataaagcttatctaatacacatattttcacaggtttctagtgcttaggaacattagagagcacttcagcactatactttgggaccattttcaataccaaaatcaccaagaaaaagcacaaagacacaaaaattgtgacactaagtacagctcgaaaaggatacttgtttgcagtatgagagctggaaccggaaggctgagtgtcaccttgttcaaccttagctcagaacatgtatgttaggtggctcaatttttcatcactctgcgttctgtaaatgactgaaaaatcactatgagtattgatttgaagcttacaaataaattttagcatgcaggtgaattcacaaatatgaaatccattaataataaggatcaactgtatactgtgtgtgtgtgtgtgtgtgtgtgtgtgtatggatgtatatgtatacatatacttccatgtacagtcatgcagttgcttaacaactgggatactttctgagaaatgtgtctttaggcagtttcattgttacatgaacatcagagtgtatttacatgaacttagatggtttgattagtttactacacacctaggctatatggtataacctgtggctcataggctaaaaacatgtacagcatgttattgtattgaatactataggcaatggcaacagagtggtgtaagaatttgtgtatgtaaacatagagaagatatagtaaaaatacagtgtaaaagataaaaaatggtgttctgtatagggcacttcccatgaatggagcttgcaggactgaagttgctctgggtgggtcagtgagtgagtgagtggtgagtgaacgtgagggcctaggacattactgtgcactgctgtagacttcagaaacactatagttaggttacactaaacttataagaaaaatttttcttcagtaataaattagccttagcttactgtgagctttttactttataaacttaaaaagttttatctttttgacttttgta

SEQ ID NO: 26214 - DNA, 1063 bp, Homo sapiens
ttaatctggactccatctattttgaatggaatcaaatgtgtttaatgcaacttttaaagaaatacagccatttctttttcttagaactaagtatcacatttcagcaataagcattgcctatcctatctggttgtttaaaattattagttaggttttacatttcttttgggtacttcctggcatgttgagttgatcagaaaattgtataatacttattttaaaaacgttttagttgaaatttctgagacagtgtgaatgagttgatttacttcttatgattcctactggaaggatcaggggaatttattatgtgataattttacttacggttttacccttaatttctccgtattttatcctcttttccctcatagctagaacctcagaacctctgcataatgttcaggttttaaatcaaatgataacatcaaaatcaaatccaggaaataacatggcctgcatttctaagaatcaggtaataatgacatttgtagcttgtgtggaaactgggaatggtattgaatggccagcctggctgccttctacatccactttgacatctcatttctttgatctttctcttcatggctctgagctccatgtcagccacctgctcctgtggcaacttcctgggcctgttattctcccacacagctcacctcaaatacaatttgttgtctaacccagaggccctcaccacacggcctcctgtctttactctccccaccagcttttcccttaccaatgtcctttcctctgttctgctggcctctgcataggctctggaaatccctactgggaatggatccacctgggggcttctgagcctggctttcaaaactcagagcctcaaagattgctgcctgttacctcaagtaacagggaggtctcatactcccaggcaatgggtcatactcccaggcaatgggacatgcttccagtgtctgattcactctttatgttttgtgtatctcttatgtttccaggttcactctagcgccaaactatagtgattttagacttcttttcagtctcttcaaacttgggacctcgctacctctag

SEQ ID NO: 26215 - DNA, 1035 bp, Homo sapiens
aaaacaattaagtcataggttcaggaagtaaaactggtccgttttatcagttctttgcgatcagaagaccgagattgttaaatgcagtcaaaacaaaaatccatttgctctaagactttttctgtaaccttcaacctagccagcaaattattttctttcagaagtcccccgccccttttttaaaggtaaagcagatattcctggtcctgttttgacttactaaagattaatgtgctttaatgaactggatgttttactattacagtgcatttaggtcattttactagagaaatgtggttggtgttagaatatgaaatgtttaccttgggcgagcctactagacatattttggaagaaaggttctgaaatagggatttgtccctctgctataagacatgagagacattcaaacttcagaattattattttttttagttttaaaaataagcaatgcgtttatatgactaaaagaagatttagaacagtatttaccgagaactcctgtacctgactactgtcccactctgtcacatgtaaccgtttttctagtttctttttggaaatataaatatttacattattataatatattaaatgtctgcacgtttgtatacattttttgcctttaccacacataaaatataacagtatatatatacgctgctcttttgcctaacaatatccctggagatctctaccaatacataaagttctttcttattctttttttacagctgtgtaatacttcatgtaccctaattgatctaagcagtcaacacaggttgttgacaatctgtttcaaatagtggcacggtgaaaaatcttgtacataacattttgcggatacacatgtgtatgtgtcttctagatctgcagaagcggtttgttggatcaaaagcaaatcagtccagttttggtagataattcccttggcaggaattgagcacatgcccacctacaagcaagatgcgacagagagcctgtttcttattgctgcacctacacaatcttttcacatgttttttagttttgcca

SEQ ID NO: 26216 - DNA, 1051 bp, Homo sapiens
gcagggaaactcctgtttttaaaaccaccagatctcatgacacccattcactgtcaggagaacagcatgggaaagacccacccccatgattcaattgtctcccacaaggcccctcccataccacatgggaattatgggagctacaagatgagatttgggtggggacacagagccaaaccacatcagcaacatgtcagaacacagaaaaaatgtaaaatatcactgtatttctatgtactagtagtgaactgtcagatgttaaaattcaattgcttagaatggcatcaaaaatatgaaatactggccaggcgttatggctcttgcctgtactcccattgctttggaaggctgaggcgggtggatacctttgaggccaggagttcaagaccatcctgagcaacagggcaaaaccttgtctctactaaaaatacaaaaaattagctgggcatggtggcctgtacctataatcccagctacttgggaggctgagacacaacaatcacttgaacctgggatgcagaggttgcagggagctgagattgaaccactgtactccagcctggggaacaaactgagactctgtctcaaaaaaaaagaaagaaatacttatgggtaaatctgacaaaataagtgtaagacctgtacactaaaaactacaaaacattgctgaaataaattaaagaagacctaaataatcggagagatatactttgtttaaaggtcagaagtctcagtattgctaaaatgagaactcttcccaatgcagtgctaatcaaatttctagcaggctttttgtagaaattgaaaagcagatttgaaattcatatggaagtgcgaacaaaaccaaaagagccaatataactttaaaaaagagaaaagatgaagttctaaaactatctgctttcaagatttattataaagctacaagtgatcaaaatattctagtactagcagcaagatagaggaaaagatcaatgaaccaaatagaaagtccagaaatagacacactcaaaaatatggacaactgattttggacaatattgcaaaagca

SEQ ID NO: 26217 - DNA, 1049 bp, Homo sapiens
actatgaccaccaaaccaacaaaaatgatgtgaaatgcaatttcttaatttcagtctcaaactgtgcctgggccaatgtatgtgaaagcccgatgtccatgtggattcaaatcctgattcactcaggcatggtacttaacattctaagcctcagtttcctcatctgtaaaatggctttcctatctcacacaggcagttagccaaggcctgatatgcagaaagtgctcagctgctgtgactcttcacccttcctgtgagatgccttctttaaccccacagatgtgtaccatgtgatggccaagggagcttcatcaatcatggcatctcaagggagctggagcagatgaggaggagatggaggtcccaggaagggctgtgatctgcctggggtcccacaatgggaaacaggcatgagctctccacactccctgtccaatgctctttccactacaactggctgtcggtctcccataggacaagaaaaaacagtcaaaaaggaaatcgaagggatttttgtttttatccctgttcttttgttggttctatctgttctgttttgggtattttgtttgtttttatttgtgtactttttttttttttaaatggagcttccatcatgtaggagtagggtgtagaaatctgagttggtggctccctggtataagaccatagccttcattttggtgagtaacaacataatttctgctttgagtcccattttcttgcagtggaagcttaatctcagagtatcaaaatcactgcatctgagcgtgggcctccccacatcatgggaggagaaggatgagtagatgatgtctcatggagaggacctgccaggatccctcatcgctggccttcagctttctcatctgccctcaaccacagaaccctgggaggaggctccctcagtggctcgtgcactcttgcaggccctgtgaacatatatacttcctggtgggaagagcaagggagcctctggtggaaagcagccccagggtccaagaaccacacagccctgcattagggcccccagggagggagaagaccaa

SEQ ID NO: 26218 - DNA, 1031 bp, Homo sapiens
ccctcaaagctcagcttctcacagggtcctctgcctttctcaggggagcttggagaatgggggaattggccctcatggggcagagtggaaaaagggtctatcttgtgctgaaaacagacacttatatgactatacggagaatgggtgctatacaacatgcctaactcttggattgatttttctagaaccaaggagtagaggtggggcaccaacactattccagctggggctccaaattcctgtctgtaggatggcctctgcctgaggtcagaaagcaggagcaccgtgaggttcaggaccgtcttctgcacactggctaccaggaccaggaggctattctatgctctgtccatcctcactgtttaaccagaaagggcatgcccaagcctacagcaggggctgacagcatctacagggttagaaagagatggggtccatgagggttccaagtccagggactgaaaacaatcccatggccccagagacaaaattacagctcaagtcaccatgttcacaactctaacgtcaacacaaggctccctcaattgccttgctgtaaaataggtgaataggtgtagtgggagattcagtggccaagcctgggtcccaggtaaggtgactaaccatcccagttttcctgaacagagaaatttcccaggaaactttgggttttaaagccaggaaagtcccaggtaagcaagggtgagttgatcaccctggcagggaactgattcattcaattctggataattgaataaagtccacatcctcaccgggaacattctactgaatgataagaagaagttccttctagttttgcctgtttcttttccaggatctgggtccatgggacccctaccttatcaactgtccccatacccaggccctggctctcatccctacattgacctccaccccttcctccacaggcaggccagaaagcagacccagggaggatagcacatgtcttcggctacactggtgaaggcatcgtgcctgctccacagcacatttttattcaaggtattgta

SEQ ID NO: 26219 - DNA, 1043 bp, Homo sapiens
ctagggattctagaaaagctctctaaaggagactgacatgtaataggcttagcattttgcacctgaattctctccttccccctgtctggaatgcagacgtgatggctggagctccaacagccttcatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctgtgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattttcgtttatttgtggttttcctctgattttaaaataaatcaaaattaaaacacttgtgcaggcccctaacagtatcatgggccccatgcactgtgcccagcatgcccagtggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattctccatactggctcaattatttgtttaacgggtatgaattccagtctataatgccaaggtatcaaaatgtgacgtacctttactctagaaatctctaaattatattaaatctgctccaagat

SEQ ID NO: 26220 - DNA, 1054 bp, Homo sapiens
taattttcttagtggttgtcctggggattaacattaacatcttaatttataacaatctaatttataacaattagattaatacctactcaatttcgatggtatacaaaacctttgctcctgtatagtctcatttgcttctttgtgctcttattgccacaaattacatctttatacattgtatgtccatcaacttaaatttacaattattgcattatgcagttgtttctcaaatcagataaaaaaaaggaattatatgcaaacattcaattatactctcttttacatttatctatgtatttacctttgccagtgctctttatttctgcttgtggactcaagctactttaatttcatttcagcctgtggaactccatttaatatttcttataaagcagatgagctaaggacaagccctgtcagttttggtttatgttggatatcttaatttcttcgtttttaaaggatagttttgctagatatagaattcttagttgccaattttttctttcagctctttgaatatgtaatctcactgcctttgagcctccatggtttccgatgataaattagctattaatcttattggcaaatctttatatatgacgagtcacttctctgttgctgcttttaagatttctctctgtcttgagctttcaaccatgtcattatcttacatcttggttggggtatatttgagtttatcttatttgtagttcttgtagcttctcatatgtgtagattaaaatttttcataaaatttgggaggtctttggcctgtttgtttaaatattgtttttacacattctctttatcttctccttctggggtacccactgtacatttgatagtatgcttgacggtatcccagaagtcactgcactctgttcatttttctctattcttttttctttctgttcctcatactggattatctcaattgacataccttcaaatttgcagattctttttttctgcctgctcattttgctctttatttcttgtaatcatttttcatttcagttatggtacttttcaactccagtgtttctattta

SEQ ID NO: 26221 - DNA, 1036 bp, Homo sapiens
aagcaatcctcccacctcagcctcccaagtagctgggactacagtgcagtggtcaccatatctggctaatattttattgtttgtagagacagggtctcactatttgtccaggctggtctcaaactcctggcctcaagcgatcctcctgcctcagtctcccaaagtgctgggattacaggcatgtgccactatgcccagccagcagatacccttgaaaacgtgatgtatcatataatacaagcaatgtgcactctccttgctatttgaaatgcctctgaaaatgaaaacctaattcttcactaaaaaattgtgttgcggcggggcgcggtggctcacgcctgtaatcccagcactttgggaggccaaggtgggcggatcacgaggtcaggaaatcgagaccatcctggctaacacggtgaaaccctgtctctactaaaaatacaaaaagttagccgggtgtggtgacacacacctgtaatcccagctacttgggaggctgaggcagaagaatcgcttgaacccgggaggcagagcttccagtgaactgagatcatgccactgcactccagcccaggagacagtgcgagactccatctcaaacaaacaaacaaacaaaacccaaaaaacaacaaaaacaaaaacaaaaacttctgttgcatctgacatgaaaagggcacatagtcttcaaatgtcaagttttctccatagcctccctgtcttgcttgggctgtaactccttattccagccatctctttgctaattccttcagtcatcgtgggcttcattattgtcaattcttaatcaagcttcaattttacaaacccagcctttacattttggtgaagcaattttgggagatttcccacaattcaggagaaagcatctggaacaatgcaaactcgaagaacaaagaacaccagaggagtctcatgatgctttgattttttcttatttcttttctttatcatgataagctcttttttttgtttgttttcaactgtgcgttgccttattctcatatacttggattaaaaa

SEQ ID NO: 26222 - DNA, 1084 bp, Homo sapiens
ttgctttggcggccatgtcttacctttttagtactgttctggtctgttgcggtcttttgtccacaactaattttcaggtatcaggattacttaaaatctaatacatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaacccatatgcaggttctgcagggccagttgcaggacttgagcatgcacggatttgggtacgcatggggtgtcctaaccaatcccctgagtattctgagggccttgactgtacttttcagcctgccacagtattgcttattttatttttttttagatgttgtttgctaattgattcttattttcaaatgttttctacatgttacatgttttctttaccaggatgactatcaaaattaagtttcattttgttgccttttagccccccagaagttgcaagtagaacaagaggaaaacaggtgacttttatttagactgtgcttttatgtcaaacacttaaaacaatattatttactgttctgcttaataactttatgttttattctcttataggtttagtttcaggcattctacatctgtttctagtctagctgaaagattggttgtctggatgactaatgtaggtgagagcttctttgttacctcctaactaggccgtgcttcctccagactagctagaagtggaaggcatgaggagagaggggctctggctttgtgaaaaggcctcacaagattgagattatggttcatcaagccatattctttttttctcgacaatctcacaactttcatataataatatttgggataccagctttttatcttgatgcataaggaatctttatttgccatttaattggaacatttgaggctgtggctatgtaagctggtctctgagaatggagaactctaatcacctacatacacacctgaaatcattgtgatactcagatatcagaaatgggtggttttggcaaagt

SEQ ID NO: 26223 - DNA, 1053 bp, Homo sapiens
atgtaattactacaatgaggatatagaacatttacatcaccctcaaaaatttctctcatgatttcgagacttatccaagttgtttcctgtatcgacagttcatcgcattctatggctaattagtagtttattgcatgaatgtgccatagttggtttttcattcaagatagttgggttgatttcagtttttagcaattgtaaatatagatgctgtcagcattcatgcttagcgttttatgtgaacataagttttgctttctctaggacaggtacctgggagtaggattgatgggtcatatagttaagtttatattttgtttttaaagaaactgtcatctgttttccagagtggctcttccattttacatttttaccaccaatatttaagagatcatttacctgcattcttgttggtgtttggtattgtcactcttttttatttttgtctttctgagagatgtgtagttatacctcattgtggttttaatttgcattttcctaatggctaatgatgttttcagggttctaggtatgaggttttgtcagatatgtggtttgcagatattttcttctggtttctaccttgtcttgtctcgtcattctcttaatacatcaaagagcaaaagtgtttaattttgatgaagctagtttatctgtatttttctttaatggatgttgcttttagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttaaaaagactatcctttctctattgcatttgcacttttgtcaaaagttaatttggccacattcttgtgtgtctgtttctggactttctattctggttcattgatctttgtggctgtctacgctgtaattactgtagctttatagtaagtctttaaaattgattagcgttactcctcccttcattactctt

SEQ ID NO: 26224 - DNA, 1066 bp, Homo sapiens
tctgacctatgtgggcaaaagttcctgtgctttttagtagagtcccagctccagttacggtaggtgtatgtctttcccattgtttctgtataaataacttagcactgctttttctttttcttttctttccttttttttttggcttaagtagttttatttagaaataatttacatgtcataaaattaacatgtttttactgtataattaaatgatttttagtaaattacagtgttatacaaccatcaccatgacccagttttacaagatttatatcaccataaaaagatttccttgtgcttgtttgtagtcagtcttgttcccatttccagcctcaggcaaccatgctaggcttctgcctttatagattaatttttctggacatttatatatatataatgtatgtacacacagtgtacctttttgtgtttagctttcacttagcgtgatgtttttaggatccaccattttgtaacatgtatcattatttcatacctattgctatgtaatagtccattgtatagatctaccaccatgttttgcttatctgttcatcagctgacggacttttggtttatttccacctcttgactactgagaattatgaccatatgaacatttgaacaaaggtcttgagcaaaaatgtggacatatgtgattttatttttcttgagtaaatgcctaggattgggtcattgggttgaatggtaaattcatgtttaactttttaagaaatcaccaaactgttttccaaatagcctgtatcattttatattcccaccagcaaaatatgaaggttaatgtctctttatccttgacaggattggatatcatcacactctttgattgtagctattttctagtggttgtgaagtggctttaatttgcttttctctaatgcattctgatgttgatcatctcatgaagttattagccattcatttatcttcttaggtaaaatagctattcagatcttttgcccatttatttaccttcatattttgaaatacgatagattaaaggaagttacaaaagagtaaacaagtcctgtgtaccttgcattctttt

SEQ ID NO: 26225 - DNA, 1029 bp, Homo sapiens
gttctttaattttcccaaagaggggtgtttaattctgtttggatttttgcttgttttcttcagctatatgttttttgttgttgttgttttgggagatgagaactgggagtaagggcggctctgctggtaattttcatgagctgatgtgtttttgttctctgttttcttctgtaggtagcaatgtacagataaagagtactttaacgcccatgcgtgttcaagactgttcaagactggtgatttggagtagtttacaagattcctcattcagagtgccctcttgtgtgactggggtgatgtgcagcttccataatggatgggacagagagctgggatctaatgtacaagtgaagggcttggtcttccctgagacattccagccattggaataggagaggagcatatatggcagaggtgatggctggtgggtaaatgtgatagtaaattgtagaaacctcttctgattgattggatttccttaataaaatcggaagcaaggttaggctgagtgagggtgagtaaagaggtagaggaggtttgaggagagagaactgctcggaagacattggtagatggaccataaaaacagagttagttctctttatgacattaaatagttttacaacatatttttaatggttcacaatttcattttagggcttaaaataaattatggttctatgatttttttaaaccagtttcctattgttagacatttgtttccagtttcttactattataaataaagtgaaacaatatctcttactataccatttctaaatttagagttcgtaacttttctgttgttaaaatataagaatatttatctttctcattggtttataaactgtagtcagattatacacttgtgtgagttacaaactttaggagtgtgatggtatcattaacacaagattcaaatactaatgttccaagtacaaataataatgagattctaaatatgcagttttatatagtaatattgattattggttattattagacaaataccatgaaatggaaactcgt

SEQ ID NO: 26226 - DNA, 1032 bp, Homo sapiens
tatagatttattattccttctttaaatattctttactttttttttctttttttaaattatactttaagttctagggtacatgtgcacaacgtgcaggtttgttacatatgtatacatgtgccatgttggtgtgctgcacctgttaactcgtcatttacattaggtatatctcctaatgctatccctccccactcccccaccccacgacaggccccagtgtgtgatgttccccaccctgtgtccaaatgttcttatggttcaattcccacctatgagtgagaacatgcagtcaacactcatttcttattttaaaaaaacactaaagaaaataggaatagatggatactttaaaagttttttattgtgataaaatacacctaatatttaccatcttaaccatttgtaaatgtacaattaagtaatgttaagttcattcatatagttttgaaaccattaccaccacatatattaccagagctcatgtttttaatctcaaaactaaaaccctgtatccattaaacaaaaactccccatttcctcttgtcttcaaggccttgacagctaccatcctgttttctgtctcttgtgattttgactactttagatatctcatataagtgaaatcatacagtatgtcctttttttatctcatataagtgaaatcatacagtttgtcctttttgacagacatttctgtcaccaccatcctattttctgtcccttgtgattttgacaaatgtaggtatctcatgtaagtgaaatcatatagtatttgtccttctcaacaggcttatttcatttagcataatgtcctcaagattcatccatattgtaccatgtcagaatttcttctttttttagggcacagcctccttttgccctggaaacacccagacagcagggcaggcaactccaccctccccccacctcttgtagccagacaggccaggccacacctgctagagcttccaacccagtggtcccacttctacctgaactctgcaggcaggtgcaaccccgtgtttactcagg

SEQ ID NO: 26227 - DNA, 1054 bp, Homo sapiens
gatgtatcttaagtgtaagtgggttttcatatggaccattacagtttacttggggtgttttacaaaatgataaattattgaagacatttaaaagtactgtcaatgcaaaggcagaaatgtaatgtgtgaactgtaatactgtaatcctctcatatcaaataattaagatttaggggtttagacttttaattcagtcaaaggcacacaatgtacaaatttagaattttccctcaaatcatctttaaggatagatatgtcatagtggtttgttagtttgtttttaattctggaaattttttcttttttttaattctggaaattttcaaatatatgagtggagagaatagtatatgaatcccatgtacctattacccaccttcaacaatgaccagtttatagccaatcttgtttcttctgtatagccagattgttttgaatcatgctaggtttttaaaattgaagttttaatttttacttagtttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacagggtaagagtcaaactattttatcatttaaagtttatctagagaagcagtcacagttgtccatatacggacagaggatttttctttgcactttatcttatgataagactatggttttcatgaatatttataccagacatgagcttgcatggccagagaccccatctgagacctggccacttggtgcattaaatgcttagtttgtagagggagctggaggatggaggtgggttatcaaaggccctgactatttctaaagggagaatgctaaagccctggcctctgcatgtgtgaaggataggatatgcctgcttgtattgctgtcatttaaagaggattgactggaatggttgtatgtcagact

SEQ ID NO: 26228 - DNA, 1065 bp, Homo sapiens
ggagaatcgcttaaacccgggaggcagaggttgcggtgagccgatatcatgccattgcactccagcctgggcaacaagagcaaaattccatctcaaaaaaaaaatgagttttaacacactatagaagaatgggttaaattgtcactgagacttataagacagaaatagactttaatagtgtatcttttacttagctttcttgcttgcttgctttttctttttctttctttctttttttccttttctttttctttttctttcttttctttctttctttcttttctttctgtctctgttgcccaggctggagtgtggtagcatgatcttggctcactgcaacctccttctcctgggttcgagcagttttcccacctcagcctcccgagtagctgggactacaggcacacgccaccacacctggctaattgttgtatttttagcagagacagggtttcatcatgttgcccaggctggtctcaaactccagagctcaagtgatctgccagcctcggcctcccgaagtgctaggattataggtgtgagccaccatgcccagcctccttagttttataaaagaatacaggacagatgataaagcaggtacagtatcttcatcttcttggaagcctctcagctacccaagtaagcaacttcttttcccctttggggcctatgtggcttccaaagatgagagccaaggttgacgacaagaaattgcaacttcaacttcccacaagttttttatactgcttgagtcacataggcctcagtcttttatgcccacttttagctcctccagacttcgtattatatattataaccttccacagcagacaggcagaaacaacattctacaactgtcttacatagtttctgcaaaacagtactgtgagaagatggactcctaggttattctcaaccaggcttgcttcagtgcagcctcttcactcacaagtatgtaaaaggtgaatacattatcaaataaatatcacagctaattaattaattaacttatttatttttgagacagagtctcactctgttgcacaggctgcagtaaagtgg

SEQ ID NO: 26229 - DNA, 1043 bp, Homo sapiens
aaaaccaattctttagattgtttttgccaccatttgcttacttggaatagctttcacatttatttttcttatgaagaaatccagtgtcagtcagaccatgtaacatcaaagcaaaatttcattgaagcctatccttgtcttaattattctaaaataaagtacaataaagtgaattattttgccctttgtagtagcatagtgttaagttatatatatattttaatatgcatactcctaagtaaagtttcagagaccacatgctggagagcagtggctttcagacagcatcagcatcacctgaaggccttgttgaatacacattattggaagagaggggagaacacaggctcatgcctgtaattccagtgctttgggagactgaggcaggaggatcacgtgagcccaggagttcaagatcaggctgggcaatacagcaagacccctgtctctacaaaaacaaaaacaaaaaacaaacaggcatggtagtgcatacctgtagtctgagctgcttgggagtctgaggcaggaggatcacttgaacccaggagttcgaggctgcagtgagttattattgggccactgcagtccagcctgggcagcaaagtgagaccctgtctgttaaaaaaacaaaaccaaaaacttgattgctgggggccaccctagagtttctgattcagtaggtctggcggtggggatggtgggcctggtaatttgcctttctaacaagcgtccaggtaatgccccagctgctggtcccaggaccacactttgcagattattactctgagaagagcactaactctgacgttggattccttctgttcctcattagtgaatttatttgggggagattattcaatctggtagatccgcatttacttagctgtgaagtggaggttaatgcaacctgcctgagactgtgagaatgagaaactctaattgaaataccaggcccagcgtgcctggatgcttgaaaaatgctgactcccatggtccgtccttccctcactcttctcagctataaagtgagaagcgaaattcag

SEQ ID NO: 26230 - DNA, 1249 bp, Homo sapiens
gctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtctatttgtgtattgtagatgtatcaagtgatttctaatttttttcacatatgaatgtgccagattactctagaactagatgtctcttctttaaataattttagttttcctgaataaatttgtaatggttaaagtaccaagtaagtaaggcgagaagggattctgtttttaaaatcacatcagaacttttcctctactaagattataaattaaatgtaaaatactcctaattgcaattcttaaacttaggccttacatgtacttattatgcaactgctcctggactctattcaccatagatatcagtaaacgtatgtcccaggattcacaggcttttgattaatcaatattcttttcaagtttgctgtgaagagtttagttctcttcaaaatttcttaactaatctgatttttaagaattctctttgcagtgtttagcttcctattcacattcttaaaattgctttggtgttaccatgagtctaaaatgaagtttagccttccttttgtttcattctgagaacttctatattatattacctttaaaaattgtttatgatattaaatttaaaatacaaa

SEQ ID NO: 26231 - DNA, 1028 bp, Homo sapiens
aagtatgctttcttggctttcctttagcctattttccaagcaagaactattgttgttggtaatttaggtgcatggaatagtaagttgaagtcttgaattcttatttaataataatacacttaatacattgtcagtgtttaattttgtcttcccattgttcttattcctgctagttttcacaaatagaaaacttacattgaaggggaaaattgccttaatgataattgtgggtgtgttttttcctctatcttttatttttaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagaggtaagtttagtcccaatacacatttttaaaaatagtgtttgctagataactgagaattgcatcatgctggcctagcttttagagattttgtgaggaattattgaaagatgataacttatatgttacggcagatgaaaataaaataattggtttagatcttttgggtaataagattctttctcctttctttctttctttcttccttccttcctttcttcctttctttttctttctttctttctttctttctttctttctttctttctttctttctttctttctttctttttctttctctctctttttctttccttttctttccctctttctttcttctctttcttctttttttctctttcttgacagagtcttgctctgtagcccagcctggagtgcaatggcacgatctcagctcactgcaacctctgcctcctgggttcaagtgattctcctgcctcagcctcctgagtagctgggattacaggcatgcaccaccatgcccagctaatttttgtattttcagtagaggcaggtttcaccgtgttggccaggctggccttgaattcccaaccacaagtgatttgcctgcctagtaactacatttttttaaaa

SEQ ID NO: 26232 - DNA, 1024 bp, Homo sapiens
aggatagttttactgttaatttagattttaccaataagcaagagtagtactattgctggatttatatgggtttgatataattttataatccaaaagaaagattggaaagggatgacaagttggttaattcattcttaactgaaagatagtggatagcatagcacataaaagcactggactctggagtaaaactgcctgtatttcagtctcggctatgtgatcttggtcaagttaccttacctctttgtgtattagctttcacatgtaaaatgggaatggcagtaataacacttccttataaggtataatattgtacattttgtgaggattaaatgagttaatacaaatataacactatattattatattgatgttgttagatgttattattgaaattgctaaattatttgatagttttacccaaagttgagattagtcttgatcacttataaataatttttatcttcatgattaggcttttcagaattctttagctcatcattaatgactgttattctcatagcattggaggcgttgtactggtaaacctggcagggtctgaaaaacctgctggaagagacacagtaggtaagtactggactctggattctctctgttagagtaaataagaaagttacatgtgcgtgctcatgtgcacagatgaacgcacaaagggtaggcactagcagggtgggttttttttgaacttttcctttggaaataacataaaaaaatgcgtaaatagtttagtgaattctcatagccttcacccagatttttcaaatgttaacaacttacataaatattatacagttataaaaatcagaaattaacgttgattatgatactgttatctataaagccttttcaaattttgccactttttccactaatgttctttttctgatctaggatcatttattgcatttaattgtcgtgtttccttagtttcctttaaatgcagaagtgttcctcagtcttcttgtcttttatgaccttgacacttttgtagggtaccacctag

SEQ ID NO: 26233 - DNA, 1071 bp, Homo sapiens
atgtatactcatgtacacacacaaatttaacttaccaaaaatatgagtatgtatttttttactttgcaaaagtaatacatatacattgtagaaattatatatacatcataatatcacatgtagggataaattgtatgtgtattagtataggtatattgttgaaaatttagacgctacagagaaacaaaaagaggaaaataaatgctaccattcaaggaataaccactgataatattttgacatatatcctgccattcttttcatgtgtgtattttttattttttacaaaaatggaattgggcctggtgcggtatctcatgcctattattccagcactttaggaagctgaggtgagtggatcacttgaggccaggagtttgagaccagcctggctaacatggtgaaactctgtctcaactaaaaatacaaaaaattagccagtcgtggtggtgcactcctgtaatcccggttagtcgggaggctgaggcatgagaattgcttgaagtcgggaggtgaaggttacagtgagcagagactgaaccactacactccagtctgggtgacagagtgagactgtctcaaaaaaataaaataaaaatgaaaatggaattcttttcaaggttaatccatattgtagtgtttctgtacttcattcattttttgttgctgttgttgagacagagtctcactctcttgtccaggctagagtgcagtggcgcgatctcagctcactgaaacctccacctcctgggttcaagtgattctcctgcctcagcctcctaagtagctgggattacaggtgcccgccaccatgcccggctaatttttgtatttgtagtagagacggggtttcaccatgttggtcaggctggtcttgaactcctgaccccaagcgatccacccctctcggcctcccagagtgctgggattacaggcgtgagccactgcgcccggccaaataatgtcatttttaaagcttgtaattcttattgctaaattactgtctgtaatggttgcattaattcttatctctgttagcagtatataattaaacccttgttaaacactcat

SEQ ID NO: 26234 - DNA, 1029 bp, Homo sapiens
cttctcttttttttatgcaaagtagtctcttctctacatccatggttgatttctaaaaacccctttgcaggagaattccctgtcaagagcgtaagactttatgaagcaaattaggaaaattgaggccactattaaactacaaagaatacatattttccttagccatttgttcaaataggacaatacatctggcacatattatgtatctaaaattagtaataaattcccattcaccacttcttgctttgggataactttctagaacttctcttttatgaagtttcagcaagacacatgattattttataacacgtgatattcatgatgagtcttttttccccttttagttctggttgctacatttcttattttatgacttaaagttaaattacttacactctctacacccgaaatgatcccaagggaactgagtaacttgagagaagttaaatataattacatgtttggactctagagttatacagatctgcttcagacttagctcccctacagaagatgtgacttggacaagcaaggtaacctctctaagttaggtttctccatccataaattggtaagaataatatgtacctgcctcataggattgttgagaaaattaagtgaggtacaatgtgtaaaattaatatctcagtgcttggcacataatccatgttaaataagtgttagccaatgttattattgagatgtttgttaagaccatttcactacaaagaacagcggttcatctgggtgatgggagcaggggtatcgtgacggtatttatggaaataaggactttaaggaccttctggcatatcaagaaaagctgtcgagctgggcctcttggactctggaagtcactcaggaactagaagcatccagtggaagagtcaccaatctgagtcatcttcttgctgccttggcaagttcagggatcccataaatgcagtgactcagcatccctccaactgtactgctaccattcccatttctactaatttttcaactctcctataaataccgtttgat

SEQ ID NO: 26235 - DNA, 1035 bp, Homo sapiens
ctagccaagagccagaggctcagatccgggaaccctgaggttgcaggcttgctgactaccctttgcctggggacacatcccctttgttctacctgtggctccttgccagtagtcatctctcatagccctgtagttaggtttggtttttttgtttgttttgtttggggttttgagatagggtctcactctctcgcccagattggagtgcagtgtcgtgatctcagctcaccacaacctccaccgcaggctcaagagattctcctgcctcagcctcccgagtagctgggattacaggtgcacatactacctcccggctaacttttgtatttttagtagtgacaggattttatcatgttggccaggctggtctcaaactccttgacctcaggcgatccacccgcctcggcctcccaaagtggtgggattacaggtatgagctaccgtgcccagcccctgtagttaggttttatctctaatctatataactccctgaagccagaactatgatttatctgtacgttctgagaccctagcctagtgctgacacatatttgatgctcactaataatttctaggtgaatgaattttattaatttcctagataattacagctaccatagcctaattatatctgaatagtcctttggcctcatttttttgtgatagttatatacatttgtatttctataattctacatgcttccattattgctttccaaaattcacatttttgtgaagaagaagagagtaagcaaaagacattccttcctcccagacattaattactgcaagatgcctgtgtaattagtgaaacaggcatctcctacatgtgttaatttagattccaccaaaaagtgcttgattaacaaaaaaatttaaaaattttcaattgaattactttaaaacaaggaataatttccaatttagttatccagacaagttgtatggatccagacagattatttttaaataaggtgttatgggccaggcatggtggctcacacctataatcccagcacttcgggagaccaaggt

SEQ ID NO: 26236 - DNA, 1050 bp, Homo sapiens
gatgtggaccaacaggaaccctcatttattgctggtgggaatggaaaatggtagagccactttggaagactgttttgtgacttcttacaaaactaagcatacttttaccatacaatgcagcaatcgtgatccctggtatttacccaaaggagttaaaaacttaatgtccacacaaaaacctgcacacagatgtttatggcagtgcagctttattcgtaattgccaaaacctggaaacaaccaagatgtccttcagtaagtggatggatgaactgtggtacatccagacagtgaaatattattcagtgacaaacagaaaagagctatcaagccatggaaaggcaatgagaaagctacatattactcagtaaaaagaaaaacaaatctgaaaagggtatatactgtattattccaattgtatgacattctggaaaaggcaaaacaactgagacaataaagagtcagtggttgctagaggttgggacaagtaagcaaagcacaaaggatttttagggcagaaaaactactctgtatgataactacagtggtggatacatatcattatacatttgtccaaacctatagaatgtgaacacaaagagtgaaccctcatgtaaactatggacttttcatgataattattgtcactgtccatgtgggtttgtcaattttaacaaatgtgctgctatggtgtgggatgttgatggtgggggaggttgtatgtgtgtgggggtggggagtatatggcaactctctatactttccattcaattttgctgggaacctaaaactgctctaaaaaattaactttattaatttaagtaaataagtaaaatataatacttatgagatcagatgcattcagggtggtatggccatagacaaactataatactgtatgattaaagcaatgggaggttattccagtcttgtccagaacctctcctccaacttcattcaaaatgcatttataccatagcccatcaaacaatgttaggtgaaaaggtcactgaaactgtaggttaaaataatatccgaagattcgtcaagg

SEQ ID NO: 26237 - DNA, 1227 bp, Homo sapiens
aagggaggtaggtatctagcagtagcacagttactttgagcctgaccacttgttctgaagtgcagatgttgaaacatgcattgaggaagaacactttaaggaagcactttatgatttactcatggctggtgttggcctcaaagtaaaagaacatcttaatgcagaacagtacaataaagagccccataggatggatgccatcatctgtccccatggttgggattgccaaggaaagtgccttgttctgtgcatcttcagaatcccccaggccctctcttgatccttttcatgaagtccagagcattccttctattacaggctgaagatgcattgtaaaaggtaatgctataatagtattccctcttctcaataaatgtgcaaaactggagaatctggtgctgatctgcagcatacttgacaacacagggaataccgtggatgttccacgccagccttacatccgtccccattgcctgcccatgtccagtggccctgcgcaacaaaagtaagggcttgtcttaccacactctccccagcatctagctcaaggtagatgactgactgggaaattccggttggataaaatggcttttccacattgcaactttgcatctctattaggaaaatttagattgaacctttcctctacttgatgcttagtttgagaacagttttcacaactttagagggtctctctcagagtatgttatactgtaaccttgaagtttgagatgaaacaaggtgtcagaggttttgaatctttcaaaggaattgccttttacagatttttttttttattccctaagaagggaaaaagagagggaagaactacactaatgttagagataaggtatgttttggctcaaaatgtgtcatgaacctaaaggtaacttgatgggcagaaatgtctcagccatgtgaaccaagaagtgggaccacagtgcaaggctgtgggtggcagcactagatacggtggtggcaggagtgtgacatgtaggcactccatgggggacagctggacggtgtctatcaaaagtgcaaatgcataagctctttgaactagcaatgctactcctaagaattgtacctgtgtacaaggtacttgtgtacaagagtttttgttgaaacattgtaatagcaaaaagttggagagtgccaccaatacaggggaatggttaaatacattatggccagcttaaacaatggaatagtttgtagaaatttaaa

SEQ ID NO: 26238 - DNA, 1056 bp, Homo sapiens
catcccctcactggccctctacttctgcgttctgaattctcactgcatcctgggcccaagcacttgtagtgtgcaataattattcttcatggaaaacacaacattgttgtctaccatatggttttttgccaccttagcggttgcctttgttgggtttgatttaccccacgttaaatgggcaacagttatgcaccgtgggcgccatcaggtcatgatactaagatttaaattcaatagcactgatgaattcaaaccctacatttttgtgaagctggctttcggtacataaccttgagtgaacttagctctctgtctggcacctagtgggcatggatagagttttcagcaggaaagagactgaggtgatgagacattttcccttttcttctagaaacaaacacccaaagcgcctcttttgtatttgctttgaagagacggagaatatgattctgtaggctcacatactaggtgacattgcaggctgtctctaccgaaaagtacaagcatcgcctagggttctgtgacacacacagttccccacggtagagttctgatgctgtttttgcctcatttaaacggtgaggtgggtgacagtttaaacttatttactgtttcatatttttgttatggaaatcttaaaaaatatacaagtagagagtgtagtataacaatataatagtgtagctctctgttcttgttccatctcttccactccatttgttttaagctggagtcttttttccccccaagtacatctcaagccatttttaaaaggaacccagcatcaccttatttctgtccccccactgccctgcccatgaactgcccctctctccccaaaaaggtgctcaaaagtgtcagagcaccttgcttctgacagcctcaaagtattcagccttaccaccaagacaagcacccacctgtttccttgctccctgagtgaaggacacatctgaatcctgtagatgagccagcactagtcttagcaaaaccaaggtcgttgtggtcatgctgccatcacactgccaaaagatcagggcctccagagagctggga

SEQ ID NO: 26239 - DNA, 1058 bp, Homo sapiens
ttgtaacttcagcagtcacaactctaatttcgtgtgtgtgaggctgattgtttttatgcagtattcttttatgtctaagtacattaattgtatctagttttgcttgctctgtaactattaagatcagaattgacttgttgaattgatacatcttttttaaggttatgtctgtcttcagctctttgatgatccttggttatatgttcatctttaattttaaaatttcgggttaccacctctgtggatccatgcattttatgcagcccacttcctgtgtttattctggaagggatctacctactgtttgctgagatcagccggtagtaactgatgttctgggtcggggaactccccatttctgctgggtatcaccaactatgtgggaccccgccctgcctctgagacttaagcaccagctcttgtgtttaagagagtcaggtttcattgcctagcctatgtggctattcctaatgcagatccccaacactgcacaccagtccttcctacgtctgctaactccacacagcttcttcctgaggccattcctgtctgttaaccatcctttttggcctgtgaggttaaactcttgtgttctaatgtaatagtctggatgtttgggggtcttagggcaagaaggggtggctgcaagttgtgcttagtctactattttcaactagacctcttggaacttttttaaaactttttttttttaatttttgaataagtaacacattcacatcgtacaaaattcaaaaagtacaaagggtgtaggtttggagaaacggtgttttcttcactgaacagtagatactagagatcattgtaaaagagctactttattcttttttaaaatattggcttagtattctgttgtatgatgtaattacctactttacacattaaaatccaagtttaagtttcttctttaaaaagtgtcattatctgcctcacaaaaagaaggtgaagttgttcacctctgctaccaaggctccagcaaccatgtcttcattctctcttgcagctgaagacttacagtgagaaactggacaaagagcaag

SEQ ID NO: 26240 - DNA, 1117 bp, Homo sapiens
atagtaactctaagatcctgaattccttgagagtgagatgtcttttgaaagatgagagaacctcagagtgatataattgttcagaatttccagttatctcctaggcagagtgggggaagggctgcaggaggagaaggagggctgggagtgcatttgaaccctgcgattcaatctgtagtccaggttgcaagtgtgctacttcacatcagcattgtcgctgctcacttcccacttgtgattgctgaacagacacctctgctgccacctctgtcatgagcagtgtgtagatatttctgttccttggtttccacagagaactatcctcatccagacttgaaaagctgtcttccttgtgattttggtgcttggactatagccgtactatggaaggacctcgctgcaaggtccctacctcgtacttcctggacgatttggaagctaggatcttcaaagacgtctccgaaaccaacccagtatccctacttttctagaattcacatgacatttaccaatttaaaattcttactctgtagcgatatgtagcacttaatttgccaccttgatgtaaacctgacaaagcttttcaattctggtctggactaacctcttcagttattgtcagaatatttcaaaagggcaggcacatgaatgtcaattagaataatttttttctcattgttcataaagacgcctgccttgcctttggacagattagcttcctttacattgctctgtgactgggttccttacggattagatggcaagctctgcgggttgggagccctctgtgatattttaatgccgcagagcccctggcatgaagtttgccaattcgtggatctgtctttgtataataatctgaaagagattaaaggcaaaatatcttgatatcagctttctaagacatttatatgccttaggatataaactaagtgacttataaaggagctttttatactaaatactaaatcaagtatttgttgagcccttttcatgttatagaaaggtggagggtgtgatttaagtcagtaataagactatcctcaaatgaaaacagcagccaacattgctctgggcatatcattcctgcagtcgtcgttcctttttgcagatggga

SEQ ID NO: 26241 - DNA, 1030 bp, Homo sapiens
ttagctaaagtaatcattttttgcttctcttgggaatttaccattttgaactagactaatattattcggtgacatttaaatctgtttcctctaaaaatagaagttgtgaatatctgtcagttattagaaaacactaaatttacactagaagtcatcttaatccacaatgtggttttgaaagcacgttcttaatctgaaaatgttgaacaaattagattggcactttagccctcactgcaatgtaaacacaaatggaatatttgtagatggttgatgttctttgacagatgttgcattttggcagcagaaatctgttaagatgctctacggtttaaattttttctgtcaaggatttagtataaagccccttttcctcttctccttctgtctgactttgtctcatcattcaaaatccaccttggtcatctagttttctttctcatcgtatctctcagtgaatgaaccattagatgagacctgctggtttacggacctgttcctgtcttcatcagtctgagttctcttggctttgagaaacaaaaaatttagattgcttaataaaaagtgtgtttgaaaaacagagcggtcagctttctgtttactaggttaggaactctcatttcagctcagtaataaactgttttatctgactaaaaataacttcccattaaacaaagcagcttcccatagcactgtctctaaactcagaggcaaacagaggaacttacaagtttataagtactgtgcgccagtaaatgtacatttacaggactccacacaggactaagaattattacctaccaataaaagagagcagtttgaaagctcatgtttccttggaacatatactactataacagatatggtagaggtacctatagagatttcaagatatttttctgtgcattgcgagcattttctctctgtatggttgtctgaatcacgggtctagtaaaagagcagaatgagaaagaacttttccctctcggtgttacataaacgatggctggccagttggtgagcccacccc

SEQ ID NO: 26242 - DNA, 1047 bp, Homo sapiens
tcttttgtactaatgctgttgtaataagaatgaaaaattaggaaatggagaaaaacaaaaactaaatcacccatgataccacgagccagggataaccactgatactgcaagcaggaaataaagagttgtgaatatcagtatggagaatcagagattgcaaaaaaaaaatggcattgtactatatattctgttttgttgcttgctcatttgttgcttgctcattttgctcagtagtatattgaggatatctttccatgccaataaagatacctccatagcatttttagtggctgtagattattaattgtgtggaactagttcaactatagtttgtatctctgttttttttttttttcttcacttggccattatgtaggacatcctcatagctaaatttattcttttatttctaattatttacttaggatttattccatgaagtggaattggtcaagattatacctaaggcttttaatacttcttgccagattgccaggcagaaaggccgctgtgaactttatcatccgagcttatgatgggcgtgttctgtttttgtcttggctttatttttcttccttcaggagattattcccagtacctgctttcttctttgaagtgcattactttcttctccctatctcctttgcacagaatagctggctgctttgtagaaggcctgcccaacaggaggtggtattttcaaaggacataaggagtggaaactaccaccttccactttcacatcataatcataatcagctcctctgtctcatgtactgtgctgtgacacagcttcctcctctgagatgtcagccctccatagccatgaagtgtctgtcctgtgaagtgaggtcttttactccctcttaaccttgaataacaggtgcccacacagttttatccagacccaaaagatacattcatttactatttgtcagcatttttttggtagtttagacttttgtatgagaatagaggggacagagaaaagacttcttagagcttccagactagttggaaagaagtgcactgtggaacttaccggat

SEQ ID NO: 26243 - DNA, 1101 bp, Homo sapiens
tccgccgctgcaggtccgcgcaccaggaagctgaagaagaagaagaacgagaaggaggacaagcggccgcggaccgcgttcacggccgagcagctgcagagactcaaggcggagttccaggcaaaccgctacatcacggagcagcggcggcagaccctggcccaggaactcagcctcaacgagtcccagatcaagatctggttccagaacaagcgcgccaagatcaagaaagccacaggcatcaagaacggcctggcgctgcacctcatggcccagggactgtacaaccactccaccaccacggtccaggacaaagacgagagcgagtagccgccacaggccggggccgcgcccgcgccccctcccggcaccgccgccgtcgtctcccggcccctcgctgggggagaaagcatctgctccaaggagggagggagcgcagggaaaagagcgagagagacagaaagagagcctcagaatggacaatgacgttgaaacgcagcatttttgaaaagggagaaagactcggacaggtgctatcgaaaaataagatccattctctattcccagtataagggacgaaactgcgaactccttaaagctctatctagccaaaccgcttacgaccttgtatatatttaatttcaggtaaggaaaacacatacgtgtagcgatctctatttgctggacatttttattaatctcctttattattattgttataattattataattattataattattttatcccctcccccaccgcctcgctgcccccgcccagtttcgttttcgttgcctttttcatttgaatgtcattgcttctccggtgcctcccgacccgcatcgccggccctggtttctctgggacttttctttgtgtgcgagagtgtgtttcctttcgtgtctgcccacctcttctcccccacctcccgggtcccttctgtcggtctgtctgttctgcccccctttcgttttccggagacttgttgagaaatacgaccccacagactgcgagactgaaccgccgctacaagccaaagattttattatgttcagaaacctgtagtctgaaataaagtgtacactgtgctcacgagcgc

SEQ ID NO: 26244 - DNA, 1019 bp, Homo sapiens
tgagacatcctggccgacttgcaagaactccagggagacagcggaggaggcgaggaccaggaagcgatcgcccagattgcactggcaagcgcctttagaggcgcggtccactcgccccaaccctgctcgggcgagcaccggaaagccaatcagaagccagctatgcgctaggggcgtgcccagcccccgccgcggcgctagccccgcccgagcccacgtgggaccgcttgcgcaaacgccgggagtagccgaaggggacgccgggaacaggtggggacaacggaagtagggtgcttagttttgctgccgggagttggtcgagagttgggttcagtcctggcccgttgtggggacggcacgcgggggaaggggaggggacggagaccgaagaacggaggtccttatgtttcttttctttccttaaatcttgcccggcctgaagaggccggaagttgcatctctggacaagtaaactctgagacctgggaatggcgggcgggacccgctcctcccttggggtctagaggagacccccggagatggtccctgatgagcagcgtgatggtggaaagctggactggtctcccgaaaggcgaagccgaggcttcttcctctgaacttttggcacgttctttgacttgcttgtggccgtagtgtcaggcctgtattgcacatttatgtctgtggtgcatttctccatctggtgcgttaaaggcagggacggtgtcttatttgtcttgatttaacaaacttggacgggacgaagtgctcagcaaatatttgttaaatgaatggctgtttattgaactcctgttgggtaacttgcactgttctagaccttggcagacagcagtgaacaaagcgggtgaatccctgcaatcttggaacttacaagtagggacagtagtttatacaataagttaaatatagagtactttaggggcttagagagttggaagtttatagttttaaatggaggagggggagtattgagggaaggtgacatttgagaaagttcc

SEQ ID NO: 26245 - DNA, 1069 bp, Homo sapiens
ttcgatctgtgaggctgcgagcacttcagtgcctgggatttacctaactgccatgaaacactgattatccagcattcagcatgtgtcagattctgtaactatttctcctgtgatgtatcagtcagcttttgctgcaaaacagcatcagaaatctcagtggtctacaactagattcccattcttgggtagtctacaagttggcttctaggttatgctccaggctgggggtctgatcacgtctgctccacaacatgtcccgtattctgggtccctggttgaagcagcagcttaccttgggccgtgttctttctcatggcagaagcacaggaggccaagccctaccttgcaagcacaaatacagcccctgctcactttctgttggccacaacacatggccatgcctgacctctgtggggtgaggcagtgcatggccaaggaacaagcacagtccacacagggggctgtcactccgtgacctcagtattacaaaatggttctcaaggagtcgcaaaatgtgtggcagatcatccatgatttgtttcccgtgtgctttacgaatatcctgaaatttttaaaagctgtttccattagaagggatctgttggggatttgaggtgagatgagaaagaccctgcattccagcccctcagttagcagtggtgaggccggagtactccacacgggacagttttaggaaagtgctggaatccaaagtttctccggagggctatgcaaggcgctttggaaaggcgaagcctgggcgcagggagcccagccatgtaggtagaagcagcagacggtgagggaggccatccccacctggccctgccagggccctgactcagtgaaggaagctgttgggatacaggtcattcagccgggcaggaaagatgggatgaagcccagcaagttcacagggatccgggaagttgtgtggctggaaacccaggcagggctgcaccacagggaccatttgctggagatgcagcacttgccacagccaccaccactgacagcatgacacccacaaaaagggagcctccagctgcacccctgctgctgcgagtac

SEQ ID NO: 26246 - DNA, 1028 bp, Homo sapiens
cgcccacagagaccctggagtttcctcttacaggcccagcgaggaacgcagcatccctttagcacatggcttctacctgggcttctaatgcacacgagcttcaagtccaggcaccacaggctgctgctgccctgctgggggcatcttttcacctgcggcacccgctcagcttctggcagaagcatcggcatggatgtccgtcctggctgtcggtcctcggcgctactctataagaatgattgggatttgcacattttagcttttttttctcccaagcacattacagttgcccacaggtgctcacgtctggattctccttaaaaatcaaagcaagagtctctccctgctggaggcctggcctcggatcttcctgttgagggcttgaagccatttttctctttgcaatggcttcctgttagagaaacattttcatttcacctcccttttcttcccctgcttcattccctacagtcgcctgtcactattttccatctcttcaatctggactgattatttcctgaagatagtagccaacgatagagctcagtgtcctgtgtggcctcagggagatgtggagggttgcatgagcttgcatcattctcagggcatgagggcaatccatgtccaagcaggccccagccccacagtccccagcccctgtaggccctgtctgccggggccgctctagcaggtgtttgcagagaaggagtggacccacctcctgggcaggaattgccttgagtaaccagccctggtgctcattccatcttcctcttgtttcacattcaagtgaatttggagcctgctgagaaagttccatcttctggggctggagacccaagagggagttgctttagacagggccctttagaaagctgggtgtgtgctgatcttcccccagaccgaaggcacgggcctgtggaagacccatgcttggaacggatgtgggaataaatgcccacaggtagaaccataaacctggtggcaaccctgggagacagggatggtgccatttctcacagagcctg

SEQ ID NO: 26247 - DNA, 1046 bp, Homo sapiens
gcatttctaacaggttcccagcactgctgctggggctgatagggggctgcacttggagtaccacttttcttttcttttcttttctttttttttttgagacagagtcttgcactgtcacccaggctggagtgcggtggcgcgatcttggctcactgcaagctccgcctcccaggttcatgccattctcctgcctcagcctcccgagtagctgggactacaggtgcccaccaacacgtccggctaattttttgtatttttagtagagatgggttctcaccgtgatagccaggatggtctcgatctcctgacctcgtgatccgcccacctcggcctcccaaagttctgggattacaggtgtgagccaccgcgcccggccgagtaccacttttctaaggtttttcctagaatcccctagacctgcctttccgtggcccacgctcccctttaaaatcaccctgcagaccactctgtgtttaacaattgagccaggcgaagcaatggctgccgtctgacattgaggtcattgtcctttggcctctgaaatcaaaagtgatgtttggtctttcgcttcatgtggcatgtggagctcactctttgggggaactgggtgtttcaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcaggtaggccctcgtgttggtggggcctgcccccggcctgtgtggggttgcctaacttgaagtaatgtaagggctttgtgctcctccttcactggcagggacgggtaggaaaaaccaggcaggacctgtgaggccgtgtggcagggacacttcacagcctcctctgtcggcttccagctcaccccctctcctgaatgcactaagaatgctttcctggcagctcaca

SEQ ID NO: 26248 - DNA, 1044 bp, Homo sapiens
aggcattactgagaagattaaatttcataaagtatattaaaacttagacattttatttgcagttgcagctctgctattattgtttgaggattgttttggttttgctgctgctgttatttatggaataaactgagtaccagaattttttctaagatttaggaagccaggtgatcaatcaaagggaatgtggtaatggcagtagaattttaattatatgtttacattttggaatttaaaatgcctgtatgtttgcttatcacatgtgactctctttgtcaaatgaagcaacagatttagcccccaaaccttgttttgagaagtgtgggcaaaaaggcgtggcgaagaaacctagaagtataaagatgctgttggctagagcagggagaagtattaatacataaattgccttcaaaagatgagatatctagttgacttttaaaaaaatatgattataaaggcagcatgcctctagtctgaaagctatgggttttactatcaaatagctggatctcagcttaactgtgactgcgagtctctttcaagtcttttttgttgttgttgagacagtctcgctctgttggccaggctggagtacagtggcacgatctcggctcactgcaacctccacctcccaggttccagcgattctcctgcctcagcctcctgggtagctgggattacaggcacatgccaccacacccagctaatttttgtatttttagtggagacgggagtttcaccatgttggccaggctggtctcaaactcctgacctcagttgatctgcccaccttggcctcccaaagtgctgggattattacaggtgtgagccaccacgcccggactctttcaagtcttatttggacatcttccatttcatcacctgtagcaagaatactactttcaagattattaagtaaaagacctagtgatactactgagggttaaaactgacagctaatgttattattctgattcttccttactttcaatcatgtgtgtcttgctgattttatctaagaagccaaatgcttttatagctaac

SEQ ID NO: 26249 - DNA, 1035 bp, Homo sapiens
tattggttctttcaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggtatgtccaagagaaccgacgtgtaattacagattgttcctgggcttgtgttagagaaatgtatttagaaacttgaaaaccgtgccacccacccacaaacctatatcactaaggctctgctgttgcccttttctctctccagctctgcccagttttgaatataaaaatgaaaatctgaaatcttgcatgatgggcttatggtttccccaggcatctactttatatattttctaatatgaaatcactagtaaattagtgtcttttacacagatgtttgttttccttatatcagtttgtaatacgtactttgaagataaaattgcagatctagggctagctggctacagggtccctgatcgtaaaatgtggttgaaaagtttgataagacgtaatagatgcttaaaaaagagcaaacgtctttcaatacgtagcacataagtatatgtgtgatatgtgagtatgtgcttttgtaatggaatgttacttaagtattgcctggtacgggctgaaacttattctatatttgcatattacctcgattaggacctgtttgggacaaactagctttgatcataatacccactccctgtggacatgcacattagaatatttgaactaggacttactgtccttattattctaatcagaacattacagataatttcgaatgattagcctgatgctccaaaaacctcaacttattttaatactagctcaagccaaatataaatagaacgttggatatattgccagaaatcactttgttcatttgctgtttgaatgagcttcaacacttgttttcagttattttggattatatagtgttactttgcaaagctttatctccactggcgtgctactttccatgcctgcccc

SEQ ID NO: 26250 - DNA, 1056 bp, Homo sapiens
aacctacatatcaggtactgcttaaaaactatttcagtctgaactatcaagatagtgatgtgcttgtacaaaatgtatagtttgcttcagtcttaagatattttaccaacttccttatttagggaaagtgataattttataatattctttgccaatttagttttaatttttgtgaatcttgagaaagggatattttcctttttttgcaagctggtaaaaattgccaggtaatctttgctatttaataccacatgtaccatagagatgcacatttcataaagtaacatggaccttaaaaattatattgaagaatttgaggtattgatattttatgactgaatgtgagagcgttaacatgtacagaatactctagtagtacagataaaatgtagcactgcttagtattattttgttaaacctataaattttctgtggtataatcactgtgaatttttcagagtaatgaatggaagcatattatcttttgtttttcctgaggttaacgaaaagccgtatgttgcatgaaactgtagtcaataagttaatgttttgaaccaagtctttatttcataattatttctaaaagttgttttctatccacatgaggacagaatttagcatgtatttccctcaggttgatgaagtaatatgctcactaagaatacttgttaataaaatggtactataatgtcagattgtaaatttgaggttgctcttaactgttactgccaccaccagcaccacccaacactactaaccaatgtttaagttgctttataatctcttttaatccactcagtaactcccaagaggtaggtaccattaaccattattagcaccattttacaaacaagatactgagacacagatagatttagtactttgcccaaggtcagtcctatggctagttgtgatccaacgagcatttacaattgcattactgagctggtactcataaccagtgtactgtaactgcctctccaaggaagatcattgaacttaatacagctaaattcaaacgattacacaagtactaataattaggatatggccagg

SEQ ID NO: 26251 - DNA, 1051 bp, Homo sapiens
aatgctaagaaaattgttatagttctacttctgctcttctagcagtgacacctaaaatttttaacataatcagctcttacagaattaaaaaaacaaaataagaataaacacctttgtgacatttgtagttatttactgtggaataaggaggctattccaccagtaattcttctaagtatattcttttatgatattcaattgtcttttatgctcctacatttaaaaaaattactaccaccaaataaaaatttatttttatataaaattgtgtattttagccaaattaatgtgtaaaatctggcttttgaaagtattatagttcattcctacatttacatctattattcattgtcattttgcttcacttttagctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattaggtaaggattctcaaagatcttggaataccattcccagcttggtcatagttttgattataatctaatgactatgtctaatgtaggaaatatagatctattttttgaactgaggatgtcactttgcctgggtgtgctttatacagattatggcatattgaggtttcagttagaaaaatatatgggacttaacccttcaaattgatgggaaggaattatgtcattgtaggcttttgtgttttgcagtcattgtacaaagcactggaattggggaaatagcagggtgtttcccccacaattagaagcagtgttgcttttcattttccttttactgattagcactaagtagacattaacctatatgaatttttcaaaaacagcatttagggtccacatttattttaattctgatcttctctaatctaattggtgaaacttatggtgaaaaaatatgcatagttacttttgacatagatttgtttaagcatgaaagctaggaattgattaaaaccaat

SEQ ID NO: 26252 - DNA, 1062 bp, Homo sapiens
tttagttgagacagtctctccatgttgcccaggctggtctctaactcctagcctcaagtaatccacctgcctcagcctcccaaagtgctgggcttacaggtgtgagccactgcacccagcaaaatttcagtttttgaaaatactaatcaagtaggcaaacttttgaaaaatgtcaattgaaatacagaaaaggtacaaattaactgttaagaataataaattaggcataaatgtggatcagtagagttttaaaggtaataggaagccaggtacaatggctcacacctataatctgagcactttgggaggccaaggtgagaggattgcttgaggccaggagtttgagaccagcctgggcaacatagtgagacccccatctctacagaaaatttaaaaattaatatggcgtggtgacatacacctgtagtcccagctgctcccagctactagaaggctaaggtgggaggatagcttgaacctgggaagtgaggcatcagtgagctgtgatcgcaccattccactccagcctaggcagcagagctagactctgtatcaaagaaaaaataatacttttttgaaattaaggtaagataaacctatgacagctttgttaacaattcaaaaacaagttgtacaagtttcaagaaaacccaaaactgtttcttcaaagaaacaagcaatgtgagtagttttaagactgctcattaaacaatttgaatcagtagttaaaagttcattgttctattcccaccctgccaaaataaacttaataaaaatggaaaagatactccaaaaattcctgccatgctcagatggtttcgcacacaagttgtatcaaagactggataattgcattgtcagtttatcagtggagatgcaaaaaaaaataataataaaaacattaggtaattccagtcttacgtaaactcagagaataggaaaagagggaatacttccctcactggttttatgcagctagtatgaccagagtacctacaaacattgtgtatgtgagtgtgtatgtcatgaccacgtaggtttagcccaggtttaatttttctt

SEQ ID NO: 26253 - DNA, 1033 bp, Homo sapiens
tgtgattgtgataggaacattattaatttgaaagatatgtgttctggaacatttgctcagtcagtcttgtttttatggaaatacctcatacacccataacaattgagaagaaattcattaagaactctctttttaaaatcgtttttaactattgcagcattatgtaggagtgttgtccatatgtaaccattgagcaaaggagaagtaacaactcttcctcctatgctgaattagttctgttaattttagtttagtttttcagtacttacctatgctttagtatattagatccacctttagtatttgtaattagtatttgtttcattgttggaaaaagtgagtaaaaatcagcctcagtatttttgtttttctgtctgtattatggagtgtttgaatatggctggtatagacttcccccagtgctagtaaaagccctcacgtcttttggtatgataatatggagctgacccttcagaagcactgatgataagttttcagtccagtattaacctcttcaaagaacgagactggagtattcaaattctctgtttcctgagaattctacctcaacttcccttattttgtccccaaacaaaaacaccaaaaaattgaaatatagcacaatcctagtgagaatttgttacagttgctacctaggttgacacatgacatctttgcaaaagtgtagcattaaagctgatgatccttttccaaacttctagagtccagacacatgagggaagacatggagtacataggcctggactcaggtaccatgctcgacagcttttgctgctggacgtgtagttgggataggcattgctagagcaagcttctctgagcttcttacttggctctgccttttgggtaactctttagtattttagcttctagttcctcctctctgccctgttctgctggtactttcttccaagaaaaaggaactcttaagaggatgagagttggctaaaacaaaaaataatctttctttcaactgtggcactaccctgggttgcccgtctgtgttttattt

SEQ ID NO: 26254 - DNA, 1026 bp, Homo sapiens
ggcgtgagccaccgtacccagctcatgggtctttaaaatacaaaatttgaaggaaaaacacacacacacaattggaaggccctcttttctatcttaaaacaatttttggagtctttagtgtacttggatttctttatacagaaatgaaaatggtgtttgagcttggcttactatattcagttatctgcagttaggccaggctgtgataacctgtgtgcatatgctggtggccatgagggtagacccacagggtaaaccctttccaaagagaaagagtacactttttgtagggccccttttcctgccaaaacagttagccttgccctgctgcttagtcaaaggcattcttttgcttcattgttcaaggcaaattggaaccttccttctacctttctctgcctcctactcttaaattccatgtccatgacagagatgcctgagtaatcctctcccatgtagatgaggttatgcctttggtaaaaggcctacagcatagtgtgatttggccttctctgaaccaccatgtccaaaatgtctctcaccaccctctgcctttcccctcactttgttacagaacactgttctttttcttctttgcctttatcacagatttgtctttacaaatgtcatacccctttgtactggaaagtctctttgggcagttagcatgaatgttttattcatactgtattcccaggaactagtaaagtgcctgaaatgtagtagatcctcatcctcaatgaataaacaaaagagggagatagttatccaagtcaggtggcaactagcctgctcctcctgtaaactatcttggctgttatttcttgaagtaaattaatgctttacttatgaactcagagcttaagaaagagaatctgttctctctcattctccctttgttcctttcttgtccccttttctcccacctcttccccaccatgttctcttgtatctttccattgtttcctcccactgccatcaagaagtccatagtcaactggaagataatcctggcctccatatttg

SEQ ID NO: 26255 - DNA, 1056 bp, Homo sapiens
agagcaattccatattttggcctggacaaatggtggtaggaccaactgaagtcaggaacctggaggggagagcaggttttgagggtaagatgattataggtgattatagttttggacacttggacatagaattttgtttgtacgtgagtttgattcaggtaggtttgtatcttggagtagacttgagattgctattagaggattaagtattattggaacatggctatttatgttaaattgtcatcttctttctctttgtcttcgtatgtagcggtatggtatttgcctctctagctaaagagggttctggagaaagagatcattaaagcagagatggaagatttgaaggattatttgcacaaatggcaaatagctcttagtgtaattactttaaagtatgagagaacattctggtaggaaaccttttccaaatttggctctaagtttttccaactgacttacttttgtgcctatgtagtgattgtcaaaaagaattgggtcaggattgctacagtgataattaaaatgacatttccaaaagagcacagggtgtagatctgatatctgtgggatttgggttctgacatttataactttcagggcaagttggaaggtaaaataagtactgtgatcaaagggagaaatgaacatttaatcaatgaaaggatatatggtgactcttatgtaatatgacactcagagattatctaaggtgttgaaattttagttgttgacttctggaagtctcagttttcagtcatcagtttgcaaactttattcacatcccttagtgttgcttaaaactttcccctttgccatgaaataataaaaatgtaagtcagaatatgcccacttaaggcctgcattgtaccttttcagttcctttttgagggataaatgatgatttcaatgtcctactattctctaacctattaccaggaagaagcttgtggttgtcattattactataattatagtcacccagtctcgttcattactgcctttgtgtctttgccattcctaccttgcccgtttcttgccccagggagcttgcac

SEQ ID NO: 26256 - DNA, 1033 bp, Homo sapiens
attaaggaatgtacatattgaagtttccagttaatactgttgaattatctatttctctcttcagttgtcactttttgcttcctgtattttgggctctgttcttaggtgcatatatgtttataattgttatgatcccctgagcactgactcttttactattgtaaaatgtctgtctttgtgcacagagagaagttttgtcttaaggtctgtgttacttgttatcactataaccattctagctctcttttgtgtactgtttgcatgaaatatctttttccatcctttacttttcaaccactttgtgactttgaatcttaagtgtctcttagactgggtgtggtggcatgtacccccagttccagctactggggaagctgaggcaggaggatgacttaagctctagttcagccttggcaacctagtgaaaccccatcttttataaaaaaaataaatacagtgagtctcttgtagacactataaagttgagtcttatttgtttatgcagtctgactttttttaactttccattggtttaatctatttatatttaatgtagtactggcaaggtagaatttatgtctgcaggtgtgctatttatgttctatatgtcatgacttgtttctttgttcctctgttactgcgttattttgtgttaaatagatattttctagtgtactactataacttgctgtttattttagttttttggggggaattattcgcagttgctctggggcttgcaattaacatcttaactttaaacagtctagtttaaattgatactatttaatttcagtattaaaaacttctacttagctctgttttcttctttttttgctattgtcatgcaaattacatctttatacattataagcccaccagtgcatatagttctataattattgctttatgcagtttctttttaagttatgtaggacaagaaaagagctaagaacaaaaaatacttttatactatattttatatttacctatgtagttatttttacttttttttttatttcttcatgtggat

SEQ ID NO: 26257 - DNA, 1100 bp, Homo sapiens
aggtgcaaagacctactgaaacttcgtctcctattgaaacttgacctagactactgggctgactcagcataaggaagttacagaacagttgatgatcggcgtaaagttaaaggggtgaagttctgttgaaatccttcccgtttaatcaccgcaaaaactgaaagaactttacttgcgacactaaaaccacgcgtcttgtgcaccctctactggtttaaccacaaagtactagtttatttacgaattactgctgtttgaactgataagtctatgaaaacaggttttcatttttccaaaaattgcaccaaaataaagcaaaagctctagttgatgcgggtgtgttgttcaggcgttagcagtactgccctcactatgcgctcattggacagtagcgcaaccccaagaaaaggatggttataatagaaagtccctgggctgcaagcaggaagcgccaatacctggtagggttgtggtaattaattcgtgagcctcgccctagtcggtctggtagctagcttacctccagcctccacagctttcgacgacaccccaattctttgttttctgaggctcccgaagggtcgcaaaagcggcggctcggttttacccagaagaccgcgcgtcggccgctcgaaaatttgcatacgcttttctcgccggggcggggctggcgggggcgggaccgcggcgcgctcttgaactccacccgcagctaacccgggtttggctacgctgtattgccttttatttcgtttctcctcaccgagtattttccattatagctgtacatagctctttttgtggaagatcatccttcttcgtgctaatctctttggtcctccagtcggcatgcgtctggactctcggactgcgtctgggccggaaatgtctaggcctccccggagcgggtgggcgggagcgctgccccgcaggccggctgctaacaggctcccggtgtttcccgctgcaggtggttctgctgggcatggacatcctgtccgccctggtgacccggctgcaggatcggttcaaggcgcagatcggcacaggtgagctgcggcacttgtggagcggacccggccccttcagacccccagcct

SEQ ID NO: 26258 - DNA, 1045 bp, Homo sapiens
cctggaggacctgccgatgaggagatgtgggaatgggtacccacataaccgtctggccacttttctgtagggctgctgcaatatgttgggggtccactccagtcccagttgccttggattttccagtacctggaggtatcaacagtgaaggctgcaaaacagcagagatagtggcctgcccctccctctgggagctctgtcccaggaaggcacagatctgttgccagcccaaaggcacctgtaggtggtggttggagacctcagttgggagggcccatcccctgaagaggaatgggatcagggacctgcttaaaacagcagtctgacctctttttcatagagcagccatgctatgctcagggtctgcccctagttgctttgggcacttgaaacccaaagatggaattgcagctccttttgccctgaagcccagaaagcctgggtatctaaggctctcgggtctctgtttgcgcctgagaaactactctgccaagattccatgtagctctgtgtcagactgaagaccctggtggagtgggttcatgaggcagtctcctgacccgagggttgtaaaaaggtctgtggaagaagcgtggttcccggggtcccatattcactcactgcttccctgaatgggggaggttcccctggctccatttcactcccaagtgggccaccgtcctgccttgcttttctccgttttccatgggtggagttgtttccttgattggtcccaatgcgtgtacctggatgtttaattgaaggtgctgtgtttactcgccccttcgctcctctcgtgagagctgcgcacactagatgcttctagtcagccatcttggccacccccctacactttgatttctatatttcatttctaggtagatacctaggaatggaattgcagtcatagggtacgtgtgtgtttcgtttttaaagaaactgccaagttatttccaatgtaactgaattttttagctgttccttgtttttactttttctgggtataccctgagaggtagtctcatggctaaagtatagagatgtg

SEQ ID NO: 26259 - DNA, 1035 bp, Homo sapiens
tgtcacccaggctggagtgcagtggcacaatcttggctcactgcaagctccacctcccaggttcacgccattctcctgcctcagcctcctgagtagctgggactacaggcacccgccaccacgcctggctaatttttttgcatttttaatagagacggggtttcaccatgttagccaggatggtctcgatctcctgacctcatgatctgcccgcctctgcctcccacagtgctgggattacaggcgtgagccaccacgccaggcctttttttttttttttttgcagaggattgttttatgtccaattatgtggttgattttagagtatgtgccatgtgatgatctgaagcatatatattctgttatttttgggtggagagttctgtagagatttatcagatccattggtctagtgttgagttccggtcttgaatatctttataaattttctgccttgatgatctgtctaatattgtcagtagagtgttgacatctcccagtattattttgtgggagtgtaaatctctttgaaggtctctaagaactttctttatgaatctgggtgctcttgtgttggggtgcatatatgtatttaggatagttaggtcgtcttgttgaattgaaccctttaccattatgtaatgcccatctttgtcttttttgatctttgttgttttaaagtctctttgtctgaaattaggattgcaaccctggcttttttctgttttccatttgcttagtagattttcctccatccatttagtttgagcctatgggtgtcattgcatgtgagatcagtttcttgaagacagcataccattgagtcttgcttttttatccagcttgccactctgtgccttttatgtgggggcatttagcccatttacattcaaggttagttttatatatgtgtatttaatcctgtcattgtgttcttagctggttattatgctgtcttgtttgtgtggctgctttatagtatcgctggtctgcatatttaacactggtttgtgtttttgcatttgttggtagtga

SEQ ID NO: 26260 - DNA, 1059 bp, Homo sapiens
tattgtgaatagtgctgcaattaacatacacatgcatgtgtctttatggtagaatgatttatattcctttgggtatatacccagtaatgggattgctaggtcgaatggtagttctgcttctagctctttgaggaattgccagactgctctccacagtggtttaactaatttacactcccaccaacagtgtgttaagtgttcccttttctctgcaacctcaccagcgtctgttactttttgactttttaatagccattctgactgtgtgagatggtatctcattgtggttttgatttgcatttctctaatgatcagtgatgttgagctttttttcatatgcctacatgttggctgcatgtatgtcttcttttgaaaagtgtctgttcatgtcctttgcctgtattttaatggggttgttttttctcttgtaaatttgttaaagtttcttatagatgctggatattagacctttgtcagatgcgtggtttgcaaatattttctcccattctgtaggttgtctatttactctgttgataatttcttttgctgtgcagaagctcttaagtttaattcgatcccatttgtaaatttttgcttttgttgcgattgcttttggtgtctttgtcatgaaaactttgcccattcctgtgtccaggatggtattgcttaggttgtcttccagggtttttatagttttgggtttgacatttaagtctttaattcatcatgacttgatttttatgtatggtgtaaggcacggttccagctttaatcttctgcagatggctagccagttatctcagcaccatttattgaataggaagttttttccccattgcttgtttctgtcagcttgttgaagatcagatggtcataggtgtgcagcctatttctgggctttctattctattccattggtctatgtgcctgtttttgtatgagtagcatgctgttttggttactgtagtatagtttgaactcaggtaatgtgatgccttcagccttgttctttttgcataggattgccttgactatttgggctttttttctggttccata

SEQ ID NO: 26261 - DNA, 1053 bp, Homo sapiens
gttggaaaatttttaaataatacatctaggatttaaaatttttctttctttttaaagaacaggggctaggtgcagtgtctcactcctgtaatcccagcactttgggaagctgaggtgggtggatcacttcaggtcaggcatttgagaccagcctggccaacacggtgaaaccccatctctattaaaaatacaaaaattagctgggcgtggtggcgtgtgcctggaatcccagctacttgggtggctgaggcaggagaattgcttgaactgggaggctgaggttgcagtgagccgagatcatgccactgcattccagcctggatgacagaaggagactatgtctcaaaaaaagaaaaaaagaatagggtcctcaaaaacgtcaaagtacatgtcagctatgtttgtattatgtatgtgtttgtttctttctgcccatgtctgttatctttaactaaaggagcaagtagagtggtcaggttgagtgtggcagaatgggaagccatccagaagtcactattttttcccccaagtagctgtgctcttgagaaaccttaagtatcttggttgaaagactttttttttttttttttgagatggagtcttgctctgttgctcaggctggagtgctgtggcacgatctcggctcactgcaaccgcctctgcctcctgggttcaagcgattctcctggctcagtctcctgagcagctgggactacaggtacgcacgaccgtgcccagctaattttgtatttttagtagagatggtgtttcaccatgttggccaggatggtctcgatctcttgacctcgtgatctgcccgcttcggcctcccaaagtgctgggataaaggcagtagccaccatgcctggccaaaagacttatttttatagactgagctcttgattgctttctataaggaaaattgatctgttttttgttttttcctatctccaaaattagatataccctgtttagggcaggggatgcggtcctagaaatgggaacgctggcaaaggagagcaagtatacttagtctctgtggagctgtgttct

SEQ ID NO: 26262 - DNA, 1050 bp, Homo sapiens
ccagcctctgctatcgtctcttctactttttacttatgagattaactgttatttagcttcacatatgagtgagaacatgtagtgtttaactttctgttcctggcttatttcacttaacataatgccctctagttccatccatgttgctgtgaaggacgggattttattctttttcatggctaattaatattccattgaatataccacattttctttatccattctctgttgttggacatgtaggttgattctttgctgttgtgaatagtgctgcagtgaacatgggggagcagatatctcttccatattctgatttcttttcacttgaataaattcccactagtgggattgctggatcctatggtagttctatttatagttttttatggaacttccatactgttttccatagcagctgtactagtttatgttcccaccagcagtgtataagagttcccttttctctgctacatcctcatcagcatttattattttttgtctttttgataatagccatcctaacaggggtgagttgatacctcattgtggttttgatttgcatttccctcatgattagtgatgtcgaacattttttcatatatttgttggccattggtatgtcttcctttgagaaatgtctgttcagattatttgtccatttttaaaattggatatgtatatatatataattttttttttctgttgagatgtttgagttccttgtttattctggatattaatcccgtttggctggtccaatggtaatgagttatcagaatttaacatagtgtcactaaagttggtatacaactccccactgctaaattttactggcttaaaaaaaaagtctcctgtcagaggagtaatttgcaaatatcttctcccattctgtagcttgtctttttactctcttgtttcttggttgccctgaagctttttagtttaatatcatcccatttgttcatttttggttttgtttcttgtgcttttgaggtcttatttataaaatattttcccagactaatgtcctgaaacatttcttaaatgttt

SEQ ID NO: 26263 - DNA, 1044 bp, Homo sapiens
tgatcatcagtgtcacactgcaggcatctgtccctggacaggtcttggttgccagaaatgtttttagattactactacagtctgctccctccctttcacgtattgaccttagttatacttcctgaaggaacctgaattaagtctgtttcttcttcacataatagcacttcatatttcccatgacagatatcacacttctagaattattgattaatttacttattaaactctctcttgaattgagcatcaggtaccaagagggtacagttgaagagacatccatggcccctgcacttcaggggcttgcagtctagttagggagacaataacatgaatcgatggctgattatagtgaaggtatgcaaacagccctaaatggttagtcctttcctggtttgatatggctcaccatgctttctttaggcaactcttgttttttttttttttgttttttttttgagacagttttgctctgttgatcaagctggagtgcagtggcatggtcatggctcactgcaaccttgaccttctggacttaatcaatcctcctgcttcagccttttgagtagctgggactacaggcatgcaccaccacacctggctaattttctaaattttgttttagaagtgttttgtagagatagggcctcaccatgttgcccatgctggtctcgaactgctgggctcaagtgatcctcctgccttggcctaccaaagtgctaggaagcctggcccaactattcccctacaccggcccccaagacggagtcttgctctgtcaccaaggctggagtgcagtggcgtgatgtcagctcactgcagcctccatctcccaggttcaagcaattctcctgcctcagcctcctgagtagcttgggactacaggcgtggtggcacatgcctggctaatttttgttatatttctagtagagacggggttttaccatgttgggccaggctgatctcaaactcctgacctcaggtgatctgcctgcctctgcctcccaaagtgctgggattgcaggtgtgacccactgcccccgg

SEQ ID NO: 26264 - DNA, 1035 bp, Homo sapiens
tatcaaaattaattcagttatctaattaggtttttccctgtttcttttttgtttttttcattgaaacgggtcttgctatgttgcccacagtgttcttgaattcctggggtcaaacgatcctcttgcctcagcctcctaaagtgctgggattactagcatgagccaccaggccagccatttttcgctttcttaatttttaaaaattaatgaggtttttgttgctattatatataatcagacaaaaagctataaaggaaaaaaagaattagtccacagacaagttttggttggagtccgacatttcacaagctgtgtattggccataagatggagtgtcgagtgaatagatgccacagaaatggcctttgaatggcgaatgaatgaagttgacacaagttcagaacgggtttttccattactatcgtttggaatacagtgtggccaaagccaaggcaactggtcactgtgactggaaattgtagccctggctgattgtggtatgagactgctaatatgaattctaaaatctcactttaatgcagcaaagcctatttcttgaagtggttggggagaaagtacagcacatgaaaatgatagagaattcacatttcagtgtatgtaaataaagacttactggagtgcagccacacttatgtgtatatgctgtctgcggctacttttctgctataggaactcagttgtaacagaccatatgtggtcctctgcttagcgctgctgctggatgcactacagattgtgcatttcatcgttggagtagtcccaactcataagaaagcatcagaagagttagatgtttaaaatggagtatcagctgggtgcggtggcccacacctgttaatcccagtactttgggaggccaaggcaggcatatcacctgaggtcaggagttcgagactagcctagccaacatggtgaaacctcatctctactaaaaatacaagaaactgggctgggcacagtgactcacgcctgtaatcctagcactttgggaggctgaggcaggcagatcacgag

SEQ ID NO: 26265 - DNA, 1048 bp, Homo sapiens
tcaagcaattctcctgcctcaccctcatgagtagctgagattacaggtgcgtgccaccatacccggctaattttttgtatttttagtagaaatggggtttcaccatgttggtcagtctggtctcgaactcttgacctcaggtgatccatccacctcagcctccaaaagtgctgggattacaggtgtgagccaccatgactggcctgactaaacttttgaaacattccattgtaggttcttcctaaaacattatgagaccagattctgttatttctattatacagaagaggaagcttcttttaaggagataatctgatttgtttaacttacatgttctgttttaagttactgaagtaaacccactatttaactaaagactgtaatactcttagattgccatttattagccagttgaggtagtgtgtgcctgtagtccttgctactcaggaggctgaggcaacaggatctcctgagcctaggatttcaagtttgcagtgaactgtgattgtaccattgcactccagcctcagcaacagagcaagaccgtatcgctaaaaaagaaaaagattgtcattcagaggtgacactgccagaattaagtctttggtttactgtatgctataagtagataccaaaacactgaccctttcctccatctgtcacagtgaggagagctatgtcttttattatagatcaagaatgaagcttattatggtatggctagtataggtaaaggtctcattcttttcttttttttttttttttttgagatggagtctccctctgttgcccaggctggagtgcagtggcactatctcagctcactgcaacctccgcctcccaggttcaagcgattctcctgcctcagcccccacgagtagctgggactacaggcacacaccaccacacccagctaattttttgtattttttttagtagagatagggtttcatcaccatgttagccaggctggtctcgaactcctgacctcatgatccacccaccttggcctccccaagtgctgggattgtaggcgtgagccactgcg

SEQ ID NO: 26266 - DNA, 1048 bp, Homo sapiens
tgtttcccaccctgaaatctccaccctcttggttactcattttgatggagcacatgttccagtaggttcctgagagaagggatgtaggaggagaagctttggagacttcacatgtttacagatgtctttactcgactttatacttgatcagtagtttggccaggtcctagaactaacattggagcttccagtgcagcagtttggcagtctgatgccctttgcttcctctcagtgtgttgtctgctgtggtggctgtgcgttttccttcccttgaaaactggtaggatcttctctctttttggaaatttgaaagtgatattcttaatgtttttctttcatcgtgatgggcactcagtatatcctttccatctggaaactcgtgtccttcagttctgagaatttctgtttttttgttgttaatcactttctctatgtagtcccttcttggaattttgattcatcagatgttagatcctctgaacagcttctccagtttgcttatcttttttctacttttttatctctttgtcttctaacccttgtattgagacttgttaatttctgagagttctttcctggtaactgttcttgttttgtttgtgaatagagtgtcttctcggaggctttgaaaacttttgaagcttccgtctgtttcctgccatgtctcttttcttcatttttttgtcttaattgtttttacctgtcttttgagtctttctgagttttggtaatccttgactgtattttattggtttaaagtcactgaaaacctggcaggcctttctgtgtggcttagtgggtttgccagcttgtggacctcaccagagtggctgggcagggcctggctatttcttcaggaggttgccaaatgccagtatctctaggacttttctcttgggctggacggtttcttcagtgaggaatttttcagtcccctgggcaccaccgtgtgttaggggaagaggagggcttgtggaatctttgcattcagtcttgccttttccctcatctctgccgggcatccctggagaataagcctccagtgccc

SEQ ID NO: 26267 - DNA, 1044 bp, Homo sapiens
acccagtagcttcactgtcccgtggctgtgggcaaggtaaagtactcctcagctttagtttttcaatctttcttttttctttttgagacagagtcttgctccgttgcccatgctggagtgtagtggcgccatcttggctcaccacaacctccgcctactgggttcaagatattctcctgcctcagcctcccaagtgaccgggattataggcgcccgccaccatgcccggctaattttttgtatttttagtaaagatagggtttcaccatgttggccaggctggtcttgaactcctgacctcatgtgatctacccacctcggcctcccaaagtgctgggattacaggtatgagccaccgtggcatggtggctcagccaggtttttctatctttaaaataacaataacaggcatttctcttctcactggtttgttttgagattttgacatttaaatgagatgtgtgtaaagtgctacagtaggccccagcgcctgccatttctcacatatgtatgtgaagtgggcatgtctcctcattataaagaagaaaacaggctggagcagtgtgtgtcgctcagatgtcagctatgtggactgttacaagacattttcctagattgctgtacttgtgagtcattctgcctgtccctgtccttcatttcaacctgtccttgggtgggattgcactcttgtttcttgtaggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccaggtaagcaggctggagctgagctgtccact

SEQ ID NO: 26268 - DNA, 1054 bp, Homo sapiens
tccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtaagtggtaccagagttaagaaggtggtcaggctgttgtgtctggatctgccagctgcctcccgctttctctctgcacatttccctaaatcacaccttgctgaaaagccaagatcaggtgactccctgattcatgacttgacaaatatttgagtgcttgctgtgtatgggccctggcctggacactgggggtattatggtggctagaacaacacttctgacctcatggagctcactcttctggggaagagacagatggtaagcagatgtgtacaaccttgggtggtgctagagtcagcgaagaaaaattagagcacatgaggggtgagattgtaatgatggcaaggggctgttgcacttagtggggttaggttcttgttcttgaatcagccttaggggttgtgtatttggagactccctagcgcagaaactttggtgttcctggatgactaggatggtgtgcaggtccagggaaaggcaggagtggccccctgggcacctgtttgaccacttatcccagtagtgtcaggtcctagcctagcttcttggccagagaccacagcagactcaccttgggaccccactgaggacttacagaggcaaggtcttcagggaaggggaggttctttttttccaaaactccaagggttattttgatgttgttttccttttttatttcactttacaaattttttttatttacgtttattcctggtaactcacagtgtatttttataataaaggaaggatctctgtttaatggaaaagcttgatttttctcttgatcttcaaatggtggatggtagtaaactcagaagctcctggaatttcattttctctgtacacacatagcgcatccctgaattctcagccccgtttg

SEQ ID NO: 26269 - DNA, 1940 bp, Homo sapiens
acatggagaaataattattgtatagcatttaaatgtgagtagaaatcaccagctgaggagataatgtgcaagaggccataacatcatctaaaaatggggaatagttcaatttttggctgatgtgggagtatcttacttgaaatagtgggaataggcctacagtggtaactcaggctggattgcaaagcattcagaccttactgtgtaagcagtgcatacaaagattcatgttcaaagatgtttattgcagcactatttgcatactctgaattcctttttgtgtgctagtgtgtcatagtttacttttatatccatattgaccccatgctatattgctgttatttttgctttagacagctatcttttgaagtgattaaaaataagagaaaaatgtcttttatatatatcttcagtctattcatttttatagatctttgtatatatccaaaatctgtataaacaaagacagatccaagatctattgggtatcaaattccttctgcctgaaaaactgcattttaacctttcttgtaatataggcatgctggtactgagttcattctgcttttgtttgtttgaaaaaagtctatttctccttcatttttgaaacaggatctcactctgtcactcaggctgtggtgcaatctcaactcattgcaacctctgccttctgggctcaagcaatcctcccacttcaaactcccaagtatctggcactacaggcatgcaccaccatgcccagataatttttgtattttttgtagagagtgggttttgctgtgttgcccaggctggtcttgaactcttgggcttaagctgattcacctgcctcaacctcccaaagtgctgggattacaggtgtgagccactgcacctggcctttctagcactttaaagctattgtcccattgtcttctggcttatatacttcctgaagagaaatctgctataattcttatctttgttcctccatatgtaatatgctttcttcccccacagctgccccagctgctttcaagattttgtctttgattttctacagtgtgaatatgacgtgtctaggtatatttgtgtagggttcccagctggtgttctttcagtttattatatttatagtttgtctgtgaaaagttctcagttgttacctctccaagtattttttctgtctcattcttcctttttcttttgggattcctattacctatacactagactatttgatactgtctcatacctctgttgtctctctctctccctccctctccctttctccctgtctccctctctcccccaccattgatctattttcaggttcactgattctttcctcagccttgttgcatctatttatgatcctgttgaaggaattcttaacttctgtcattgtttttcatttcatgcattttcatgtgactcattcctgtagtttccatcgctctgttcaccatctgttcatgcatgttgtctaccttttccattagaacctttaacatgttagtcatagttattttaaatttcccttctgaacctcctgagtctggttgtattaattgctttctcttttgattttttttggaagggttgcttttttgtgtcttatcattttacattgaatgccagatatcatgtataggataagggaggaggtaaatagaatgtatgcctggaaataggcacagctcttcttctgctaggccgttactgtgaggagctaagtcaatcagtctagttaggagttgagctgggtttggattttgttgttgtcatggtctctgtgcaccactgactttaaattcttctaattaccttgtgctggtttcctaaagggattttctcaatggtcctgctccatcagcttttttttttttttttaatttgagatggagtttcactcttgttgcccaggttggagtgcagtggcgcgatctcagctcaccgca

SEQ ID NO: 26270 - DNA, 1034 bp, Homo sapiens
ctgcctccaactgataatggtttgtacaaacactatggtttatgctgaatacctgcttttcttctgggagtctggaattttggtatgtgttaggcaagggggtgcctacatgatcaaccttcaatataaaacacctccccctagcgaaatgtgtaaagtattcatattgtatatttttcattagtattatttaaactgacttttttttttcttttcctggctccttttctgtttctttttattaatatgctgatctgttttatcttctcaggccataaagaatgctgatgggagaaccattttcctaattttcaaattgttgagctgtttgccataatgggtgagttcaaactaaaagcatttttcagcaataattaaaggatagaatggaagtgaaaaaactttctctattatgtgttattataaacctttttataaataaattttatgatatagcagatttatgaaatgttttatatttacttaatagactttgaattaaagtactttttgtgttgctgtagttttagaatgatcattttatgcgtaacagcagggacattcaaaataagctgttaagatgtgttgtgatttgcttaaagtctgatggcaagagagaaatcataaaatttaattttatcattcatagagcagcaaatcattggtgctcagggagaatatgttatacaactcttggtcgtatattgtggtataatgttagtttaaagacactaaagtatgggaatggattgtgtatgttcagtttacatattttgttttcctgtttacctcctttttgttttttccttttctcctttgtgttaagggttccagcatgaggcagggaattagttagacaggaagacactagaaggaaatggagtcacgaatggcccaccctatcctaaatcaagaaaaatggtactgagtagttggatgctaaattttgaaacttagactgatcctgggatttaattctgacatttgcttgccagagtttgcctttatcacacattttctacttcttgcttaac

SEQ ID NO: 26271 - DNA, 1045 bp, Homo sapiens
cattaccacctgtcattgtctttctttttgattatagtcatcctactggatgtgaggtagtatgtcattttgatttttattggcatttccctgatgacagatgatactgagcatctttatttttctttttcagtattgttgtggctattcagtgcctattgcagtttcatatgaatttaaggatcagttttccgtttctgctaaaagaggccattggaattttgatagagagttcattgaatctgtagataactttgggagtattgctatcttaaaaatattgttttcccattcatgaatatgggatgtctttctgtatatttaggtctactttaatttctttcaacagtgttttgtagtttttagagtgcaagctgcatttttttgttgttgttaaatatgttcctaagtactttattttttttggtggtattgtaaatgaaattgatttcttaattttatttccagaatgtttattgctaatgtatagaaatataattgatttttgaatgttgaccttgtatcctgcatctgtgctgaacgtgtttattgattctaatactgtttttgtttgtttcttaggttttcctgtatctaagattatgtcacttgcaaatgggtatagttttacttcttatccagtctggattccgtttatttcattttcttgcctcgtcttctgactagaacctctagtacaatattaaatagatgtgtggcaagagtggacatccccatattcctggccttactgggaatgtatcctgtttttcaccatgaagtttttcaccataatcaacttgattatgtcctcttctgtttgttatcttttgagcataaaagggtgttgaattttggcacatgtgttttctgtatgttttgagatgatttggtttttgttcttttttcttttttttctttttttccttgagacagagtctcgctctgtcgcgcgggctagagtacagtgcagcatgatctctgctcactgccaacctctgcctcccaggttcaagggagtcacctgcctcagcctcccaagtag

SEQ ID NO: 26272 - DNA, 1094 bp, Homo sapiens
ttagctatgaaccccctccagtcagccagtcagtcagtcagtcagtcaacaaacagtgccactgaatggtaagagtcagaccaggcagcatcacccactggctgtgtgtccttacataggttgttaaacttcttgaaggctcattgtaccccagggctgttgggggtaatccctgagatacaaattacaaaccccctccagtcagtcagtcagtcagtcaacaaacagtaccacccaatggcaagagtcaggccaggcagcatcgcccactgcctgtgtctccttacataggtggttaaacttcttaaaagctcattgtaccccagggctgttgggggtgatccctgggattagtaaggtctcataatgggatgctgctgagctcctcacagaggaaaggaattacagggagaaggaggtgagcattcttggagagctcctacaataggcatggcatgtttgtgaggcctccctgccaagaagagagcgcatactccatggagaactgagggctgaaaggtcggcccgactctgctcaaaatgggccttgaatgcccagtccagatatctagacttaaaagagcaatgggacgtcgtcagcaggggagctgcatcataacaaaagaatggaaagggcacaacagcaacaattccagaagctgacagcagatggatggacacagtaactgacttggcagactggaaagcaaaaatctcagcccgtgatgggggcgcccagaagctgaaggactggaccacggaaccataggaggctgtggggcttccaggaaggcagtgcaggtgggagggcatgttgagagtttgtaagagaaactgcgaaagccctcctcactgacttgactcccctctccctgcctgcagaaggtgaaccagaggctctgactagggacttcaggccccgcttcaggaaggagtggtgctcttagctgaccacagggagtcatgcaaatgtccacagcctgcacaggcaccagctcccctgccccaccctgctctgaggggccgaacaccatgggtgagcgtcttccatcctccaagagcttggaggagtcctcttagaaagcagcctaaaa

SEQ ID NO: 26273 - DNA, 1050 bp, Homo sapiens
gtttgcccagtaactctgggactcagggagagggaggatctgcgaaagaaagccactcctacctcctaggtttgtggattacaggcaatggtgtcggtaagaggcccagttccggggattcccagggcggatgctagaacaagaactctatatccagctgtccagggtctcacagcaataagtggtcaagtcatggatttacatctgactccaaaggcttttccattacccactcatctcccatttccttcagtggataggagggcccaggagggcctggaagcctgggctgagtgagtactgtcagccacagctggagagaggccacacacaggcccatccacccagtgtgacgcggtaaggcgccccgccccccaggccatgtgcagaggcgaccacccagcatctgctgattaagctgctactgtagaagtccctgttttggtcttcctaaatcagggcctgggaaaaagacatgaagaggtttcagtcctccattttcccagaacaaaagacttttcctgtccacatcatatcactggcccggaatgcatccgctgcaacctcagcgccttcagcacgatgcagcactgccagccggcctggctcgaggagccttggccaggatttaccacctgccccacgtttttgaggatttcatcacgtggtgtaatatgattgcaatacaattcttgaaagatattgtttttactttagctttttcttttaatgtaacagctttactgagatttaattcacatgctgcagtcattttaaagaggtaattccatggttttttttttttttgtatattcacagttatgtaaccatccccacaatccatgtttaaatattcttatcaccccaaaaagaagtcccataacactccccatttcccctcctaccagtcctcagcaaccactgatctactttatggatttgattattctttacgcttaatataaatggaatcctacaatgtgtcgccttttgtgtccgggttctttccctttgtataagcttttctaaggtcatccatattgtagcatt

SEQ ID NO: 26274 - DNA, 1051 bp, Homo sapiens
gttgcgtcactccccagcgagcctgatgctccctctctgcccagtcttccaggaatccactggagttgacacttgagacagaacccacgttctcccttcctagcaaaaggtgtggggtatccggttctttgaaggtcgtagaggcagttggggtgtttaggactacatcctgaccctgtttttgagtctaaaaggcccctcctggctgtgccgaagggccctggggctggactgattgcgggcctggctcactgtgggcttttcccctgtagttcgcatttcacccctcccagaaggaaacccaccactgactctggggacaggcagtgcccagtatggatgagatttgctccccctcaccacactcccgtctcgtctcaaagattcatactcttgtcttttttatttattttttattttgagacagggtcttgctctgttgcccaggcctgagtgcagtggcactcagcctcggcctcccaggctcaagccatcctcccacttcagcctccagagtagctgagactacaggcttgcaccaccacacctggctaatttttttgttttcttgtatttttattagagatggattcttgccatattgcccaggctggtctcgaactcctgggctcaagggatccgcccaccttggcctcccacagtgctctggatgacaggcttgagccattctgcacacgcacccagctaccctcttgcctgctctgtgtttgggtggttatgtgtttattggaggcagtcagtttgaaactaactcatggtgcagaggatggaaccatggaagactgagcagtctggattcaagtgtggaccccgctctgctgtgtgagcttgggcaagttactcaacctctttgaggcttaggtcccttttctggaagaggccataataatagtagctgcagtattgccctggggattaaatgagagtgtgaatacagagccgctcacctgtgctgggtggtgttctgtgtgcgagactctctggtccctgaagaaggggtaataggggcccaagtgggagttgactgggc

SEQ ID NO: 26275 - DNA, 1068 bp, Homo sapiens
atgcatacaacggactgttacgcagccttaaaaaggaaggagattctgacacatgctacgacatggatgaaccttgaggacattaggctgagggaaataagccagtcacaaaaaggaccaatactgcatgattccacttctgtgaggtacttagagtagtcaaatacacagagctagaaagtggactgggtgcataaatgcccatcagtgatgttacctaatcatttatgcagctaccgtatagaaaaggcaggagtgtgctgctcattttataggtgagggaagctgagaaataccaagaagtgaggtaacctactcaaggtcacctacaaaactgacgatagggcagcgttaggttgtgattcctggtttctaaccttgtgggcttcccattgcagaaagaggccttcactgagggtccctctgtgtgagccctggatgcgctttctgctgtggtttggttgcagggagggaaggtcattaacaaaacccactctcctctagcactgcagcaaaactcatcctaacaatcatcttcacttgcttccctgtctcccttgaagcccttcaaccaggccttcgttccaccgtgccagcaaaattgttcattacaaaatcgccagacgctgtcggctagtgcggtgagtttcggccctcagccccaggacggcaccgtgggctcctctcttgactgttcctcctcctgagacctcagcgttgttgcgcctgggatatcccctcttttctctctcggcaccctctggcccagcccgtgttgttaaaaccctctgcgtgcagagcgtcccccacttctccaccgggcatctaatagacaccctggaggtgacatgcagaaccaaacacttcactcctgacttcccctcctcatcccccaaaacctgtagctaacccctccttccgcacctcaagaaatcgcaccccatcagcaagtcccaccagctctaccttggaaacagatccagtaccagccgattctctcctccaccactaaccccacatctgggcgcccccctgcaccccaccacggagcccctgttttggtccatg

SEQ ID NO: 26276 - DNA, 1381 bp, Homo sapiens
ctgtctttgtctgggcagtgcatattatttctgtcgttgacttgtttctttcaagtgtgtttataactgtgatcctttaatgttacaggctttattgcttctaggccaaacctcttgccatcttgattaattcgcttttcaacaaaaatggccattgtatttatacttgttttgaattctgacatttttttttgatactttgtttctagtcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacaggtcagtggctgtgatatgcttctcattgaccactgttacctgtaacattctcagatcctgataattgtgtcttttcccatgtttttgttctgcagctgtggcctggcatcctgttcatgaaggactttttgccagtggagggtctgatggttctttgttattctggcatgttgggtatgtaagatttatgtgaaaaagtagtgtattttgtgaagagagcacgtgaatgtgtgcagacatgatagttttgtagcttttctaagtgttcatatatcctatatcagagactgcttgcagttttcagttctgtaaatccagcttggaatagaaaatgtacctctgtttgtggatatggaagtcattaaggaggaataaaatagattttctagtttctaaatgcttgcagccttttcccctgtgaagtgctctttggatgaaagggtaactgtcctttggcaatgacaagccaataccccgagacatgtggaattcaccagagtccaagtccaggctttggtagcttcattttaagagtaacagaaaatgtcttttttgagggggagggagaagctgggtaacttttgtgaacaaatcttctctctttggtgctgttgcagggtagagaaggaagtgggtgggatggagatggctcacgaagggatgatctggagtctggcttggcatcctcttgggcatattctctgctcaggctcaaatgaccatactaggtaagctttatattgaaatagcaaagctttatatggagcaacaggaaataaatactgtatgtgtttatttttattggttgattgatatagtaatttatattccaacttattcttgggaatatttttgtagtggtttacaaatacttatattgcaataaagagattgggtattgaatatggttttggctattcaaattttgttttgccttctgacttaaaacagaagttttccacttttatttatttatttatttatttatttgagacagggtctctgtccaggctggcg

SEQ ID NO: 26277 - DNA, 1862 bp, Homo sapiens
aagctgttgttctagcactatgtaaccctacaaatactccccagtattcaggtcttgttttgtttggtgaccacatatttgagaggttgagcaccaataacaggagctcaataaacgttggcatcatgcacatttattttgaattaatgagtggaagtggaagagtacataaatgaatatgtgaaagaacgagtagaataagtgaaatcgtttacttcctgtttgctgtacattttaatgctattaatggtcactttctgcaaataattattacaaagtagtaagtcaaacatttctggcatattagacacaggttaatctacaaagcagcatcacctgtctccaggagatgctaattctgtcactggtcatttagctaggactctgaaggaacgtttagctggatagctagctaaggaatgatgcaaactcactgttctcaatgcttaatatctaaaaataactcagtgtgattaatttggaatttcttttggtggagttagtttatggttgtcacattccttcattccgaacaagactctggtcttcagaatcaatatgtttacttattaaatagtcaaaagaattatgtatttatccctaaattattttcttatatagttctgagaggtggaaaggagtatagaagttgtcatatacaagctcttcagttacagttgagaaagtgaaagttgatttgtaattggaacagaagggactatccacttcatctggatgttatatttagtgagatgaagacaggattggatgaggaggaagaaaatccgggccccctcccaccactgccctaaccctttcaggcttccgtgttctcatctgcagagttagagggctggatagttctgcaggtcttctcaagctctggtatcattgaaagataattttttgttgttgctgttcattgtacaactgagataaataaaaataagattgtggaaatttaaagggacactttctttagggccagttattgtccaatagggtttttttgttttttgttttttgttttgtgacgacggaagtattctatatctctcctgtctgatattcttagccactagtcacgtgtgactattaagcccttgaaatgtcactgatatgactgagaaactaaaattttaaccctaaaacaaatttaaacagccgtatatggctaataggtgccatatgggacagtgcaggttaaattcttaagtatttgtgttcagagggaattccacacagatttataatggtctttttctttatatagtgatctacaactggaatgtcttaattttagaattttgcaattgtacctccaagtccaagtcgtactgctgaatctttcatgtgcccatatcactggcttctttaagctctgccatcctactgaggattctgcatgtccaccacagtctacctatagactcctgtcagtcccctgcagggccacactttgtgcctgtagtggactttgtagtgtctggagcagatttggtgctgttcggaattttatcttccttttttttgttgtcaggggcttgattctgagaagtttaattacttgaaaaactgcctggtctttcatcagcaagaaattttcagtactaaaatctttagcctttagggagatgtttttagtactataacgtctagtcaccaggctacaaaaactctcgttacctgggtgaattttccattaagtctgtattcttgcagtattacaaacactacattcttggaattttcacatttggggaatcacaaagagcctggaatgattgtatcatgaaattctgtacctcagaaatgaaatgatcaaatttagtatagaggcattctttaggcttaatgtttga

SEQ ID NO: 26278 - DNA, 1061 bp, Homo sapiens
cttccccacgttattgtaaaagagtttaacagcagcctgatatgtaagtttcagcaaaacttatacctgtatatgtttttatttgactcaaaaattagatattttaccatatagtcataagaatttgctcactttgatgccagaagtacttaagaagttacacggcactaattttatgagttgtatgcctaatttcaatttctaacctatttgacagtttcttttaggtcagcctttgttggtcttccatgtaaatacaagttggtacaaatcaatagaaaccattttacctacataggcaaagtaaatgtgtgacttagagactgccagatttatggtgcatctacctttttatccatttgagcttgcttttttatgtttgtgtattggttgctcctgacactatacatttcaaaattttttataacttgaaaaacacttctgtgctaccactcagttctgatcaaatccttacattttgcaacactcatttctgaattttcagtaaagaaatacacattacaaattaaaggttaaaggcccctttacatgcccttccccagtctcctcttcctcccccggaagtgtccattctgctgaattcaggttcatcattgccagacaaatgtagtaagctagtgtttcacatttccaaaatcagccttctggcagacttggaagtactcttgagaaaagaagactcgtgaccaaattctcccacagatttgtaataatgtacatattgaaaggactgaaggctctcagactgggaaagaaacttacccattttaaaattcagcattgctcaacttacctgactgccggaccccttcacccatgattctatgcactgtattgttggaacatacattgtgaaaacactgccctgcctaggcataccccctttccagaattaactttccatttaattctatagtttttcactgatgtaactttctagactggacaacaaagatgactaatagtaatcactccaagttgatgttgactgttgggttgtggtgaaatcattttgcattaaaggaaggtaaaatactaat

SEQ ID NO: 26279 - DNA, 1049 bp, Homo sapiens
ttttagtagagacagagtttcattatgttggccaggctgatcttgaactcctgacttcaggtgatccacccgcctcggcctcccaaagtgctgggattacaggtgtgagccaccgtgcccagccggaaagtgttatttttatcaactgcatgtttacttttcaagaatttctagtggttctctaatcttttcatttttcaaggaagcctgttttgtagttggtttgtttttaaggaatataccccttaaaacctttaacatagtaattggggtgtttgtgtggatgtctggtttgatctgttgttcctgtttgttttccctaaagtcatataatctgtatttttctctttcctggtacttgctttttctcaaataacgcagtgacccttggttgtccagagatttgaatggtggtttgtattggttagtataagtagctatcttgcatttttttgcagttaagttcgcttacctacaagggtcctctcctggatggaagatctcactgtggattcgtgtgtctgtgtgtgtgcttgtacatgtgtacacacgtgcatgtttgtgtgtgtttaatgaagtgagtggagaagcacaggccactgccacatttatcaagtaagtgggttgtggtttgtactctgaggtggagtgcttaagtttattccactcttaagtggaactgccatctttctctcctccctcccttctcttttctctttttctcctcctctcccattctctctttgccctccacttctttccattttcagtgtcatccgtggcatttctgcagactttgtgctgctttactcttcagcctcaaatcctgctctagggtttcttcccagactgaaatgtgctttttgtaacaaatgtgctttgtataatttgctttgtctgactgagagcatctgttctacagaaacaggaagtcaggagggacaacctggacaagtctccctataattaccctcattacttcatcacagcctttgtcactgagcctttgccacaacctttgtcactgacaactacagtctatgtatttt

SEQ ID NO: 26280 - DNA, 1152 bp, Homo sapiens
gtatattaaggtcatttttctgcatcattactaccccagtctttttgactgcatgtatctactgtaatttatttaactattcctcactgataggcctttgggatttgcaagaagtttttgccaagacacagttgtgcactaagcttcctaatacctttatatttgtgttacttacgtaaattttccattaggttagactcctaagaataaactcaatggagcaaagggtatgaacatttaaacttttggaagatgagttgtcttcactgtccaggaagtcatcaacgatgaagtttaagaaagttcttgtcatctagccaaactgaaaataacacaggattaacattttaggaaattgtcaccacctaaatatttaaccttatttttaaaaatcactaataataagcacacatggtaaaaagtctttcctccagccccatagagggatggaatatgaaatttaaaaatctgccaatcctttacctctccccagaggtagtttcttaaaactaattgtttctattcttgtggtcatcagaatttcacataatatgtattttggtatatctgtctgacgtagtgcctctttctgtcatcaaaggtgaggaattgagtgttattcacaccaccaaccatgcctcctacctcctcgtttttgtcataatgaattgtagtttcagtggttttctttatagctttaaatgttcttaaacctttatttttaaggggactgccaactttagccaatattccttggctcaccactaggttacagaaggaaatctgtgcctctcaatgtgtttccacttctgccgtttgtcttcctttacttctgaattgtcaaggattttaagccaattttattctgttcttgaattatggctacttttgttttcttcatattttaaaattctaaacaatgagaacaaaaaagatagcatttctgctatgaatgatactattgataacagaaccaagcagtataatggggccttgcagaaagagtgataatcttgtggtagttaatgaaaagttgttctgcttggacagtgtcaagatcaagtatgctgcttttgtattaagtctgtcatgctgtcaactgttgaaaataatgccatagtttaattcacttttgtcttgcaatttattatt

SEQ ID NO: 26281 - DNA, 1049 bp, Homo sapiens
gtttctgcttggcacaatctccgtatttcctctggggaactttaaacatcactcagctgagagtcagcaagtttggctttgaatccccgctttgccactgggcaagtcaagtctttctcagcttgcctctcctcgtctgtaaaggagagctaatgatacctacctcacagggctgttgtgaggaccacagacatactctgcacagtgcaggatgaagcaaatgtttgttgctaaagtcataaatatcaaggaaagatgctaaaagacaagataggagtaaagaaaataacatattttacttaatttgatttaagaggagattggaattgagtaggaaaggtattaaaagagaggtattaaaggtattaaggaaaggtatttatgggaggagattattggatcaaaaattagtattggaatatgattatcttttcagtagtgatttttaggtttagaagtgtgattgataaagttgtaagccacatttaaatagataacattatattgaaatagaactatgacttctttttaaagctttatttatgtaagtcctcatattttatttccactatcatctcagaaccacaggagtgccagaaggcaatccttcacaccctgcattagagttgttctcttcattgcctttgcttgcttacctttttttttttttttttttaattattttatgttttagagacagagtctcgctctgtctcccaggctggcatgcaatggtatgatcatagttcactgcaaccttgaactccagggctcaagtaattctcctgcctcagcctcctgagtagctgggactacaggagcttgccaccatgcccagccacagattgttttttgaatagataatatatttgaatctttctggagaacgacgtgctgttttttgagttctagttaggtaaattcatgttggatgagtgtaagacataccgagttactctacagacttggagcattctttccacttgtactttttggtaggtttacaatatcttgaaaaaatatgaagcccataaagtggtatgtctgtg

SEQ ID NO: 26282 - DNA, 1341 bp, Homo sapiens
agacatcatattttatttttaattttctcccacagcctcacccctccccattatactcataaagagaatcagttaacaagtttcagcgtgctttaattttgttttaccttcttgattttaacaataataacagctgacacattatacttactgtaattgtaaggcatattgtaagtactttatttaatcttcccagtagccctaccagagcagtactgattgtttcccattttacaaatgagtaaaccaaggcaccaaaaagttaaataaacctgtcagaggtcatataatttataagagttgaggctaggatttgaagcctgtttggctccaatattcatgctgttaactactatgttaaactgcctcttttatgttttaaaaggaatgtcagcaacagtaccttcctaagctgtaattgacagaattgtgaagtaaagattggtatgggggagaagggtgtgggtagaggaaactaggtattcaggttcattttaacattctttaaaactgtagaggttatagtgaatgtataatatatttagcaaaaatattaaaacacagctattggttcacactacacatgggttataaggtgtattaaatagaacatggacataagcagttatattgagacttacgcaggagtttttagttttcaaatataatactaatggaatggaaatgaacacttacgtactcaccacacagattaagaaaagtaatatgattactaatacttttgttaagtctctgtgtgccccttcatgattgcattggtggtttatactacatgagatgactgctgtctacacaaagatcttttcgtttggcagtgtgtttttgaactgtgtgaagacacatttacaaagtttgaatgttccaaaaaatgggtgctttttattggaaataactttattattaaagtaaaattggtaaaccatgtagtttatgataataaacctaatttatttctataaggttttacaaaacactccccagaattctgttttcccccaagacaaaaaacccagcttcctttaaagtagcccatagcagaataattccttacgttgacttagcatgcttttagtattaaaagcacttcaagcatatatccaaacaaccacctggacccattttactacagctagctgcctgtattctgtatccagtttcttactttgaggaagcgtttctttaaggctctgtgctatcctgaaaagactagatcatggtaggttgtcttattatgtaaataattatatcataagagagaaaaagacttgatatttaacatctaaagcacattatttaaacaagtttgtgtagtagggttct

SEQ ID NO: 26283 - DNA, 1055 bp, Homo sapiens
gagttaaggaatttgttgtatatatgcaatacaaacatcacaacaaagacacttctaactggatcctgttagtttattaagtaggaaggtagttttctccagtgcttaatttgaaccttttgaatgtactgtttaacaaacagtaccttctactccgtacccttgattccaggatgccacaaaagtaccatctttctctgacacataaatacagggtgggaggatgggtgctacgggtgttgggtgtcaaattattattcagagcttttcccttatgttcaagagtcagcagagatcgttgtcttggttgaatcgttaagtttctcacagtttttcagagctttagctgtagcatataatgttgatgttttgtagacaggaaagactcttgagatactttaatgtgtatttcagcccatatttcaagccagtatcttccatcacatttgcttcaacactcctgacttggcacattttgtttgggtttatccacagtactgtatgactgtagcttttgtaagaatagggaacctgtcacattgagggagtttactcactataaaggtcataatattgtataacttcagaacgagacagagactttgagatgatcatgtctgagttattttatggatgagctccatgatgccaagggtggaagtgacatgttcaaagcaaaataggttcagagccaggactagaatcttatcatttgactcccagcctaatgccacacttatgttgaatctttcctcactattagtcttggctgttaaacagaaataagtgaaacattttctaagtttttaaaatcctggaaacttagagaaaatgaaataattttatttattaaaagtaattctagagtagctgggcgcggtggctcacgcctgtaatcccagcactttgggaggccgaggtgggcggatcacgaggtcaggagatcaagaccatcctggctaacaccatgaaactctgtctctactgaaaatacaaaaaattagctgggtgtcgtggtgggcgcctgtagtcccagctactcgggaggctgaggc

SEQ ID NO: 26284 - DNA, 1060 bp, Homo sapiens
ggcctccggaagtgctaggattataggcatgagccactgcacccggcctcagcatggattttttttttaaccagctagtgaattgctcatgttaacttttaaggtagaaatttttattgagataattgtagattcacatgcatttttaagaaataatacagagagatccttaatacagagattctatttatgttacccagtttctcccaatgataacaaattgtaaaactgtagtacattgtcacaagcagagcattgatagtgatatggtctgcagatcttatttagatttcctccagttttactgtacttatttgtgtgtatctatagttttctgcaatcttactatatgtttatgttcctgtgttcgccaccataatcaagatattaacagtttatcactacaagagttaccttttttataaccacacccatccaccctctcctacccccctaactcttggcagtcatttctattgttttggcattttaagaatgtcatataaatgaagcgtacaatatgcaatctcttggatatgttcatgtgtctattaccacagtcaagataatagaatctcgaactttaaaaagctattaattgggccgggcatggtggctcacacctataatcccagcacttcgggaggctgcggcaggtggatcacttgaggtcaggagtttgagaccagcctggccaacatggtgaaatcccgtctctattagagatacgaaaaaaattagccgggtgtggtggggcacgcttgtagtcccagctacttgggaggctgaggtgggagaattgcttgaacctgtgagatgaaggttgtagtgagctgagatggtgccactgcactccagcctgggtaacagagtgagactgtctctcaaaaagtaaaaaataaaaagctattaataaattaattattttgagatagggtctcattctgctgcccaggctggagtgcagtggtgtgatcatggctcactgcagtctcaaactcctgggctcaagggatcctcctgcttcagccttttgagtagacgggactggaggtgaaag

SEQ ID NO: 26285 - DNA, 1095 bp, Homo sapiens
aaacagtatttgttgccagtgataaaaatctgagctttcaaggtaagtttggaaagcttgttgtcagtgataaaaatctgagctttcaagataagaagtttggaaagcttgtatctgccattgtgaaattgaggttcccaataattaatacattttaagatgagaacaatggttattttaaggaaagttatattttataaggaatgtgataaaaattggatgatatacgtaattctctggaaccagtattttccagatggtcagtgcatgatgttataaaaatcatgcatgagtaaaagttccattcaaattgcaggacaaatcaatggattttaatgtaacagagtataaaaagcttgttgatacaatttcaaggctatgcacagtggctcacacgtgtagtctctgtactttgggaggtcaaggtgagtagatagattgagcccaggagttcaagaccagctggggcaacatggtgaaaccccatctctacaaaatataaaaattggccaggtgaggtgtcacgtacctgtagtccccgctactctggaggctgaggtggaagatgacctgagcctacatggtcaagctgcagggtgccgtgattgcaccactgcactccagcctgggtgacagagtgagaccctgtctcgaaaaacaaaaaaagaataaaaaatatgatttcagatgacacattgcagttagtatttcataaattagtgcttgtttttgggaaagagtatcatagaatatctacagttgtcttagaaggctgtgaaaatactcttttctagatgtataaatgtgtgaatccagattttttttcataatatatttcatatatgcccggctatttttcatatacttaaataacatattgcagcagactgaatgcagaagcaaacatgagaaagcagctgttttcaattaagctagatactaaaaagataagcagaaatgtgaaaaacaatgctacttttctcactaattgcttttgggaaaggaaaggtaatgagtttatcgttatttaaaaatgaattaatattttaaaaactttttttttttcatttctaatatggccagtatccaatacca

SEQ ID NO: 26286 - DNA, 1050 bp, Homo sapiens
ctcctggcctcaagtgatccgtctgcctcagcctcccaaagtgttgagaatacaggcgtgagccaccgtgtcctgccaaaatattgtatttctatattgtaatagtgaacatctggatatggaaataagagaaaaacagtatcggctgggcactgtggctcatgcctgtcatcacagcactttggaaagccaaagcaggaggatcgcttgagcctaggagttccagactagcctggacaacacagtgagaccctgtctctacaaaaaaaagaacagtttaaccactcatggtggcacatgcctgtgggcttagctactcaggaggctgaggtgagaggattgtttgagcctaggaggtttaagctgcagtgagctgtgattgtgctactgcacttcaggctaggtgacagagggagactctctcaaaaaatagaataaaataaatgagataatactacagaccttttagaatggcaaaaattcaaaacagctgccacaccaaatgctgtcaacgatacggagcagcaagaactctcactttgccagttggaatgcagaatggtacacctactttagaatatagttaggcagtttcttacaaaaccaagcatacccttatcatgtgatctagcaacctggctccttgagtcacatgagttgaaaataacatctacccaaaaacgtgcacacaaatgtttatagtagttttgttcataattgccaaaacttggaggcaacccagatgtctttcagtaggggagtgggtaaacaaagtttggtacatccatagagtaacgaaaagtaatagtagtaaaaacaaaaaaaagctatcaagacctgaaaagacatgcaggaaccttaaatgcatattgctaagtaaaagaagccagtctcaaaatgctccacactgtatgattccaactgtatgacattctggaaagggcaaaactgtggagacagtaaaaagatgagtaaatagccaggagcttgggggagggaaggatgaatagatagagcagaggatttttagggcagcagaaactattctgt

SEQ ID NO: 26287 - DNA, 1048 bp, Homo sapiens
ctgctaagatactaagatggctgagtgtggtggctcacgcttgtaatcccagcactttgggaggctgaggcgggtggatcacctgaggtccggagttcgagaccagcctgaccaacacggtgaaacccagtctctactaaaaatacaaaaattagccgggcgtggtggtgcatgcttataatcccagctactcaggaggctgaggcaggagaatcgcttgaacttgggaggcagaggttgcagtgagctgagatcacaccactgcactccagcctgggtgacagcatgagactccgtctcaaaaaaaaaaaaaagatactaagacattataaggcctttttactgttgatgcttgcagttatgttataaaagcagtaatggataaaactactagctccttagcatcattcaaggcagtgctaccaaactgtagtaggtatgttacttttacctcatgctggtagttgaaaagaaaaaagacaatttcacttaagaatgtcactgatgaagtggtaaatataattttattaaatgtcacctcttgagcatatgatttctaatacaggatgctttggattgagtcgtattcccttatatttatatgctgaagtagtaacccccagtgtgatgacatttggagatgggggcctctgtgacatcactaggtttagctgaggtcatgaggttggggccctcatgatgggaatagtacctttaatagcagaaacaccagaaagtttgctgtttctctttccgtcaagccagaaagagagccctcacttggacctggttatgctggcaccttgatcttggacttccagcttctagaactgtgaaaaactaaatttctgtggtttaaagccacccagtctatggtatttttatggcagccaagcagactaatacatagcacatgatgaaatgggaagtgtgggttggctgtggtggctcatgtctgtaatcacagtactttgggaggccgaggcgggaggattgcttgagcccaggagtttgaggctgcagtgaggtatgattgtgccactgtctt

SEQ ID NO: 26288 - DNA, 1087 bp, Homo sapiens
ggtcttgctctgtcacccaggctggagtatagtggcatgatcataactcactgcagcctcaaacacctggattcaggtgattctacttcctcagccttccaagtagctaggaccacaagtacctgccaccatgcccggctaatttattttatttttgtagagatgggatctcagtatgttgctcagggtggtcttgaactcctggcctcaagtgatcctcctgccttggcctcccaaagtgctgggattacaggcttgacccaccttgcctggactaaattgagctttttgttttttttccttgagacagagtcttgctctgttgcctaggctggagtgcagtggtatgatctcggctcactgcaacctccttctcccgggttgaagcgattctcctgccttagcctcccgagtaggtgggattacaggcacccgccatcatgcccggctaatttttatatttttagtggagacggggtttcaccatgttggccaggctggtctcgaactcttgacctcagatgatccacctgcctcggcctcccaaagtgctaggattacaggcatgagccaccgtgccaggccctaaattgagtttttgatgtaccaaatcattagatattacctgtgaaataaattttaatttatcttgggggatagtgaatacacatacatgtatgaaattcaaaaggtacacctgaaatttctcctcacttttatgctaactcatctaattttttttcccagaggcaatctgtggtaatgtttctgacgtatctctctatgagtgtgtttatagtataccactggcctgctttgtttgtttcatcacaacccaggtactctaatcaaggtagtttttatttttttcctttttagaccccatggaactttatattttctcctaagataacagagtcgtcaagtgaaaagtatagcttgatcatttacctaatttgctaatttacctaataatcaaatttggaaagtttgtgaatggatcaagttttactatctctcatgatttatttgtaataataccttttttttttctttttgagacggggtctcactcttttttgcccag

SEQ ID NO: 26289 - DNA, 1330 bp, Homo sapiens
cctgggttcaagtgattctcctgcctcagcctcctgagtagctgggactacaggtgcatgccaccacacctggctaatttttgtatttttagtagagacggggttttaccatgttggccagggtggtctggaattcctgacctcaagtgatctgcctgcctcagcctcccaaagtgctgggattacaagcaggagccactgtgcctggccttaaccattttttttgagatggagtctcactgtatcacccaggcaggagtgcagtggcacgatctcggctcactgcagcatccgtctcctgggttcaaacaattatcctgcctcagtctcccgagtagctggcactacaggtgtgcaccaccacgcccagctaattttttgtatttttagtagagatgggatttcaccatgttggctaggctggtcttgaactcctaacctcaagtgatgcacatgcctccgctccacaaagtcctgagataggcatgaaccactgcacctggctcataatgtaattctgtttttaacatttttgaagaacctctatactgtttttcatagtgattgtactgttttttttttttttgttgtgtgttttttgtttgtttgtttgttttttagagacagagtctcactgtgttgctcaggctggtcttcgcctcaaagtgatcctcccaccatggcctcccaaagtgctaggattacaggtgtgagccaccatgcccagcctcattgtaccattttacagtcagtacacaatggttccaatttcttcatgttcttaccaacagttattattttctgtgtctgtgtgtgtttttcctctgagaaaaggtctccttctgttacccctgctggagtacagtggtataatcatagctcactgtgcctcaacgtcccgggctcaagcaaacctcctgccttagcctcccgagcggctgggacaacaggtgtatgtcaccatgcctggctaattttgtttttcttttcttttttttttttttcctagagacagggtctcactatgttgtctgtcctggctggtctcaaactcctgggctccatcttcccacttcggcttcctgaagtgctgagattacaataggcatgagccactatgcccatcctaaagttttacagcccaataatagtaatattccatcactacagctatcattgagtttcagaagttagactgttaaaagtttcagtaaagagctttaaccagtttattgtggcaatactgtgtacacaattattttttgtaaaaggaaggagatttctgtcttaaatagctttaataaagtttcagtttcatatacaggaatag

SEQ ID NO: 26290 - DNA, 1971 bp, Homo sapiens
cagcttcaagacgacacttcattccagctataggtggcaacagatattatggcagggaatacagatgtttaaatacgaatgaaatcaagggtcaccattgcttcaggcacagggcacagcttactttctgccagatttttaaattccacctgtggccggagccccttccaggaggctttcgcttttagctccttgtgtttctttcgttccttttcttgtttctgcttgaaagccttattcatcttcttggcctgctttttgggcagtttcaaagggttcttcttgccacctttgaggccggacctggcacctgctgccccttcctgactctgtcaccacaaacagctagcctcatctttttaaagaacgttccatattttggaatttcttattgtatgcttaaaatgtcatgtattttgtttctcaattcctgttgtttctctattccttttatttcctgtaaactagaagttagatctagagaggtttgactaaatttgggtcaaatatttttggcaaaaatacttcatagaggccaggtgcgctggctcatgtctgtaatcccagcactttgagaggctgaggcagatggattgctagagcccaggagttcaagaccagcctggacaatttggcaaaaccctgtctctattttaaaaaaagaaaaaaaaatgctgggtttggtggcctgcgcctgtagtcccagctacttgggaggttgagacaggaggatggcttgagccagagaggtggaggctgcagtgagccgacatcctgctgctgtactccagcctaggcgacaagagaaccctgtctcaaaaaaaaaaaaaaaaaaaaaaaaaaaaagaaaaaacttcacaggtgatgatacgtgatttatgttgtgaggatatacttctagctatgagccttcaataaggtggtagggactgccagatgttagcttgcgttatttacaatgccaaatttacctggttaatgtgtccattggatttcttcatcaaagaggtatatttttccctttgcagttatacttgatctgtggggtgataactttagcatcatgtgagtacctcacttctcaaaatatttttcacttaatgattgatgattattagctgagtcatttattgggggttttctaattttgttatttgtttatattcattaactgttttctgtaataaagagcttttgctttccccctttcgtgtttaaatgtttaaattttgaaataaatatgaactaacagaagagttggaagaatagttcaaagaactcctatgtactttttattctgattcacccatttttaacattttgtcacatttgctttattcctcccttcctgcctcccagcccctcatgtattattttcggagccatttagtgttattcacagatatgcacttctccgcacttctctgctcaagaacaagttaagtacccgcaatattaactaattctggacattgaacatttatatagtattgaaaattcatactcaaatttctctagttgtctcagtaacatctcacagaatttttctttctctaatccagtatccaatctagatatttcttttctttttttatttattttttgagacagagtctcgctctgtctcccaggctgggatgatcttggctcactgcaagctccgcctcccgggttcacgccattctcctgcctcaacctcccgagtagctgggactacaggcgcccgccaccatgcctggctaattttttgtatttttagtagagacagggtttcaccgtgttagccaggatggtctcgatctcctgaccttgtgatccaccctcctcggcctcccaaagtgctgggattacgggtgtgagccaccgcacccggtcccaatctagatatttcgtatctctttagtctttaagcaggagcaggtatttggcccttattgcttttggtctttttttttttttttttttttgaga

SEQ ID NO: 26291 - DNA, 1021 bp, Homo sapiens
gagggaaatgcattttaactgaggtttggggcgggagtggaaagaagtgggccgagttgaagtagttggttgaaagggtcaagggaagttaacgtgaaatctgcaaaacagctgaagacttagccgtgatgttatcgtggcttgaaatcggtgcttattataaggatgaggctacagcttgacaggcaaagccctgcttttttggaatagttgtatttctatttggtttgtgctagatccctgtttctgattttaagttgtcttctggcaactaagtagtgaggatcttagcatgccttcttaaaagaaatgacaatgaatgtttgtacttggttgtaacccttgggattagtggccccttccggagtaaggaggaggcggcggcggcaggtcggtagggaattccgtaattggatctatttaaatcaaatcagaaaaatacgggctacttgtagaaagcctgtcaagaatgttttaaagtagtttctacacacatgatcttaagttgactgttcaggaactttggaagacattagaatatgaacaaaaagcctgcactgaaaggaacaactctggggagcgtagactttacttttttagtacactctggagagctaatgcatgctatatatacatatatatgtgtatatatgtgtgtgtgtatgtatatatagcctgtgaatatggtgcagtggtaaacctacttaattcaaaccttttagtgacagttatgctagttgtacctcttgtggcatttttcatttcctcgccttaattgcattttacccattttttattactgtaagatacttttgctttttttgtctccttgaccgggagaagataaaatattgtatagatttgagtttttgctgagacttgaagttccatatttagactatcttcttgaaacttggggagaaattttaacttgtctttcctgtactcctaggaagaattttggtagaaagttggcttatggccgggcgcggtggctcacgcctgtaatcccagcactttg

SEQ ID NO: 26292 - DNA, 1058 bp, Homo sapiens
atcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgccactggtgtcagataatttttttacaaaaaattttatacttaacagaaaacctggaaagactagtacattgatacctgtgtgttcaccatcttgatgtaacggataacatgctatttgctttatctgtatttcattgctaggaatggggcattatagcacttaggaacattgacaagtattgcatgttattgaatatccagctcatattgaagttttccttggggagagttctgggtcaagggtcagtcccagtagtggtgtggctcagttgtcagggtctaacctaacaattgcggtgagaaatattgaggaaatatatgtggttacagctctcaagtttctgtaaagatctttgactagataaaagtacctgtttgcaactcctgaatgggagatgggactagggagactgcaggtcctgggtagattctgatcagtatttgtgcctacacccggctctcctctcttcatcagcggaagagcagtttggaactaaacaaggagaatgcacattcaatgacagcagagtaggggcagatctgctagagtccatcaaacatggagcaggttcaaagcagcggtgtatgcctcccttccgttgtgtggcactgtgtattttttttttttttttttgagatggagtttcactcttgttgcccaggctggagtgcaatggcacgatctcggctcactgcaacctccgcctcccaggttcaagcgattctcctgcttcagcctcccgagagctgggattacaggcgtatgccaccacacccagctaatttttttgtatttttagtagagacggggtttcaccatgttagccaggatggtctgtatctcctgaccccatgatccgcctgcctcggcctcccaaagtgctgggattacaggca

SEQ ID NO: 26293 - DNA, 1028 bp, Homo sapiens
aaaagttgagtcttgggcagagaaagaggaaagtagcatgtaaatttggcggcaaagtgaattaaagctgtcagcatggaacatgggaaccactacacggagcctttccttatgctgccttgtaggtttcccgtttccagccaggggctgtgccgttttcagaaaggcagagagtccttcgggtagctggcaagtccaaaaacagggatttttggcaataacagaaatgaatagggacaaagccaaaaggttttgttcttatccatgattaatttggggctggagaatgttttgtgttttgctttttttagtccgctctttgtgacgtggaagacagggcgggacaagcggcttcgtggctgcattgggaccttctcagccatgaatcttcattcaggactcagggaatacacgttaaccaggtaatgacaccagacattaagaactgtagataaattggctagaatcagaaatagctgcctgactttatttcttctaagtgatgtacgttgagctttctctttttggtaatcaggaaatgtaaggggcttaatctggtgagtcagttatcagttcaagtacagacagttaatagcatcgagttgtttttaacatgttagtgttgatgaacaatagatactctctgcatagctcaagattcataaatatgtgggctctatggcacctgatattggctcctgactccagagcagccttacctatgttttctgtccccctccagtgcacttaaggacagccgatttccccccctgacccgagaggagctgcctaaacttttctgctctgtctccctccttactaactttgaggatgccagtgattacctggactgggaggtgagaacagccgcatttggaactctgcatctctcgttgcatttgggttcgggttagtacatggcaatgtatctccttcattgagagaaagggtataagaatgtgaaggctgagtttggaaccaattgtgggcaacataggtgacagaagaggtgctgctataccaggagt

SEQ ID NO: 26294 - DNA, 1029 bp, Homo sapiens
cagccctccaggcagtctggaaatgtcctcagccagcttcacgctggctggtgccccaccctgtcttctgccctggggactcttggggaacagggagctgcttggtgcctgcctccatccatggtagtcatctggaaattttatggaaaataaaaattctcttttaggaaaaggttaggggtttcttctcctggtctgtgacctggaggttgagtgggagaaagaatttgacagctcttagctggtcaatgcagactctctatctttgatgttttttcctctccttttaactaaccagtcaaattaatgcttaacttctcattttggttagggttctgcagcattccagaccttgagcactgaatcaggatgggaaaaagacgttgtgttcctccactcgagcccaagttggcagcaggctgttgtggggtcaagaagcccaaattatctggaagtggaacgcacagtcacgggaatcagtccacaactgtccccggctctagttcaggacctcttcaaaaccaccagcatgtggacagcagcagtggacgggagaatgtgtcagacttaactctgggacctggaaactctcccatcacacgaatgaatcccgcatcgggagcgctgagccctcttccccggcctaatggaactgccaacaccactaagaatctggtggtgactgcagagatgtgctgctactgcttcgacgtactctactgtcacctctatggcttcccacagccacgacttcctagattcaccaatgacccctagtgagtaaatcatgtgctgggggcactgaggaaggcatggtgacatctttctggggtgattctcttgagagggtctgctacttggaagtctttattatcatttgaggaaagggtaatgggaagagaatgataagaaatgtccagagaatatttaaaacattcagtggattcagtaatggaagggagcagttcacatttggaggaggctgtaggcttgttgttaaagtaatgttctggaaatcaagtgagttca

SEQ ID NO: 26295 - DNA, 1047 bp, Homo sapiens
atctttctgtctcataaccctatataactttttttcaaaaaagttgtaaacacacaaggatggggagaacaggagaggacacagtagcaactgaagctgggaagcagaccatcacgcgatggcgtcctggctctgagaaagctaaatgtgaagcttgcgtaggggaaagttgagaaccatcctcttttaaaattggaaaatcttcaaaaggaccaacaacaggcaaatcctgggggcgaaggaaggggctctgtcctttaaggaggataagttaaaacctttgagtttgaaaagtgttaaagttagagcccagaatcccattttctacctatgccatgtggtgtactgccccttcccgactttagcaggagcctgaaagttcaaactctgcagatggtccgctagggtcacccagcactatagaggtcatgagtattttaccagaaagagattgtgactcaccgtgtgtgtgtggagtgctgaacacttcccagtccactccctgctttcagctgatagaactctggcaggtgaacttgattctagatagaaaatgagaagaggactctactttccttctggggagtctatccagcccaaggggaagctctaaagatactgacactagggcttccttaaggacagggttagattaccctacagtggacctcatagtagacatgcccttccaaagctcagagctcccagccagcatttcagtccctctccccgactcttaatcatgaacatacaaccaaagataggcacatatctgaggggacctctaacggtggaagacagaaaccacaataaatacatgcccaaagcaccttggaagatgtagaggcctggcagggagaataaaacacaaaacaaatgagcaaggataagcaaacagtatccgtgatgccttcagaaagacaaaagaaaaggttgcatccacaaaacagtaacacagtgctatgcaaaaagaacattcagaggagaaaagaaccggtcctgaaataagatagcagaaattgaaagatcagtagaagagttggaaga

SEQ ID NO: 26296 - DNA, 1200 bp, Homo sapiens
ttggccattttgagagtaagggttgcagcattatgaccatttatccgtaagtacctccatttgtagcacggaagagtaaagacattctttgatgtcaccgcggtacagctatctgaaaggattccgagctctcccttctctttcactcatggatatttttaaagagtgtggagaggccagttgttttagggaatttggtactgtcacgttgtttcttcatggttacattcaggttataccaggtaagcagtgtgttcttcccattgcatcagagagctcatgctgtctgtttttcccgtattggttatgttaacattcattacttagtgaaggtgatgtttgctggttttttctactggaaaagcatgtttttctcctttgtaaacaagtaatctgtatggaaatatctgagtataaatatcctgttctccagtaaacattcattcaatagttgtagatctattattaattcctggctgaatcaattattaatatgatagttgcaaaatagtgagtttttctaacgtgttgtctatatatattagctggcattctgacgtaaagaaactttctcttatccacccccatttatttattatgttgagcattttactgttttttaatcggctcggccttgtagatttgcttttattcattattagaatccattgctgtcatctattttggtgctcacatgatctcatttggtctttgggggttctttctgtctgcttctgtggatttcgccccatcccctctattctagcctttccttattttccaatgacgagatattctagattcctattgaactttatctgtctggctgtgaaatctgctgtttctccaaggagccccttgtcatttacaaaccaagatctgggcattagccctgcttgttgctatgggttgtcattcttctaggccctttgagcaggcagaggtagaaagtatataatattttaagaacatttgagttcatgctgatatctctagttcaaccccatcgcttcccccattccatgtttgtatctgcctctcccataaagaaccctatacagtatacacaaagtagtttcaaaaacaggttattgttaagtgttctaatttgatcatttgtgtctaggaatgcttacagattttgatacattgatatgtccatcccccttgttgaatactcctgttagctctaaatgttta

SEQ ID NO: 26297 - DNA, 1044 bp, Homo sapiens
ttctgtttgcagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacaggtttttcttccttttaatttgctgattttcaaactgaaatgccaaactgttgatcatgatttattgaatgctagcagtacattagtcacggtaataaaaaaagatcaaacagtcactgatacctgcaagtgaagatagtaggtttgagagagaaggataactgtaaagggagtagaagccagtgtccatagtggtcatttagctagaatttattgagcagctactagatgctcgattcgaccctagtgtgatatataaatctagataaaacagtccgtgtccttgaggagtccggagtccggttcgtgtttggttttagcgtcaagaactgccttccgggggtaggcagtgctgctctgtggtttctctgaggagagcagatgtgcatctcttgggataggttacctcaagcagctctctagttccaaacttttttttttttttttttgagacagaatctcacggtgtcacccaagctggagtgtagtggtgcagtcttggctcacagcaacgtccacgtcccgtgttcgagccattctcttgcctcagcctcccgagtagctaggattacaagcgggcaccaccacccccagctaatttttttattttaatagagacggggtttcaccatgttggccaggctggtctccaactcctgacctcaaatgatctgcccgcctcggcctcccaaagtgctgggattacaggcatgagccaccgcacccagccttagttgcgaacatttattctgaagtcttctgttttaaggtttttttgtgaaattttgcaatcctactctgctgtgtacctgattaattaaatattttacattttttacctggggaaaaaaactaaatctaaaaactttccctt

SEQ ID NO: 26298 - DNA, 1034 bp, Homo sapiens
ctactcaggaggctgaggcaggaaaatcacttcaacgtgggaggcggaggttgcagtgagccaagatcgtgccattgcactccagcctgggcgacagagggagactctgtctcagaaaacaaaacaaaaaaaatagaactaaatgcaaatgaaaatacaacatatcaaaattggtgggatacttctaaagcactgctgagaagaaatttttattttgtttttttagacggagtctcactctgtcgcccaggctggagtgcagtggcgtgatctcggctcactgcgacctccacctgctgggttcaagtgattctcctgcctcagcctcctgagtagctgggactacaggcgcccatcaccacgcccagctaattttttgtatttttagtagagatggggtttcaccatgttgcccattctggtttcgatctcctgagctcaggcaatctgcctgcctcggcctcccaaagtgctgggattacaggcgtgaaccactgcacccggctgagaagaaaacttatagcattcaatgcttacattagaaagcatgataggatttatatcaataatctaagctctgacctcaagaaaccaggaggagaagagtaaaataatctcaaagcaagaagaaagaaggaaataaaaataagagcagaggctgggcatggtggctcatgcctgtaatcccagcactttggaaggccaaggcagagccaagatcacacccattgcactccagcctcagtgacagagaaagactctgtctcaaaaaaaaaaaaaaaaaaaaaaaaaagcagaattcaatgaaattgaaaaaggggccaggcacaatagttcatgctcgtaatcccagcactttggcaggccaaggcaggtggatcacttgagcccaagagtccaagaccagcctaggcaacatggcaaaaccccatctctacaaaaaatacaaaaattagctggacatgatggcatgtgcctgtagtcccaactactcaggaggctgaggagggaggatcacttgaaccgaggaggtc

SEQ ID NO: 26299 - DNA, 1038 bp, Homo sapiens
agcccccctcatgctgcgtcacagccctcacctcctctccccgtctccttgcaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggag

SEQ ID NO: 26300 - DNA, 1060 bp, Homo sapiens
caggaagcaggaggctccagggcctgcccacccaggctgacacccctgtaccttgtgggccacagtcaggaaatcccagagcctgggtgtgggagggtggtccgaagacctcttttgtctccccctccacacacacacacacacacacacacacacacacacacacacacacgcctcccttctttgcggtggagcctctttactgcccagtagcccaccttcttctcccagctctccaggccccagagcacttgtcctcagaggggccgcagctcccaggtgggagtgtgacagcgtctccatcctacctgggccaccaacctattgaaactggtgtcatcttaaggacagccagcgcctcttgactctgacaggctgccccagggtgaacaagtttctaaaggtggcaagtcccacctacccagtagacaggctgagaacaaaggaagacccaagcactagcaaggagagccctcccctccctcggggactgcggcacttcatgggcagggcccggggccctccatcacagcccaccccgccctgtgccccctctgatgcagtagagtcagtgaattgtcactagcctggtgcaggccatccagagcacagtgccagggccgggcacagggcgtgtatgacagaagagccatgtggggtctcaggaggaggctgtcaagtccaggctcagaagctgtgatgtgaaggacagtgcttcatggagtttggggcaggtttccagcagagggtctgggccagcagggcaggtgcagagaggagagggcagggccctgccctcaaggaggtacagagccaagcctactggcttcgggacccacatggtgcccctgtgtccctgcagcgtggtctcagcatggacccccaacctgtggtgaaaccattgccctgggatgttcagcaggactgggtcagcttctgcctggctcagcatggccattccacacttagaggctgaccacaggactaactggatcctatgtggccacagaccctgctcacatagcactggccttctgagctggtggttaatccaaccttc

SEQ ID NO: 26301 - DNA, 1033 bp, Homo sapiens
acctgagtcttctggcccaggctggagctgggctaagctgctctgctgtggcggttgggatgcacttcccccatctgcccagggacccagcaactctctatcaggggcagtgcccatccctgctggggtgcctcatgttaagtgggcttggtgtcaggagactcaggtgtcaccctggccctcctgcgatgtcttcactctggctctgcactgccatctccgtgttctctggggactgagaccctcttttccttctatctctgcctgcctccctgcccaaggctggctcctggaacctctccaccaagcccctcccattccctgctgcggtttgggagggtctcagtgggcctgtggtgcgcgtaagagaggtggggctcttcccggctgccagcctccccattgcacagtatcagcctgggctgctctgagctgggcatccatggagatggacaggtttttgatgtcttcctggaatatggtttggaacttctagtggctgttagtgcttggctgccttggtagaaaggaacaagagtgagcagagcattggcgggtccctgtttagtcctgtgttcaccatgggggctgcctcatctgccgacatcagccagggtgcttgtaagactccactggaaggacgtttgctggctggccttaaagaggtgtggccatccccaggcagcagccaaatggccagccattccagggaccactcggttagaatgtctcagcaccccacactccgctgtcactcagagggtccagatggtgctccagagccagaacctccctccttcctcttcccgtctgcctgaaggcaacgcaagaacaggcatggtcaaggtcttgcccgggccaccctggaaatgtccctgaaatcatgtgggcttcatttggggccacggagggcatctggagcccaagtgtggcatctgggccaccttggccgggaacccgggaccagctcacatcctctctgcaccagggcctctctggagcccttagtgggctcgcagcctctgtgacgttg

SEQ ID NO: 26302 - DNA, 1027 bp, Homo sapiens
caagatgcccaatagtcttttgaggatgtgtaaaaagagtttgtgaagtcctcctcacttatttgtagtttgcatcttggttagtgctaaataaatggtgctcctgaagtccctgaagctgatcttcactcatgcaccgtttaagcattcattcatagcattaatttgtcaaatgcttttgaaggatcaacacttttttttcagaaagagcaggtaatgatatgactctttttataaaaaatgcacttttcaacacctttgcccactcttggtaggtttactcatccacctgtacttgaccataagttactcaagtcttactgtcgcagcttccaggcctgcataagccacgttaaaaactgaactgttttgcttgaagtaagggtgaagcttggagcccccatgcttgcttcttgctcctttcctgcatgcttctgtggaaccaccttagtacagtttatttgaagatgtaatagaactagactgcaatattatactccaccagaagatgtcactgtaacatgtggtttatacatgctgaatatatggtaacggaataatggcgaaccttccattttctcagtgaatcaaaaagagaaagaaaaacgtagttttggccaacttatatataaaaactttgaaggtgagaaagagatagtcaatatctactcataatgtttaattaactcatttagttacatatacatatttgaaataatatatagaatcattaatttgtaaatatcactttattttcattcatatttcatggaacaactttatgaaagttccttacatgcttatctttcataagtgtctttattgtcactagagacacttaaaaaccttttatttgaaaatactttcaaacttacaggaaagttgcaagaataagaatagaacatggaatattcatatactcttttcccacattcaccttttattaacattttgttcatttgctttatcttgttttctctttccctgtctctgtgctatatatctatatctatatctatatctatct

SEQ ID NO: 26303 - DNA, 1057 bp, Homo sapiens
gccctggagcagtcacagggctgcaaaggctgccgggaagtgtgttccatactgtgtgcccagagcaagggaaggggtttggtgggagtttgccagttccaccacagcgctgctgtgacaattgaaatcaaatgcatgaagggactggttttcacacaggtcaggtgtcatgactgctacaagctgggttttcctccagcttgtactcctgtccagacagagcgtctatttttttttctatctactgaatcagagaacctacctttctcaggtcagagtccaaattcccaacttgtatcaaatgagattttcttcccagtaataaatagtgggatgtctacagacatttgcaaggtgttcgtcgcacctcgtgatttctcccttggcagggacctgtggccactgtgtctggctcaggacactgacaaaacaccaggctcaggattttttcccccacaatacaactagatcctgaccaagggtttttgatgaaaatcagattttgaagactgctgtggtttataagagcttcctcaagaagaagactttgtagacctcaccatttacagatatgagagagaagtttccttctgagtgatctcattctgctctgatgtccctgggaacacacattggagccaatatctcccatcttttcaaattaaattagctccctgtagggagccagataaaagaatgatggaaagaaatggaacaatatagattagcccatttttgatgcttgggttaaattttattaaaatgactgttctgcatggcctaaaccatctattttgagaatgatttgtcattatttctaaaaatgtacttataactctgccctaaattgtaactaaatctgaaaaacatacttaaattctgccgaagtgataacttaatccacatttaaaggacttccttggatgaaggacactgaaagtttaaactttgcaacctgtctttttactacccttttctgttcatcttacatcagcttaatggcataaactagtcataatacggcaggtatttgaagacacaaaaaccatagtcctgt

SEQ ID NO: 26304 - DNA, 1097 bp, Homo sapiens
gtggcccagagactctggcagcgcagcttcagcctgtcctgacaccacccctgcccccgcacctccgcatcgtcctccttgccccgagacaatcccgttccctggatcccattcgtggcccactcccttccatgatctaccgctaggatataccagcgcccccgtgatccaaggtaagtcagattctgatcatcttgtgcaagcaactcacaagcagaggccctgtgcagtcgggagaaatctatacctttccccttggacatccaagagcaagttagatcccctaaaggccagctctcaccaataaccctgacatttccaatataaatgagagagaactctctgttttgagacaaggtcttgctatattgcccaggctggagtgcactgcaccatgacagctcactgcagcctcttaactcctgggcttaagcaatccttccgcctcagcatcccaagtagccaggactacaggcatgcgccaccgcaccctgctaatttttaaatttctttgtagagacggggtctcactgtgttgccaggctggtcttgaactcctaggctcaagtgatccgaccgcctccgcatcctgaagtgctagggttacaggtgtgagccaccacactggagagcggactcttatgtagccttcactgtaaaaattaagctagcttcccttgactcccaaaaccagaattcctagcataattttctcaagtcacaaggtgcgaaaatatatcaaattatttcccagtcaagaattcctacttttggccaggcgcagtggctcatgcctgtaatcccagcactttaggaggctgaggcaggaagatcacttgacgtcaggagtttgagaccagcctggccaacatgctgaaatcccatctctactgaaaatacaaaaattagctagtgtggtggcgcatgcctctaatctcagttacttgggaggctgaggcaagaagatcgcttgaacctgggatgtagaggttgcagtaagccgagatcgtaccactgtactccagcctgggtgacaagagactccttctcaaaaaataaataaataaaaaaagtgataaattggcagctggcgccag

SEQ ID NO: 26305 - DNA, 1078 bp, Homo sapiens
aggtgacctggaggcccctctgcccgggccttcaaagcgaggagagtgtggccacagccctggcctggttgtggaggggggtgctgcgctggcccgcggctgctgggactgcaattgtttggattgtcactgaccgtgctttgtttttgtttttttctcctcactcctgggctcgttctcattgctttctttctctctccgcttccccctcccgtgtctggtcctatctctccccttccccaccccattctcttgtcctctgctcttcggcctcttccggcatctctctgtttcttatctcagctggaggttctgcactaccgactcagtgtctccagcgccctctacagccccgcccaacccagcctccaggccctccacgcctaccaagtactggctcattcgttcccttcctcctgcccagagtgcatgtccatgcctggcaaagcaaggggccgccggggccggccgctggtgactcagaggctagttccaagcagaacgaagcccctgtgtcggggggaggcaggggtcagcctccagcctggcttggcccctggctttgtagactagtttggttgggggtgggggtggtggctttgtggcagaacgaggcatgtgggcatgtggccctggctgtccaggctccaggccagtggaggtgtcacaagctctccagtgttggaggcctcgtgcttggccctggtttgaagagctggagtcctcaggcctcagcagtggctgggttcactgcactctgcagggtctggcgcttaggaaggagctgaagacgcagaggcctgggacttacgggtggtgtgggttctgccttgttcagaactgtcacccagcctggaggtgctgtgacccagagcttgcgtgtgaggcagggggtgggaaggacctggggcttgaccctatagcccacagaagctgtcagtccttgacagcccagccaggacccggccttcacctggggagccctggccgctcatacacacctccagaggcagattagagtgggtggtgacctcatagaggttgcagctgcctaggcagaaatgacaagtgtgtggat

SEQ ID NO: 26306 - DNA, 1034 bp, Homo sapiens
aaacctcgtctctagtaaaaaatacaaaaattagccgggcgtggtagcgggcgcctgtaatcccagccacttgggaggctgagtaagagaattgcttgcacccgcgaggcggaggttgcagtgagctgagatcgcgccactgcactccagcctgtgcgacagagcccagagcgagactccgtctgaaaaaagaaaaagagaaagctggccgggcgcagtggctcacgcttgtaatcctagcactttgggaggctgaggcgggcggatcacgaggtcaggagatcgagaccatcctggctaacacgtgaaaccctgtctactaaaaatacaaaaaacaattagccgggcgtggtggcgggcgcctgtaatcccagctactagggaggctgaggcaggagaatggcgtgaacccgggaggcggagcttgcagtgagcccagatcgcgccactgcactccactctgggcgacagagcgagaccatctcaaaaaaaaaaaaaggagaaaaaagaaaaagcggccgggcatggtgactcacgtctgtaatctctgcactttgggaggccgaggagggctgatcacgaggtcaggagtttgagaccagtctggccaacatagtgaaaccccatctctactaaaaatacaaaaattaactggatgtggtggcatgtgcctgtaattccagctactcgggaggctgaggcaggagaattgcttgaaccagggagtcggaagttgcagtgagccgagatcatgccattggactccagcttggcaacggagcgagactccatctcaaaaaagaattgaaaaagtcggcactttgggaggctgaggcagcggatcacttgaggccaggaatttgagaccagcctggccagcatagggaaacccgcctctactaaaaatagaaaaattaggcagcctgtggtggcaggcccctgtaatcccagctactcgggaggctgaggcacgagaaccgtttgaactttggaggtggaggttgcagtgagatgatggagtgagactcagtcaa

SEQ ID NO: 26307 - DNA, 1050 bp, Homo sapiens
gtggaggcctctctgaatctgatggactcgctttgttggtgaactgagccatttggcaatgcaggatgtgccccctctcctcccaccccctatgaccatgtaagacttgagtagaaggaggacactttgtgtaccggggttgctctggccttcttcctttcccttgaggggagcttgtctttgcaggtcagttgtcttcatcgggatgttttcatgcatctaggagagctggtcttgcgttgatagaagaaacagctgcctgtagaaatcctttggcattcatctaccgtactttactttgcaaggcctcctctaaggaaaataaaccatggaaagatgaggcccctggctgggatgggcacatctccgcggaagccctgggggtttgatctgatgtctagggattgggtgaccacccaatctgtatgaccacccatgtggattcacctcctggtctctgggtcaatatgaccacctttaggtcatgcccacacaaaagcgtactgttccctccttgtttttctggacttgacttcagtgtaaggaaattatgccagagagaaaagcattccgggttattatgtgtgcttcaatgtagactctgatttggttttccccatacttatctgtcaaggaacaggaaactgggcatagacagaaactgctggtttgaggcacagggagggagggcagcaggcaccaggttgggtgccactgtgttggaggtggtgctggtccataaagggactcaagtagttgttgagtttctgcagttgtaggaaaaatagatttctcttaaagaactcagaagctcatgtagtttagaatcctcatttcttttttttttttttaattttaaaatttttaatatttttttttaagacagggtctcatcctgtcagccaagatggagtgcagtggtgtgatctcagcttactgcaacctctgcctcctaggttcaagtgattttcccacctcatccttcccagtagctgggactacaggcgcctgccaccatgcctgcctaatatttttttgtaccttttggta

SEQ ID NO: 26308 - DNA, 1117 bp, Homo sapiens
gggttgcatcagtacagatgggcttcctggggagggagaatctgaaaagctgttgttttggaaagacctagcactgaatgaatttgatatttcagggaggcagtgtatatttttgggtacgatgaggtaattgtgtgtatttatttaaagtttgtgaagttcctgttgagttactatggagggatatggtggacttagtgctgaatgaaaaaaaaaaggtggcaagcacacactgtctatttttaattaaaaaaatttttttacttagtgttttaaatttttaaaattattattattagtttttagagacagggtcttgctcagtcgcccaggctggagtgtggttgcacaatcatagctcactgtaacccagaattgctgtgctcaatgagcgatcctcctgccttggcctcctaaatcgctgagactacaggtacaccccaccatgccttgctaatttttattttgtagagacaaggtctcgctatgctgctcaggccagtctcagaactcttggaatcaagttatcctcccatcttggccttctaaagtgttgggattacaggtgtgcaccatagctcttggccccacactaagtcttaaattgatagggagacctgtttgccttacttgaaatgcacttgtcttaagtgctggctagaaaatggtgtaatattcatgcctaaaccaaagaccaaaagttttctggtgagcattagaacgtagcctcacagtcataagaataaacagtaagataatatatattaaaaaccattgttgtgattagaaatcgttggtgacttttttcaacattttattgtaaaaaatttcagatgtcacagaaaagttgcagaaatttcacagtgatcacctatatatggactgctaagattctacgattaaattttttaaatttaaaaaatttcagatgtcacagaaaagttgcagaaacttcacagtgatcacctatatatggactgctaagattctacgattaaactttttaacgtcaacttttacaagtaacattttacttgtatcacatacacattactccatccatccttcagtccatcttattttttgatgggtttcatttcagagtaagttgtggtcc

SEQ ID NO: 26309 - DNA, 1054 bp, Homo sapiens
tgaatttagaagtttaaaacagtttcttacaacaaaaaataatagcttttaagtcaaaatatgtaatgtaggaaatgtcggaattcagtgaaaatgagtgacctttacataggcttagctgttcactggtagcagcaaaaataggcccttgagtccaagctagacttgaattctgattcttccagactttgtgcagtgaagtcagatgagggtaacaggacctagcgtgtgatacccttagcactcttactactcttgctaagtaattatgtgattagagtttggaatgaaacttccagaaatgttataattgaggcttggcgcggtggcttatgcctgtaatcccagcacttcgggaggctgaggtgggtggatcatgaggtcaggagttcgagaccagcctggtcaccatggtgaaaccttgtctctactaaaaatacaaaaattagctgggcgtggtggtagatgcctgtaatcccagctactcggaaggctgaggcaggagaatcgcttgaaacggaggttgcagtgagccgaggtcgcgccactgcactctagcctgggcaacaagagtgaaactctgtccccctccaaaaaataaataaaaataaaatatataattgttacctatcaaaattctgagggaaagccaggcgtggtggctcacacctataatcccagcactttgggaggccgaggcgggtggatcaactgaaatcaggagttcaagaccagcctggctaacgtgatgaaaccccgtctctactaaaaatagaaaaattagccaggtgtggtgacacacacctgtaatcccagctcttcggaaggctgaggcaggagaatcgcttgaacctgggaggcagaggttgcagtgagccaagatcatgccattgcactccagcctgggcgatgaaagtgaaactctgtctcaaaagacgacaacgataaaaaaaacaaagttctgcgggaagaagacaactagagacatgctgttggccacacatagtgctcttggggctgcttaagtctgtggagttctggggaagaaggtaag

SEQ ID NO: 26310 - DNA, 1035 bp, Homo sapiens
gcagtctctggatcacctgtgcgtcagtttttattgtccatttgttctgttcttttgtttttccgtcacatggtcctgtcttggcatgcctggtgtttttcattaactgtctcacgcagtgtattagaaattatgggtggtttcactgatgatgtcttcttttgctgggaaggtagcatgctgaatggtcttcttaatccacttggagctgggcttagatgcatttcagttttggcaaggcttggtctccctttgttctgcccttattctggagcgcagggtttccataagcctgacatgctctgcacagtccatccctcttgtggatccgtaccctgatctttgtctcttacaccaggggagtaaggaaaactctgcgtttcagagatttttggtttttgctgtctgctggggtagctttagaatttgacatatgtcttaaagcagactttaactggttttgaagctcatctgaggtccaattttatcactacagcccttcaagatcaccaaaacccatgtttctctgtcctccagccacggccttctgtccagggagaacctagacttggcctcttgcccatgctgagaattgacaagcaccgcccaggtcaacaaggctgtagatcctaatttctcctttgttccacaaatggtagtggacactgggatggagttaggaacataaacattttgggggggctatcacataggaaaatccagcagggaggaagtagaattagggagagcctcagactgtgaggcacatttgccgaactcatggccagcccacgggtgctctggggcaagggttagcagttggaggccgacatgaggcaccagcggcctggtcctgctcctgagactgttgacccacatacttctcctggctgaacagtaggttctttctggaaaagagatgcaggcggcgttgctcacttcgctttgtaaggaatcactccataacagttcacagaagtttgccttgttcttttttttttttttttttttaaatgtaatagcgttacatacact

SEQ ID NO: 26311 - DNA, 1035 bp, Homo sapiens
tcctaaactgtagggtaagacacacaattgattctcctgcctacctgctatgcctttgtatacttgtttcctccctactctgaactgtaggcctgcactgtccagtatagtaaccactagccacatgtgactacttatgttgaagttaaataaagctaaaagatcaatctcacagtagcctcatttagccttacttttcagatgctcagcactcttggcaggcggctgctgtaggggacagcacagatggagaaggatgtggtcattgtacaaagttttgttggtcagtgctggtcaagacctatcacgtagctgtagttgtgaatggcatgacaaatctggcatttggatttggtttagaagtttaaaaaaattagacagttcaggtaatgaatgttttagttactaaagttgccagtttattcctgatttaatccagaacttcctgttacagaggctaaggatgtgacctaatattttcttcttactacaggattgcttggttgtgaatattctaaatgagacaaatgagctgaaaatttgaagtggtttctttttgtattttgtcttcgtaatggattttgacacctagagtgttctgaaaggcatttgttttttagaaagtcggtaggtagttgcagctattttgtaccagatgttgttattgatgctggagatattgcctttaaacagaaccaagtgcaactgttccctgcttgttttggctacattctaaatggggatgtggggaagacagacataaaatgcacattttgtgttttgttacttattacatgtttttcagagatggaaccttattatattgcccaggctggtcttgaactcctggcctcaagcgatcctcccacagtgctgggaatacaggcatgagccattgtactcagcctaaaaatagacttttttttaggtctagcagttttaggttcacagcaaaattgagcagaaggtacagagagttcccatatacccccctacccccacacatgctgttttaatcttaaagatcaccttaat

SEQ ID NO: 26312 - DNA, 1030 bp, Homo sapiens
ctctggaatgtcccacttttggggtttgtctgattgtttcatggtgtcattcagcatattccctcctactcctgcgtttcttgtaaactggaagttagatgtaaaggctccatttgatttttttttccccccagacagagtcttgctctgttgccccatctggagtgcagtggtgcgatttcagctcactgcagcctctacctcccaggttgaagcggttctcatgccttagcctcccgagtagctgggattacaggtgtgtgccaccacgcccagctaatttttgtatttttagcagagactgggtttcaccatgttgcccaggctggtctcgaacgcgtggtctcaagtgatccgccctcatcggcctcccaaagtgctgggattacagggatgagccactgcaaccagccaagtagagttttattattattggtctaggctataagtcaggtcattatggaaggagagcctcctaacatccttcagtacttcatttgaatttgcagtttttggctgttaggaataatgctgttacaaatgttcatgtccaactgtaggtgtagcatgtgttttcacttctcttgggtatgtacctaggagtggaattgtggggtcatgtggtaactctgtttacctcagagttgctcaggagcttctttgcctaccagaggacatctccactcaggcctgtatttaagggtctccacttggtggttgtacctaagctgtgtctccacaatcatctattactgattccctacatagagcctaagctccaaacaaactcagttgcttaatgttcttaaaatgcatcttgcttgttctcatttctgaggctgatttgatcctatccattgtttattggaaatgctgccctttaattattattattactattttttgagacggagtcttgctctgttgcccaggctggagtgcagtggcacgatctcagctcactgcaacctctgcctcccagattcaagtgattctcctgcgtcagcctcctgtgtagctgggattacag

SEQ ID NO: 26313 - DNA, 1074 bp, Homo sapiens
ctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggtcagagctgggcccgctgtccctgccccagtggcgggggtggcgggcggggagggggcaggcgcggcacagcggcggcgtggccctgagtggccaggcctgtctgtcggtcggtctaggcccagcacctgcagggcccatccgtgggctctgctcctgggcttcgctgccagccttaggaggcacgtccaggtcaggtggacgcagagtgcgtgccccagggtggtccaggctgggtagggctcctccgcttagctcctccccacctcttcactcaggccttcatcctacaaagtcgggaatcaagacggtttggggctgggcgccgtggctcacgcctataatctttgggaccccacggcgggaggatcctttgaggccatgagtttgagaccagtctgggtgacagggtgagatcctgtctctaaatgtttttcaaaagacagtctcgatctctgtcctgtggtatacagcatccagggaagtgcccagggagcagggcaggcagacgtcttcctgcctttaccccacctgggcccagttcctgcctctgatgattgcaggaagagagttagacgcggaactcccagggtgcagaggcctgcggggtctgaagggcctcctccctctccagtgtggtgactgggctgaggagatgctgggactgagagtgtcatggtggagcctccgtccctgctcatcctctccgcatgttgcttctgctcccgatggctctctctgaaatgcagcacaacctcccaggccaatggaaggaggcccagagctggctccctgcctggaagcaggaggagaccctcacaggcatcatgagaaggcgtggaaagcaggctgccttcatgggggaagtgccagggcctgggcacccacgcccgctgacccaagagggcccgggcacctgcgtgctggcctcttcactg

SEQ ID NO: 26314 - DNA, 2140 bp, Homo sapiens
gcggtccgcctctccttcgctgcccaaacgtcggggccgccccgcgccctccgcgcatgagtggccgccggtccctcgcggctgccgcacacgggtcgggcggtcggcctcctcgcacatgggcacgaagggtcgggagtggtgagcccgtcggggggttttgtgtcctgtgggtggatgggatgtccggttcgccgccccaccacccccctcccaccaccccaagctgctccctccctcccccacgccccatcgcccgccctgccgcgcccaatctcgcaactgggacgccgggctcatcctcgcgagtcccagaggccgctttctacctacctggttgatcctatcagaaccatatgcttgtctcaaagattaagccatacatgtctaagtacgcagggctggtacagtaaaactgcgaatggctcattaaatcagttatggttcttttggtcgctggctcctctcctacttggaaaactgtggtaattctagagctattacatgctgaagggcactgacccccttcacagggaagatgcgtgcatttatcagatcaaaaccaacccagtcagcccctctccgtccccggccggggggtcgggtgccgccagctttggtgcttctggataacctcgggccaatcgcacgccccccgtggcagcgatgacccattcgaatgtctgccctatcaactttctatggtagtcgctgtgcctatcatggtgaccacgggtgacagggaatcagggttcaattctggagaaggagcctgagaaatggctaccacattcaaggaaggcagcagacactcaaattacccactcctgacacggggaggtagtgacgaaaaataacaatacaggactctttctaggccctgtaattggaatgagtgcactttaaatcttttaatgaggatcaattggagggcaagtctggtgccagcagccgtggtaattccagctccaatagcgtatattaaagttgttgcagttaaaaagctcgtagttgaatcttgggagcgggtgggctagcgagccacagcccgtccctgcttcttgcctctcggtgccccctggatgctcttagctgagtgtcctgtggcccgaagcacttactttgaaaaaattagagtgttcaaagcaggcccaagccgcctggatactgcagcttggaataatggaataggaccacagttctattttgttggttttcggaactgaggccatgattaagagggacggccgggggcattcatattgcaccgctagaggtgaaattcttggactggcagtttagaccagagcgaaagcatttgccaagaatgttttcattaatcaagaacgaaagtcggaggttcgaagacgatcagataccgttgtaattccgaccataaacgatgccaactggcgatgtggcggtgttattcccatgacccgctgggcagcttccaagaaaccagtctttgggtttttgggttccgaggggagtatggttgcaaagctgaaacttaaaggaattgacagaagggcaccaccaggagtggagcctgcagcttaatttgactcaacatgggaaaactcacccagcctggacacggacaggattgacagattgatagctctttctcgattccacgggtggtggtgcatggccttagttgctggagtgatttgtctggctaattccaataacgaacgagactctggcatgccaactagttatgtgaccctggagcggtcggcatcccccaacttcttagagggacaagtggcgttcagccacctgagattgagcaataacaggtctgtgatgcccttaaatgtccagggctgcacgcgcgctacactgactggctcagcgtgtgcctaccctatgtggcagatgtgggtaacctgttgaacctcattggcgatggtgatcagggattgcaatttttccccatgaatgaggaattcccagtaagtgctggtcataagcttgcatgaagtccctgccctttgtacacactgcagtcgctactcctgattggatggtttagtgaggccctcggatcagcccgctgggtcagcccactgccctggcggaacgctgagaagacagtcgaacttgactatctagaggaagtaaaagtcgt

SEQ ID NO: 26315 - DNA, 1035 bp, Homo sapiens
ttttggactgagtctctctcgctctgtcacccaggctgcagtgcagtggcgctctctcgactcactgaaaccactgcttcctgggttccagtgattcttcttcagtagctgggattacgggcgcacaccaccacagccggctaatatttctatttttagtagagacggggtttctccatgttggccacactggtatcatacccttgacctcaagtgacccgccctcctgggcctcccaaagtgctgggacgacaggcctgaaccaccgggatttcagcctttaaaagcacgggccctgccacctttccctgtggcccttacactcagaatgacgtgtcctccctgccataggttgactccttgagtcccctatgccattgcactctagcctgggcagcaagagcgaaactccgtccccccaccttcccgcgcaaaaaataaataaataaataaataaaatctctaggtgtgttcccaagagtgatgtctaagaaatggcactgtacactgaacgcagtggctcacgtctgtcatcccgaggtcaggagttggagaccagcctcgccaacattgtgaaaccctgtctctactgaaaatacgaaactgagtcaggcacggtggggcaggcacctgaaatcccagctacatgggaggctgtggcagaagaatcgcttgaacttggcaggcggaggttgcagtgacccaaggttgcgccactgcactacagcctgggcgacagagcgagactcagtctccaaataaataaataaataaataaatgaaagaaagaaaaaaagaaaagaaaagaaagagaaaataaaagaaaaggcactgtatcgctactgggctaggaccttctctctttctatctgtttctctctgtctctctctgttcgtctctgtctttctctctgtgtctctttctctgtctgtctgtctctttctttctctctgtctctgtctctctgtctctctgtctctctctctctctgcctctctcactgtgtctgtcttctgccttactcactttctctg

SEQ ID NO: 26316 - DNA, 1001 bp, Homo sapiens
tgagaggtgtagaataagtgggaggtccccagtgcccccctatccccgtgagggggtggggtggggtcctgtgggctgcccatggaatactactactctgatcgttttttcactgacctggtgaggcagggggtgagcccctaggggccctcccttctggcgccaagtgcccagctgcacgccggccgggtgttgacccgtcccgaggacagtgccaggtggggagtttgggatagtacacctgtcaaacggtaatgcaggtgtcctaaggagagctcagggaggacagaaacctcttgtggagcagaagggcaaaagctcgcttgatcgtgattttcagtgcgaatacagactgaaagctgggctttgacgatcattctgacgtttttaagcaggaggtatcagaagttaccacaggggataactggttcgttgcggccaagcattcatagggatgttttttgatcctgtaatgttggttcttcctatcattgtgaagtagaattcaccaagcattggattgttcacccactaatagggcatgtgagctggatttagatcgtagtgagacaggttagttttaccctccgtgatgtgtgttgttgcaatggtaatcctgctcagcatgagaggaatggcaagttcagacatgtgcttggttgaggagccaatggggtgaagctacggtctgttggattgtgactgaacgcctctaagtcagaatcctgcccaggcggaaggatacagcagcaccgtggagccttggttggccttggctggccttggctggccttggctagccggttccccacccccgctggtgggctgcctcacccttggtggggtgtgccccaccatgtgctaggactgggtccggtgcagagtgcccttcctcctgggaagggtgtggctggaaaggtggcctccttgcccgtcatgcaacacacgttcgtggggaacctggtgctaaaccatttgtagacgacctgcttctgggtcag

SEQ ID NO: 26317 - DNA, 1045 bp, Homo sapiens
acctggctcaggccaggcatggtggctcatgcctgtaatcccagcacttcgggacggtaaggcaagagaataacttgaggccaggagttggagaccagcatgggcaacatagtgagaacctgtctttacaaattttttttttaaataagacaggtgtagtggatgtggtggcacatacctgtggttccagctactcgggagaggaaggtgggaggcttgcttgagccctggaatttgaggctacagtgagccatggttgcaccactgcagtacagcctgggtgacacagcaagacgccgtctcaaaacaaaaacaacaacaacaaaaaacataatacaattcactggtatactggaaaaaacgtagggtcaaggatgactccaagctttggctcttagaaaggctggatttgcccttgccttctgccaagtgaaatgggagttctgcgtggacatgctagatttgggggcccattaagcctgcaagtggaagtggtgggtaggtgggaggctaggagagtctggggctcatgtaaatttgagtgtcatcagcacatcaaccgcatttgaagctgtgtgtccaaatgtgatgaggaagggagggagtgtagcccaagagaagactaggtcctcctgccttatctcagtcacagagaagaggaagaccctgtgaaggaagaggagggctggggagcatggcgtcttagaagccaagtgaggaaggtatgtcaaggaggagactcatgattctgtctgttgcttgttactaaaaagtggcaagcaatcttcagttctgtcctaccccttcctctgccagtggggttccagtgtagacaggagaagtaggaatggagggggaggatggtctaagtgtcctgaaaaaggagacaagatttaaaacaaattcactgactccacatgagagagtacctgggtatgagggcacttaccttagggcccatgtttcagcatcatatgcctgtctacatgagttgcgcaaggcaatcaagaatccgcattaggttgtggctttggatgacctcatg

SEQ ID NO: 26318 - DNA, 1045 bp, Homo sapiens
tttcatgggtagtggggaaactctctttaattgttctctgctaattacacccttgctactcaatgtggtccatgggccagcatcatcagcatcacctgggagcttgtcagaactgcagactctcagagcccaccccatacctactgaatcagcatgcacatgaacaaaagctcagctgatccatatgtacattaaagcttgaaaagtactgccctgagagatgtttaagggctccaagcaaagcttcccaatccacactattcaaaataaccttaatacgtattttaggaaaatcggggttccctatgtttgaggaagcctgcaaattcaaatcctctcttcggaaactacgctaatgcccattggcacactgaagcctctgagaagtcctccaaaaaagaaacttgattgttgttggatgaataacattatttgaagaataactttagtgtttcctgaatggtttgcctgctgaacccttcctaacctgtagtctttcaacattttgtagaaaagtagtctaagaacagtttgcctcggggtcttgaaaaggggcttctatagatgtgtatacataattaagcagatgttttgggcagcacagactacagtgggacagagtggcaggaagcccagctttcactgtatttggaccttttttattatttctgaatgtctcccccacctccttccctaaacttgtaaaatgttgatgaaaggtgatatgtgattccacatacgtgtcctcatttaggaaaagtcagttcccaaaagcagaatgaagcagagccaaggcctcagacatgctcatcattcggatatgctgaagacccaatggcaagccagccgcttccagactgggggagtgaagttgctgccaccgggacccaggtgaggggtcgggggaggtgaagggtgcaatccacctgttggtcctgattctaaaaagtgtaccctaaaaacacttttatgatagatttcactttaaatgaaatttgctgttggtttactgaatataaaccaaggtctagggttcaccctttcc

SEQ ID NO: 26319 - DNA, 1050 bp, Homo sapiens
ctttggcccccttcagttctcttaatatgtggtaccatgctgcacccacagcaaaccacagcaaaggtagaaatgatcactgagaaagggctctactaatatgtctctccagaagccagaagctcacatcagtgatccctggtaacaaagtccatccacttttggctattgcctaatgtagttactacttaggtaccaggcatcagggaattataggatatcaggaagtgtaaaacagggtcccgtagggagaccatgaactaactgatggcttagttgaagagccaagacacatgtgtatgtgtgtgtgtgtgtgtgtgtgtgtgtgtgtgtgtatttgttgttgttgagatgaagtctcactctgttgcccaggctggagtacagtggcatgatctcggctcactgcaacctccacctccctgattcaagcaattcccctgcctcagcctcccaggtagctgggattacaggtgcacaccaccatgcctggctaaattttttgtattttttagtagagacggggtttcaccatgttggcctgactggtctcaaactcctgacctcagtcaatccacccaccttggcctcccaaagtgctgggattacaggtgtgagccactgtgcctggcctctgtctctgtctctctctctttctctctctcttcccgccaccctctctctctctctctctctctctctctctctctctctctctctatatatatatatatatatatatatatatatatatatatatgtataaacatttttaataatagtagcaacacccaggtaaaagtccctaagcaccagcgtttgtcaggggctgttcagtcttcacaatgatcccacatagtaactactttcatgatctccatttacaaagaaagaaactgagtcacagaggggttcagtaattttcccaagctcacagagctagcaagtgaaagccagagtttaaacctcataaatggccttggagttcaagtgctcaaccacagaacagttatttactgcagtagataatcctatgtgataatcacatgc

SEQ ID NO: 26320 - DNA, 1031 bp, Homo sapiens
ctcaaccctgttcatttctacctgtttcatttgcatatgatcagtttgttattttatttatttattttttttgccattgttgaacccaaggttttctctgcagtgggtattagatagtgtctgacattatttgctttcataataatttgacaatatttacatccaggattctagcctggttgaataatgtgctttttgaatacaagtcaggtgtcattttcttggcattttgttcaaaactgtgttatttttatttagtccaatgtgcacctttgtcattgttttgattgcctgttgagtagactgattcaagggtcggtcacctctttcctacctcatctgaagtttgttgattttttttttgttctgatcctattgcattgtagttttcaatgtgagaaattaacttgtttcttctattagactattgttttctttatggtggcccctgtatattttatccatctttattttcccccagcatagctcctgcaggtacagcaaaggaccagtaattgaatgtacacataaaagaattgatgttccacctcgtttcctgaatatgactgttccacttatttattgctatgtaaccaactatctcaacactttgaggcttaaaataacaatttaatttttctcacaattttatgggtcagaaatttggggaggacacagctggatagttcatctccaatctatgtgatgttgggaggtgaaaggatccatttccaagatggctccttcactcccatggctggcctctcagtgtcccctggcctatctctctctgcaaggcatctcatcctccagggcctgtctgcatagctggggctttataccacctcaaaacattcagactgcctacatggtagctcatataagaagtgttctaagaggccaggtagaagcttaaaagctcatggtgtagtcttggaagaccaaagatggcacttcagcctccttccattggtcaatcaagtcagtaaggccagtctagattcaagaagataagtcacagagcatttgca

SEQ ID NO: 26321 - DNA, 1103 bp, Homo sapiens
aaatgctgtaaaatatccacgtagtctgatttctgatagcaaccttttgagggtgatctaattcattagcattcaaatgagctccaaccctagagcctcactacaaagggagtgggaaatatgcagttttactttataaccaaagcagtgtgacccaagtccgataaaggaccagagatttaagatgtggatgtgggaggagagattataaacaccagctgtcatggtgtaagagtctctacagtcttagttttggtaattactcctgtttcagaaatatctgaaatacatctttaatttatgaattgaactttctagatttaaacatccttggctgcttaatagcatttttgcctttggaattggaacgccttagttacagcacacccagggcaggctcagcctccctttcagagtcagtaagtgctgctgctcagctgtcacggtggacaggggctcctctagaaagcaggttcgactgtgtttctaaagaagatacagcttgtaacacgtgtccgtggtttgttttgagagaacagcatctcaacccagcaaagtaaagaagacatatttttaagaacagagcaaggaacatgagcagttggaaattttgcatcatttttcccaagatagagtcttttcccttacctttgtctcatttgtaatcatatccacaagacctttcttagaaacaggaaaaataccttttcctgtgacatcatttttttttctgtttctgttttgttttgctttgttttgttttttgcttcttaggttcctggggccaagtcaaattggttttggtaatctcataaaatactaagatgatcaggaattcatttagaggagactgcctcccatacagtgtagtagcttgggggaggtaactctgtaggtaattccagcttaaaatgagaagcaactgcaggcaaacagcatatgatgtgcaggtgtttctaagttcgtatgataaaatgggttccttggaaatccaaatcaccaaaaaatctccctgcagtctagttttatgagagaaagacaaataagaaaacaaacagcctttttcctttttccccaaaagtggtgtcggggtatttcctgag

SEQ ID NO: 26322 - DNA, 1091 bp, Homo sapiens
attcctcttgtccgtagatctgtgctaggaaccagtgaggtacatcaacacctattcatttcaccataaccttttccctcattttgaaaaggttaaaatagagttgaagtgaagttcacagcccaaagtctcactccagcacatgctatattcatctatactgatttttatacacacaacacctgtttcagtaagtaccctggaagttaatcagcgaagataagtgaactcttaagagagctcaattgtaatttacagttctttagaaagtgcttcctttctctttccttattttttttttaagccttaacaaaatgtggtaaacaactgtaaatatgtagatcggcagtgagtacattgagtgactgagtgcacacaggctgggaaaagaaatctaaaattctgtttgttgatagagtggctaagtctttgcacagttatttataacattttaatacacaataaggttataaagtatttttattgagagcttttatttatgtctgtggcctataatcttgagaagtctcaagggtttttgattctgctttaagcaattgttcttttctatgaattgttatgaacttcgaatagctgctgaagtgggtgatggtggtaatgggagtatttttattgtgtgttaagatttaaagggctgaaactcttccttgaggaagcagatttctttcttcctcttttgttttaagtggcatccactgttcatataacaagttcagatacagaaggcggaatttctcataaccaaagtgtgtgcttagattcaggtcagtcaaaaataatgtctttcaaacaagatgaatcttccttttctctttgaaattattctataaggtgaatttttttattctacatcctacagaaatatttcccagatatccagaagttttcaaaacagtttcatttgagagcacctgctggctggcacactaactaaaaagtatttgtctcgtacatccaaagtcatgttaaatactttgaaaggaatagaagagttttaaataacatcactaagagttgaaatagatatgtacattcttctccggaatttaaaatccctggtttaatgggtt

SEQ ID NO: 26323 - DNA, 1044 bp, Homo sapiens
atcaagaatagtgtcgtgagacattgggtgaaccctatttggatcctgatttgaaaatactgcaaaaaagaaaacaaatgagacaatctgaagatatggttggaatatttgtctactccctgaatatttgatatagttcatgtttttaggtgtgataacatatggctatgttttttaaaagacatatttaaaagacatacctatccatactgacataaatatggctgaaaagatatgcttgtgtgatgtaatttaaataatttggagggaggatcaggagttaatgttgaaactcaattggctttgagttggttataatcaagcatgtgagcatttcttatactggaacctttacttttgcagatgtttgtaatgttttatgaaaataaaagaagagaatacctccaagacatgctgctttcttatagattattagttgcaatcttagttttgctgaagaaattaacagaacttaatacaattactcttatttgcaagtctataattttctaaacctaactctgatgcagtcctactcctaatatttacaaggcctagaacaagagtatataaatggcagcccacattctacgggtctaaatatatacaagttataaaccaagtcagcaaaataaaatgccatgtaaaatgtgttctccttgatgaatgtatcttcatcatgacctggaaggccgaatcaagcatggcattctcatagtccttggagttccattttggcccatttggtacaggggcagccaattcctaacacccagcttgcagcccagtggtttggttggctccctttcttctctcacccccagctccatgttcccattaccactaagggcctggggtgcacatgtgtgtacaccctagctgtcatgtctatactctgtccacatcccatgcctgctgccagcatttggctactttttggatcttgggtgcgcacacatacccagcaggtcctggaagcaggcttgggcccatttggaaacaaattcctggttcagcataccctgaacatcatgaggcagaggg

SEQ ID NO: 26324 - DNA, 1084 bp, Homo sapiens
aaaaaaaataaaaataaaaatataaattttgttttgcacatacttgctgataatatatagaaatacagtagatttttgggtgctaatcttgtatcctatgattctgtgagatatagttattaattttaggaggttttgtagattccttgggattttttatatagacaatgtcttctgaaaatagaaagtttatttcttcctaacctgtatgacttcagtttgctttcttgcctgattgcaatggctagatctttcagcattatgttgaacaaaattagtgaaagtggacagtctaaccttgttctcattatttgtgagaaaactttcagtcttttttcaccatttatctgtagtttgtgaggtgtttgtttgtttggtttttggccagtgctcttttaactgaggaagttcccctccattcccatttttctgaaagttttcatcatgaatgggctgaagtttgtcaaatgctttttcccacatcaattgatgttgatttttttagactgttgataagatggatatttttttccattctcatgtccctctgatgaattctatttggtcataattctttttatgtattactgaattctgtttcttagtgtgctggtaatgagttttgcattaacatttatgagggatgttgatttgtagtttttttatttgcctttatctcgttttagtatcagggtaatactaattttataaaatgaattgggaagtattccctcttgttgtattttctgaaagagattgtataaaattggtgttaattcttctttaagcattttgtagatttctctagtgaaaccatctgtgcctggagatttcttttgtgtgtggatttttaaattataaattgaattttcttaatattattaacagggtcatggaaattatctgtttcttattgggtgagttatggtagtttgtgtttttgaaggaaatgacccatttcatcaaagttgtcaaatttatgtatgcagtgttgttcatagtattttcttactatccttttgatatctgctgtgtctgtagtgatagctcctgttttcttcctactattggtaatttgtgtctt

SEQ ID NO: 26325 - DNA, 1050 bp, Homo sapiens
aacttggaaactcatgattctttttagatatacagaattttagcaaaattgttttttcttttaaaaaagatgtagggaggagggtgaatgcaagaaacagaatgtagtaaaatgcttttcatgaaataagattaatctcctatcctgaatgaaaatagaggcagaagacagccatccagtgagtgctttgtaaatcacattattaggacttgcttaaagcattcacctagtgttctatatggaggtggttggtggaactgccatatgccagcttgggtctgggccagggaggcatgcaggaagggttttgcattccagtcatcctctcccgcctggcaaaaagcactttttgtatgtggtggaagtacccaagttatacgtacacaatgggaggctgaaatttcatttccacatgaaattagtgaataatggctttcaagactcactgaataagcatccccaagacagtcagcattgtaagtctgtacaggacgccagccatctggatgaaaaataaatcagttatgcagctactttggggggcatcagagatgggcatgcaagggtgaagtgtacggacactgtattggagcaatttgcttttcatcagggctttgttgtggccaagttttgtcacttctgtgattccatgtcactcttgtactgttctaagtcactaacttattaagccagaaatgcatatatttttatctccaattgtaatatattggccactgggtgtctgtttaatggttttatcttactattttattatctttattgtttaccatttcttaaaatacaccttcacattaattttggattttagcctttaggagagtaggtattctatctgcatggtggctaagttcgtaactccggaatgcgcaactctagacagtgttatcaataatgaggtgtttattttctccaaattgtgatggtgaggtctcctttctggctaatgtaagactagctgttaaaatatgatttgagaaaatatgatttcagttttggtaagggttatttgaaaaaaaaataaggccaggg

SEQ ID NO: 26326 - DNA, 1033 bp, Homo sapiens
gaatatagagtttaatggttcatcccaaattatataacgagtaaagatagaactgggatttgaccaggccctctggcttcagcctatgttcttgactttactgctttactttttctccctgactcaagtacgatctccagggagacatgaaaagaaaactttccttgaaattatttatagaatgcagttatttgtttacctgtagttaacatttagctctctctatactaatccttcttgaaaaggagcgtttttaaagataagtaacctttatgttgctatcaagcatcacctggcaaaatagaaaggaaggaagaggtaaacactgggctcactaaacatatcttggattatccttgagaatttttaaatacttattctagaatatttttataagcattcttagaatttttttttgattccaagtatttaagcaatgagtgtctggaacaatgagagaatgctttgttctggaaatcatgtataagtatttacacaataataccaaacttaactggactacacgaactggattccaccttgggccctattatgagttgcccaggtttcctgtacatcctaaaggtgcctcctcccaaaaccaaacgtccttgagccctgggaacttaaagaagttagatagatctgtagtcccaaagtacttacagagcaatttattaagacttgggttcctgagaaagttttattctattactcagttattgtcttcaatctgccattcactgaaaggtttctttggccttaattcaattctctatctcctacgctatcagtgtttttgttgagcacttttctatccagacagataacaggatttggtgacagctttcaatttcattactgctaaaacttttgtaggtatacaatttctctgtgtaggctggtccctgactgtgatttatttagctcattatttattggcctgtaaaactggcccaactctgcaaaataactcactaattcttcccatgtgaaaacctctgaagatatttatcaacacacatgtaagtaa

SEQ ID NO: 26327 - DNA, 1082 bp, Homo sapiens
gttgcagttaccaggtgtctgctctggggaaatgacctgtgtgttttctgcttagaatctcaaccagctagaaaagtctgtgtgtgtccctgtgggacaggaggaactttctttatgacctttgggatgacagagaggggtgtgtgagtgcaggaaaagtacgtttcaggccccagactcgctgatatcactgatgtgtagacaagaaacttgacaagcagtgcctcctggacatgttgctttgatttattcctgggcatgtgcggagcccaggggtcacgtcaaagggcaaaagtcttgtgggttggtgggttggtgggtgcatctgcacaaaatagagcagaaatatgtggattcttttttaaaaagtttatatatatgtgtctgtatatgtatatatgtacacacaaacatgttttatgttatacacacgtgtgtgtgtatgtgtgtgtgtatatatatatatttttgttttgtttttgttttttttttttttaaagatgcggactcaccatgttgttgcccaggctggtctcaaactcctgagctcaggcagtcctcccacctcggcctcccaaagtgctgggattacaggtgtgagccaccgtgcccgggtagattatttttttaagaaatacttccttgtccaaaactctcaaggctcttttgtgtgtgaagtgtggagtgcagacatgcatggtgacagtgacagttgtggggcccttctcacccgcaggacggagcatggtgacatggcatgggctccttgtcttagccgatgttgacctgctgggtgcagagctgagctttgcacagtgggcagggacatgggaagccaaagtgacgtttccaccctgggacagagctctggcccaagaatccatctgcagaggtggtgggactgtcgacaggtggcgggactgttggcagatgtgtcggcagttctagggggtgagggtgggggtgtgggctggttgtccttgttggggagccaggagtccctgtgcccaccgcctgctcccactcctcctcctgagtctgcaacacggtctcttgggaaggcaagaggacgcccccagctt

SEQ ID NO: 26328 - DNA, 1084 bp, Homo sapiens
aggaggggaataggcatcacaacgtctgctcaaagccacacggcatttttctttcaacatgcaagggattcgatctttttccccccgccccttgtttaaaatcagcatgtgactttaattcaagatcattgggcagacaaatgagagaaaaatggggtacttgtaacagtagggaaaattgggatgagccttagatatgccagtggagtaatcatggcaggaataataaatgacttttctctttactgttcccacagtcattcgccctgtgtggctggctacctgtccttacaaggctgcttctgttgtgggcaaaatgccacagttggtgaagccactatgggatctgtggcctctaacacaagcactgtgggttatttacaaatgtgccctcctaatttctggttgtgggacttttgggagcaaattatccagtccatgaatccacaggccttaaagtgctagcacttcggatgctgtcagtgccaagatggcttagtttctgggactaacctgcttagttcaccttttaggtgctctcttagcagctggcttctctcaaataaagtgaagcaaattcaaacgcattccttctctgtgatgaattcagccagtgtgttttatgctgctttctttcctcttgagggaaatcagatagtgggcagtgccagtctctccctcttgtggaaaacaagcccctagttggcctggcagtaattgtgcctgggcagacaaaggctgtcacagtgactgtcctgttcttagacttctgggtgctctagagccatcagtggagcttataaagactcctgagtctaagcccacccccgctagaaattctccacggatctaggatggggcagtataacaggtgcctcagggcatgcttcggagaaacggacagaaggagatgagaaacaggatggtgagtgtccggagtggaagctttgagccttatgggcagacaagtccacatctcagcttggcaaccttacatgtttctcataccctttgaacttggtcttcctcgactgcttaaatatctgtcttctcagacaggtatgaggagtggtgggagatagtg

SEQ ID NO: 26329 - DNA, 1105 bp, Homo sapiens
ttaatacctaggtgatgtgttgatgggtgcagcaaaccaccatggcacatgttacctatgtaacaaacttgcacgtcctgcgcatgtatcccagaacttaaaattttaaaaacccaagctctcaattacagcattaaatgttatcgatattaaaaaacaaaaactcttgcatttcccctaggctgcttcccagaccaattacacctctatggctgagtgtgggacccaagtgttaagccacctgggtaattctcgtgtgtaaccaactttgacaaccatcgtcctaagactgcagctcattttaatgcaattacaaatcaatctgggctattcaaatgcaggctgtagttcaggaagtctggggaaggtcctgagattctgagatcctgggttatgtcgctgctgctggtccaagaaccacacttggggttgcaaggctctaaaatattggagtagaacagggtttctcagtctcagctctgtggacactttgggctggataattatttgttgtgtattgtagaatgtttaaaagcatccctggtctctacccactagatgctgtcaacactccacccacttggttttgacaaccaaaaatgtctacagaaagtgccaagtatcccctgtgggagggagttgggggagaagtgaggtggagtgggggtaaaaatctcctcaggtgagaaccactggagtagtgttacttactaaggctgggtttcaggacccctccccacttcccgtttctctgtttaatggaaactttatttctttgactaggagaaaaaccacttgtctacctctagactgatcctaaatgcctggaagaggcctcaccacgatcagagtaattcctaccaagatgaattagatatcagctcctttgctgagaaacgtggtgtaatggtggcagggagcagctgaggggagattgggggagagacaggagtgcttttctaggttttctcagtaatggattttgaaagacatcagtaatagctttttaagcattttttctaaatgaaatttggcttatcctcatttccaatcatctctgagttttaaaagcaacaaaacaactgagtaccgcacctcagctctt

SEQ ID NO: 26330 - DNA, 1023 bp, Homo sapiens
tagatcgagaccattctggctaacacggtgaaaccctgtctccactaaaaaaaaatacaaaaaaattagccgggtgtggtggtgggtgcctgtagtcccagctactcgggaggctgaggctggagaatggcgtgaacccagaaggcggagcttgcagtgagccaagatggcgtcactgcgctccagcctgggcgacagagcgagactccgtctcaacaacaacaaaaataataataataaaagaactttgctgctacttttagctctggcgtgtgaggtctgtgtagcaaatgtgctaacaagttgaggggctgtatacgccatcggagacggcggagacggcccataaatgctcataaaagttggttaactgtgccttcaggggatgttcctcctgcttattcccagactgaagaagcagcacagtgaaagtgtgctgtggtgttgaggaagttttgtcattaaaagctggggtctttgtctttttgtctctgagctggtgactcctgtgtgtgagacctctgagagcttcttgaaacccaggtctctccctgttgagtggcaggcatcctgcccatgtcccaggaatgccgatccctgctttggaacgggggtcatgtgcatttcatgttacgcaaactgaaacagagctagtctggtggtgtgtggtagcaggaacaagggtgccctggtccatgctagagactttccttgggttgtttttatttggatttttttcctgttatactattctgtgttggctcttggctttctgggtccggggctatccttactctttccttaatcctagatctttgccatttgcaaatgcttcaagctgtccctaaagcagtggtccatttagaggctggtttctccattgtgccccagaaagtgccagctgcggcttcatttgctcagggaagggcttctgggtagcacggctgggcctcccggtgttttgagcccttggtcctgtctgccttctccctgaaggctctgtttgctgcatgctggagctaa

SEQ ID NO: 26331 - DNA, 1049 bp, Homo sapiens
aggttcgatctgggccagggactggggatgtgactatggctagaattccagtcctaactacaaggatgaatgtggctagggggtcttcattcatatgtgtttcatttatatgtgttttccaagtgttctttttagctaaatctttgcaggtaaatctttgacataactctcgctcctaatggaaatgataaagaagtcgttctgattgaaatgatgtgggggtgggatgaggggcccactgtggtcccttagggcttaaacctacagggtctaaggaacttgttttgaaaaaccctaagggtggtggtccaaccatggcagtgttcagttcactgccctgatacctggttatgagttatttattagcactgagtagaagtaaagctgatgctgtcagggaagaattattgtcattggatcaagaaaaactatgactcctatttttattttcttttgaagcatcaacactgattcatttttgatttatagctcaatatcactgggaaattgttctggttcatgtagaatgtcaaaaacacagctctccatctataaaatcctatcagaactcagtccaggctatttgtaactggtaaccagcgtcactgtgggtctttggcatagtgatttcatggagtgtctgaatctcacttttgagagttgttatctttcatgtttgttcttgtgacagattccccagacttctcctgtgaagttgtgttgattggttgatggatctgatgatgtctttgtggtcgtactctccttgctttagaatgctcacagggctcatggatagctaatacatttgctaattcagaagccagacctaagatttctttccttcattcttttttctttctttctttgtttctttgtttgtttctttctttttctttctttccttttttcttttctttccttctttccttccttccttcttttttctccttttctttttcttctttcttttttctttcttttccttctttctttcctttttcttttccttcttttctttttcttttccttcttttctttctttttct

SEQ ID NO: 26332 - DNA, 1040 bp, Homo sapiens
gttgcagatgtaattaatgagttaagatgaggtcatgctggagtatggtgggacctaatgcaacatgactagcgtccttatgaaaaggggaaatgtggacacagatacgcacgcaaagagaatgccacgtgaaaatggaggcagtgatcagcgtgatgcagcagaagccaaggaatgccaaagtttgccagcaaaccaccagcagctagagagagggctggggccagtttcctctgcagcctgtagaaggaaccaatggtgctcacaccttgattttagacttctagcctctagaactcagacaataaagttctcctggttaagccacctagtttgtgttactttgttttggcagcccttgccaactaatacaagcttggcctgagattaaggaatcactaaagaaaaggaaattgccctggaaacagccatttctccaacaggtgccatccgaagaatttcagtgtcatatatgtatcttgactcaactgtaaaacatcttagaattgatgacccaaactttgaacactgttttgtggtccttagagccttgcttgctcttcattccagactttgttgggctcttctttcaaaaagtcttaagtccatgcacaaaaatcttccctgggaggaacatatactataaggcatttatactaaaatgttggcttttatatttaataaatatttgaagaagcaactggttcttcacatgactatttgttaattaaatattccaattttgctttatgtttataagaaatattgataataacagctaacattcattgagcatggactctgtgccaggcactcttccaggtattttttttttttttgagacggagtctcgctctgtcgcccaggctggagtgcagtggcgcgatctagactcactgcaagctccgcctcccgggttcacgccatcctcctgcttcagcctccctagtagctgggactacaggtgcccgccaccgcgcccggctaattttttgtatttttagtagagacggggtttcactgtgttagccaggatggtc

SEQ ID NO: 26333 - DNA, 1049 bp, Homo sapiens
atagctttaatggagagatgtagtaactgacttttggctacatgatacatattttgggtaattgttatttaaattttatttttatttgtttggtttttttccaaaatgcttgagtaaaaaacatctgctttcagttatttatatctaatttgtcagctgtgcatacaccattctatgtgctagttgtgtgaaatagtgctgctgacccgtctcttcaaaagacagtttgggagtgagaatcatagtctcggtatagaagctctttggatttaatgattttgcctaatctgtagcaattagcccaagctctgaggctctacccccacactcacattctcccctgggtcccctcgtgctgtgttcttcaccctggatgctcagaaagattcatcaggggagcttaaaaatatatatccctgggctcatccccagacaaactgtgttcaaatttctgaaagtgagacccaggcatgggtatcatttgtacagaaatctccaggtgactcaaacgtgctaccaggctgagactcgaatcccgtgtgcattcctggaggtcggttctaaacctggatcccatcgacttatgacctgtagaataccctctgggcagatgaatgaaagcagggtttctcaaggtgtggtcccagatcatcagcagcagcatcacttgggaatccaccgggactgtatgtccccagacctccccccagaccactaaattgaaactcaggggctgggcccagcaatctattttaagaagcgctgcagctgactcggatcacgctgagatttgcaaactgctgagttccagggagagcttggccttggagctggccagcaggcacctgggtggacttcagctttccagggcacaggctgcaagtggctggcggccacagtggctctgagagagccctccataggttctgtcccctctgtcccagcagtgcagaggactggttctgccttcacttaggggatgagggtccatccggtcaccagtgtttacggccatctcttctcccttcctcaacccttgtcagaagagg

SEQ ID NO: 26334 - DNA, 1037 bp, Homo sapiens
gcatgactcctaaatcataatttctaatcttctggctaatttgttagtgctacaaaggcagtctagtccctaggcaagaaggaggtttgttttgggaaagggctgttatggtctttgttttaaactttaaactataaactaagttcatcccaaagtcagttcaccctatgcccaggaaagaacaaggacagcttggaggttagaagcaagatgaagttggttaggtcaagtctctttcactgtctcagttataattttgcaatggcggtttcgatgataattaaatgacattgaacgaaagatactatataggagctgctgtacatgtttacgttttccctaaagaaaccttggcaagtaaataaattaacaaaaccttgcaagtaattcttgtggactgtagaaacaagtctggatttctgaagcagccttccattaaagcacctttagatttggtgcctgtacctggtctttgccagccagcctgagcccagtgatgaaaggcacagacttctgatcactggtgtggtgtggtggacacagccctgacaatgcacttagtgctagaccaggtcctggcagacccttggtccacatgtcctcgtgttagtgactggattgcagagacaattgagagttccatgggggaagggaaaggaagggtggccaggatgagggtagcagagatgcatgaggcaggagaggaagggccagctagcagccatataccttctgatatggagggtttgggggattttaacaaccagcaggaccattctgttgtctccccaatgagtgtcaaccccgaatgttgttcatggggtctctgcttgctgattcgagtatgtgtccacacccacacggtcttttccacttggaacactcttttccaatccccacttttgccgatcttgcccctgcttcaaggctggctgagatcccctgttcatttttccttgctcctggctacaagtactcaccctctgctctctgaagctggaaggcctttatctgtgtctgggtttccgtatttcttt

SEQ ID NO: 26335 - DNA, 1048 bp, Homo sapiens
agcttgagttttattctgtagtgcaatttgggggttgggggagggtgggaaaggattgggggagatgagatgagaggaaaggcaggcagaagtcggctgttgtgagccccatggtggaaggtggtggtgggtgggatttagtctgtgggatttagtctgattagctgtatgtgcagtgcagtgtagaggatatgattttttaaacttcctatgtatttttttctcattactattctgtctgttaatttgcagatgacagtatcagatctcagagggagctgcttactaatttgggtcaagaaacacacatcattaagaaagaggcttctgttgatctgagtggggcatatgcattcagctactttaaaagcagttttcagtcacaaaaataataacagctgcagacgtttggtgagagcttgccacaagccaggtggagcttagatgcagtatcttgtttaatgctcttgagagtgctttgaggctggtggtgttatacctgaatttcagatgcagatgctgaggtccggagaggctgaggaactggcttagctgcaggaccagtaatcagtagaggcagggttggaattcagctctgtagtccctctgctgtgtgctttcccactgtatgagttaaagtgaagggggtggtgggtgtgctgtgtactcacctagtattgcactgttctgaatcatcatcagagtttccaggggaccattcacacagaccctgatcctccaggtggcattagatatggccagggatagatgttgatatggttgggctgtgtccccacccaaatctcatcttgaattgtagctcctgtaatccccaggtgtcatgggagggacctggtaggaggtaattgaatcatggaggcatgttttcccgtgccgttctcatgatagtgaataagtctcatgagatctgatggttttataaggggcagttcacctgcacatgcactcttgcctgccactatgtaagacatgcctttgctcctccttgaccttctgccatgattgtcaggcctccccagccttgtgg

SEQ ID NO: 26336 - DNA, 2022 bp, Homo sapiens
aaaccgcacaaagttattatctgacagttctgaaggacagaagtccaagatcagcctcagtaggctaaagttaaggtgttggcaggaccgtgtttttccataggctttggggagaatctgctttcttgcctttccagtttctagaggctgcctgcattcctcagctcgtgggctctctccacccagcaattacatcactccaatttctgcttccattgtcacatctccttcttccactctcctaccttgctgtttcccttataaggtccctgtgattatgttgggtccacctggaaaatatgggctaatctcgtcatctcaggatccttagcttaatcaaacctgcaaagttctttttgccttgtaaggcaatatattcacaggatctggggattaggttgtgaacatctttggggagcactgtttggggacctagctgtaggtcctagggatacaaaaatgaacagcacagttttctgcatttcaaggggttgtaggcttgaagggagtgggaactcatgaaaggatgtgcagtgttggaagatctgcattcatagtggctgagcctcgggtataaggtgggaggcagccaaaaatgaaagtggagggaaaattggagccataccaacacgtgccaatgcgagctcatgaaacgggactatatcttgtggatcaggacttcttgtcctggggttagtagaaggctgccaggtgttcctctaccacctggccttgtatgtaaaactttaggcatgtgtgcatttttctgtggagagggtccatgatgatattcatcagataacaatggggtttatgagccaaaagttcaatgttgcagctgtgggtgatgggatgcctttggaggactttaaatgacctaattaaagttgcgccttggaaaactagccatgagtggaacttgcaggtataggagtagaggcagggacatccttaggaagccccccagtactgggccaaagatgatgggcagggcaggcagtgggagcagagcattgggactgagtccagggtagatggggaggtagaattgatggaacttggatgatttaatggatgagcagggcaaagggtaattggtggcattctggatggatgaaggccctgttagtggaccaaggggatatagatggtgagcaggcttaggggttattgtgggttgggagggagctgataaattcagctttaaggccaggcacagtggcttatgcctataatttcagcaatttaggaggctgaagtgggaggatcgctttagtccaagagtctgagatcagcctgggcaacagagtgatacactgtctctacaaaaaaaaaataaaattagccaggcaggtgtggctgtggtcccagctactggggaggctaaggtgagaggatcacttcagtgaatcttattactgcactttagactgggcaacagagtgagaccctgtgtatgagctcacataggcacgtgttggtctgcctccaattttccctccactcaaaggcagtaaatacataaatttggttttgtacctatgcatatcatagagcctgtgggacattcaaatggaggtaagtagtatatagtatgtggtcatagccatttctagagtccagaggtacagaaattcatgaactttccatatttttattcttatttaatgtctccactctgttcttcttcagtaaagctaaacccttaaaatgggcaggacttaggaggttttgaggcagaaatagcaacagctaatacactttttgttacttttataatttataggacactttttataatccaaataccatcttatcattgcatcagtctgatgaggggtggtggatgaactgtcactgacatgagggtgatgataataatgaataataattatagataacatatatgaacattcaccatgccaggctaggctctgagcactttacatttattagcttagttcatcctcacagtagccctataagagttgcttttatcatcccattttacagatgagtcag

SEQ ID NO: 26337 - DNA, 1055 bp, Homo sapiens
tctatgaatttatttcttattaactttcattcagcatttcttttctaacctcagcttctctgtgatattttcagatgcagaggtaattctattggtttcttcctgaagaaacctctcatggagcacctgacctcctgtaaccggttctgattgcccatttcacctggtgcacagctgcatcccagactcttccttccccactttttttgggatttcctttatttttctcttctgttggaccccctgtttcctggataccatgtttttctcttctctggcttactcccttttagggggaacacatctactcctagctccctaggtaaggtcacatgggaggtgtagctttcaaaccatgtaaagcctgaaatgtcttcagtatatcctgacactggattgacagctggatagaaaattctcagtaacaaataatgttcccttagagttctgtacactttgcttcattttattgtcatttgtagtgtggctatgaaagtcctaagatcttctgaaacttacacctttgcatgggacctgctgtggtgggggctgttttatccatacacaccctacttcctatttctttgtctttttgttctacttcctgggaaatttaatcacctttatattcctacctttctattgagctttttcatttccattattaagttaaaaaaattgtctgagtgtatttctttaaaaaattttccagctcttgttttgtggatcttttttgaaaattttttttatttttaattaattaatttattttttatttttagacaggatctctctctgccacccaggctggagtgcagtggcacaatcacagctcactgcagccttgaccttccaggcttaggtaatcctcccacttcagcctcccaagtagctgggactacaggggcgtgccaccatgcccggctaattttggaattttttgtagagacacggtttcaccttgttgcccaggctggtcttgaagtcctgggctcaagcagtcttcccaccttagcctcccaaaagtgttgggatgacaggtgtgagccactgct

SEQ ID NO: 26338 - DNA, 1038 bp, Homo sapiens
tcacccacatagtatatttgattataatgcctcttatgcttcatttaatctattatagcaccccattccttttttatactatcatactatcaatggttgaatatactggatcatttgccattctggatttgtcttcctgtatctgcaaggtattgtttgacatgttcttctgttcccccaattttctcagtaagaattgtaagatctagaggcttagtttcattctcattcagttattttgggaaaagatcttaacaggtggtgcagtatatcaagaggcacctatggtctggcgattcccctttccatgttaatattgaaagacaagaggcaaacagataacccagaaatgtagtccatcacaatcagaggctatgtatgtgtatatacactcacacacatatatgtgttcattgcattgaaaaatgtaattttaatacaacaaattatgacaaattattatttatagaacactatcatcaatattcactttcatttccaaaattcaactggatttctaatcttgctatctgaacaattctaaatttcaaactaggccaggcgttggctcatacctgtaatcccagtacttggagaggccaaggcgggaggattgcttgagccaagagttaccagcctgagcaatatagtggaaccccatttctacaaaagaaaaaaaccagaacaattagccgggtatggtagcatgcacctgtagtcccagctagtggaaccccatttctacaaaagaaaaaaaacctgaaaaattagccaggtgtggtagcatgcacctgtagtcccagctacttggttggctgagataggaggattgcttgagtccagaaggtcaaggctgcagtgagctgtgatggtgccactgcactccagcctgggcaacagagcgagaccgtatctctaaataaaatgtaattttgtaatgtgcttaatttaaaaagaatcacccctcagccactgtgtgcccactaaaatattggatgaattcctgccagtttgacaaattatatatttttatttacc

SEQ ID NO: 26339 - DNA, 1006 bp, Homo sapiens
tgttgagacagagtcttgctttctcacccaggctggaatgtgatggtgcaatcttggctcactgcagccttcgcctcccaggttcaagcaagttgcatgcctcaacctcctgagtagctggtactacaggtgcacgccaccatgctcagctaatttttgtagtttttgtaaggatagggtttcacaattttggccaggctagtctcaaactactgacctcaggtgatccacccatctcggcttcccatagtgctgagattatagccatgagccaacatgccaggcccttcgcccactttttaatggaattttttgtttttctcttgtaaatttgtttaagtttcttatagatgctggatattagacctttgtcagatgcatagtttgcaaatactttattcctttctgtaggttgtctgtttaccctgttgatagtttattttgctgtgcagaagctcttaagtttaattagatcccacttgtcaactgttgcttttgttaagactgcctttggtgttgtcatgagaactttgctcattcgtttgtccagaatggtattgcctatgttgtctcccagggcttttatacttttgggcctggaggctctgtacagggagttgccgagcagctactggctcaatagctctggtggcggatggctagagccccaggcttggaggacctacccaatgagcagatatgggaatgggcacccatgtaacagtctggccagttttctgtagggctactaaagtagctgagggcccctccagtccctagtcacctcagattttccagtacctagaggtatcaccagtgaagtctgtgaaacagcaaagatggcagcctatcccaccctctaggagcttcatcccagggaggtacaggcctgttgctggtccaaaggcacctgaaggaggtagctggtgatctggttgggaggttctgtccagtgaggaggaatgggatcggggactcacttaaaaaaagcagtctggccacattt

SEQ ID NO: 26340 - DNA, 1001 bp, Homo sapiens
tttagaatcagcattttaagtgtatacaattttgttggaattgtgttggatctgttgactaatttggaagaatttacttctgaataatatttagtcttctggtccctgaaaagagtatcgttcacttttaatttatccccacaatgttctctagtttttttaatacattttgttagatttatccataggtattttgtgtccttttatgctcctgtaaatggcattttttaaaatgtaaatttccaggtttcccttgctaagtatagaattattatcgattttcttatattaaccttttattctgtgaccttgctgaactccttttattagttcttgtggatttttggttaattctagaagatataggatcattttgtctgcacataaagacatttttatttcttccttgtaatatatatgccttttatttatttgttttgcctattacgttgaaggaagactagtacaattttggatagaaatgataggactgaacagccttaccttgtagccaatcttagggggaaggcatttagtctttcaccattaaatatgatgttattgcggctgggtgcggtggctcacacctgtaatcccagcactttgggaagccgaggcaggcagatcacgaggtcaggagatcaagaccatcctggctaacacggtgaaaccccgtctctactaaaaaatacaaaaaattagccaggcatggtggcgggtgcctgtagtcccagctacatgggaggctgaggcaggagaatggcgtgaacccaggaggcagcgcttgcagtgagccgagattgcaccactgcactccagcctgggcaacagagccagactccatctcaaaaaaaaaaaaaaaaatgatgttattactaagtttttttagatgacttttcttatgtagaggaaacttcctttttttactagtttgtttagagaagaaatggaacatatgaactttttttcctttggcggagaaggggaagaagaggtggtta

SEQ ID NO: 26341 - DNA, 1029 bp, Homo sapiens
ccaagtagctgggattacaggtgcccgccaccactcatagctaatttttgtatttttagtagagatggggttttgccatgttatccaggctggtcttacactcctgacctcaggtgatccacctgcctcggcctcccaaagtgctaagattacaggcgtgagccactgcgcctggtcaacaaaaatttttttaagagacatgatcttgcttggtcacccaagctgaagtgcagtagcacaatcatagcttactgtagcctcaacctcctgggctcaagcaatcctcctctctcagcctcccaagtagggaggactacaggagcacaacaccacactcagctaattgtttttcattttttatagagattgggtcttgctatgttgcccaggctggtctcgaactcctggcctccagcaattctcccactttgacctcccaaagtgttgggattacaggcatgagccaccgtgcctggcctcaatattttttaaatggcagtttccctcaaattgttcagtggattctgtgcaataacaatcaaacccaagattttgtagaaattgacattttaaatctaaaatttatatgcaaagacaaagttccttttttaaaagaactttgaaaaagaagaaaagaataagattcacactatttttctttacagtcgtcaatcaggagacacatgtaaatcactggaacatatagaatctagaaatagacccatatatgtgatcaattgatttttgacaatatgcaagacaattcactggagaaaagctagtcttttcaatacatgctcttggaacaattggacatccatatgtgaaaagaagaaacccaaaccatatcttacacaatatgcaaaatttaatgataaatggattgtatatttgggactttgggttaggtaaggatttttttagatggggcacaaacttcatgaacgataaaagacaaaagtgatgaatttcacctcatcagaacttaaaatgtctctccccaacactgttaagaggtgaatagacaag

SEQ ID NO: 26342 - DNA, 1066 bp, Homo sapiens
aaacttagagcatgaaacaaacatcattagatttatagatttgatttattatctaagatatttcacatggttcaaaattctaacctatggaagagtatacacattgaaaaatcccttttacctaagttctccctataggcgactgtatgtagtttttaatcttccctcagaaactgtgtgcatattcaggcaaattcattgttttaaaaagattgtaatataagcataaacattgttttgtactttccctttttgtctttttttcatatacataaatggtatacattatggttgcatgtcattgtatcattggaaatatactgtactttcggggatggcaggaagttgagagtttgccttgtacagtttatattttctctgtggaatgggaaggacaatcataggttcagagaaatggaaaaatagagggttaaaggtttcatgaaagttgatgtggtttgaaattttaccaaatgagaatgagattagtgtggtaggattgttaacagctctagtaatcatttgagatcagcaactgcagatttgtaatggaaccagttttctctaaggtacaatttctccagccacacccagcagcctggatacaggcatggaaaaggcttcaggcctttttgatcctgaggttggatccattcaagattggattttttcaacagcttatgatgcatggactgtgggacaagggaacttaaactatatttataagaacaaaggtaatgtatgaactcagaaatcaacagggctgaggaaagatgtgaagacagaaaaaatataatggatttggaaattagaggagtcagttgactgaaatgtattgatgcaatagtaaagacatagtgagtatgaatgaacaagcaccttcgaaggatggggtaagtagagagtagaatgtctcaatttaccaggtagaacggtttcttaggacctggttgtaaccatagggatagttggagtaggttttagagggtcattgaagacaatgagtgtgaggaactaagagggaactagaagccatgttttaagaagcattttaacaaatgaaaac

SEQ ID NO: 26343 - DNA, 1034 bp, Homo sapiens
gtcattgtaactatcttcatgggtgggctgtgggaacagcacatctgaagctctaacactcccacgtagccatatgcctttggcagctggagagtcatataaaatcagcactggcccatgttctcatacttataaacacctctctctggcttactactttagtatttatgaactattttctggcaagctacttaatcagaactttaaaaatggttcactttggccgggcacagttgctcacgcctgtaatctcagcactttgggaggctgaggcgagcagatcacgaggtcaagagatcgataccatcctaagcaacatagtgaaaccccttctctactaaaaatacaaaaattagatgggcgtggtgacacgcatctgtagttccagctactcaggaggctgaggcaggagaatcacttggacctgggagacagaggttgcagtgagctgagatcgcaccactgcactccagcctggtgacagagcgagactccatctcaaaaaaaaaaggaaaaaggttcactctgataattaatttttttttttttttttttccaggtgtatggtggctgatgaagtaagtgtttcaatggtttttatgtcttttataagattacacagcttgtttttagtgtctgctattttccatgtactctttctccatatgactatatgtctgtatatggggatggggagagagagaaagatgggagggtgaggagggagggggagagagaatgagaatgaatgaatgtgtgtgtgtgtgtgttttctagacatgcatctgatacatatgttaatattaacattagtgaccccaaattgttacctaggatgcatgaatgagttttgaaatgcagccccccaaaaagcttttctgttataatagtacttgcttaaaagctaaactttaaagattctgttctaaaggttattgtttattgtttcctatgagtttgaaacatagttctgaaatggtattttattatcactcaacaatctgatagatttaaatggcatgtgcttatatgta

SEQ ID NO: 26344 - DNA, 1053 bp, Homo sapiens
tacaatgcataataagcagatgtatcacctcaagcatttattcattatgttacaaacaatccaattatattgttttaattatttttaaatgtacaatttaattattattgactatagtcaccccgttgtgctattgaatactagatattattcattctatttttatttacccattaaccatcccgactttccccctaccccaccactacccttcccagtctctaataaccatcattctattctctatctccatgagttcagttgtcttaattttggattcccacacataagtgagaacgtgcaaagtttgtctttctgtgcctggcttatttcacttaacataatgacctctagttccacccatgttgttgcaaatgacaggatctcattcttttttatggctgaatagtactccattgtgtatatgtaccacattttctttatctcttcatctgttgatggacatgtaggttgtttccaaatcttggctattgtgaatagtgctgcaataaacatgggagtgtagatatctctttgatatactaatttcctttcctttgggtatatacctagcagtaggattgctggatcagatggaagctctatttttagtttttgtgaggaacctccaaattgttccccatagtggctatactaatttacattcccaccagcagtgtacaagtgttcccttttctccatatccttgtcagcatttgttgttgcctgtctttcattttaactggggtgagatgatatctcattatagttttgatttgcatttctctgatgatcaatgctgtcgagcacattttcatataactgtttgccctttgtatgtcttcctttgaaaaatatctattcagatcttttgtccatttaaaaaattggattattagatttttttcctgaagagttgtttgagcttcttctttattctggttattaatcccttgtcagatggatagtttgcaaatattttctcccattctgtgggttgtctctttactttgtggattgtttccttttctgtgcagaagctttttaacttga

SEQ ID NO: 26345 - DNA, 1076 bp, Homo sapiens
tgttgaatgggagtggtgaaagtagacatcttagtctcgttccagttcttcggtggaacactttcagcttttccccattcagtatgatgttggctgtgggtttgtcatagatggctcttattattttgaggtatatccctgatgcctaatttgttgagagtttttttttatcataaagcgatgttggattttatcaaatgctttctcagcatctatgaagatgatcatgtgttttttgtttttaattctgtttatgcagtgatattgtttggatatcttctccaaatttcatgttgaaatgtaatccccaatgttggagttaaggcctggtgggagatgtttggatcatgagggtggatcattcatgaatagcttggtgctttcctcacaatagtgagttcttgtgagacctggttgtttgaaagtgtgtgacacctccccactcactctcttgctcctacatttgccatatgatgtgtctgctcctccttcacctcccactatgattgtaagtttcctgtggccctcaccagaagcagatgccaacaacatacttattgtactgcctgcagaaccatgagccaactaaactgcttttctttataaattactgagcctcaggcatttctttttcttttttttttatactctaagttctagggtacatctgccaacgtgcaggttagttacatatgtatacatgtgccatgttggcgtgctgcacccactaatttgtcatttaacattagatatatctccaaatgctatccctcccccatcccccgaccccacaacaggccccagtgtgtgatgttccccttcctgtctccatgtgttctcattgttcagttcccacctatgagtgagaacatgcagtgttcagttttttgtccttgcgatagtttgctgagaatgatggtttccagtttcatccatgtccctacaaaggacatgaactcatcactttttatggctgcatagtattccatggtgtatatgtgccgcattttcttaatccagtctatcattgttggacatttgggttggttccaagtctttgctattgtgaatagtgc

SEQ ID NO: 26346 - DNA, 1034 bp, Homo sapiens
ctcattgttgaatgtccctcatttcggatttgtcttatgttccttcactttagactgagatgatggacttttagggagattgctgcagagatgatgcctctgtttctctttgactccattcttttgtgttaaaacaaatgccttttgcttaccaatgtaaatttttagccttttaaaaagttttttttcttaattgttgctctaggaattataatacatatttttaacatatctcagtctacttgagtttaacattgacttaattctgacttaattctggtaaaatatagccgtttcattccagtatcactctatttctttccctttgtggtattgtattatacaagtatatattatatgtaagaatatagtgttataattattcattttaaatcttttttaaataaagagaaaaaagaaaaatatgtgtatgcatgtgtgtattcagtcatttatatttatattaatatatacttaaatatttaccgttgtgaaacatatataaaactactgtaggaaaggtctgccagcaacaaattctctcagtttttgtttttctgagaatgtctttgtttcaccttcagttttgaagggcagttttgctggatgtgggagtcttggttggcagtattttttctttctacaccatgaatgtcattcggttgccctcttgcctctgttggtctgatgaaaagtcagcccctagtagtatcattgcttccagtacataataaattgtttttctctttctgcttttaatatttcttctttgtctctatctttaaacagtttgaccctgatgtatctatgtgggcttcttttgtgtgtttatctgacttaggattcattgagcttcttgggtctgagagtaaatgtttttcttcagatttgggaagtttcggaccctgatttttccgtatttttttttctgcccctttctctctttttctgggccttccattatatgaatgttgggatgctttgcattgtcccaaaggtctctgtctgaggcttcattcatttttcttaaacct

SEQ ID NO: 26347 - DNA, 1096 bp, Homo sapiens
ctccccgcccacgcctaccgctttaatagcttattgcagtataatctacatataaaaaattaacacataactgtataatttgtgttataaactatacacagtttgatcagttttagcatcactagaattcttttagaatttccgttttaccaaaaagtttgtgcctctttgtactcagtcaatccttgtccccacctccagacctagtcaacaaatgatgttgctttttttccttctttacagtttaccttttctataaatttcacgtagttgaagtaatatactgtctaatctttttttggggggttcctatttttttccagtcaccagctctctggcaaactgtgtaatcttttgtgtctggcttttctttccaggttcatccttgttgtataaatcagtagtttgttccttcttattgccgagtattttgttgtatgggtaaactacattttgtttataaatttactaattgatggagatttgtatttttccactttggggctattatgcataaagctgttatgaacattcccatgcaattctggatatttgttttcatttctctggcatgaaaaactaagagtaggattactgggttgtatgttaactgtatatattatataacctcctaagacaatgccaagtagttttctaaagtggctatactattttacattccctatggcaacatatgacggttccagtttctcctcattcttatcagcgcttttttttttgtctttttgattatagccattctaataatgtgtattacattgtggctttaatttgcatttccatgtaagtaatgatgttgaacagcttttcatgtgcttgtttgccattaagtattgtctctagtgaattgtctattcacatattttacctaagttttaattgggttgtctgtcttcttattaaagaattctttatatattcttcttacatagcttttatcaaatacaagatttgaaaatattttctcccagtctgtgacttgttactttattttgttaatccaatacaggatattacattgcatttaattattgtgtctttttagtctcttcattctgtggtagtttcttaatct

SEQ ID NO: 26348 - DNA, 1093 bp, Homo sapiens
aaacaattttgagaaagtctcatacttctgattttgaaactactacatagctatagtaatgaatgaagactataagtactggcataaagagagacatacacacgatcagtggaatactagaaataaaagcatacatttatggtcagttgatttcaacaagtatgcttactcattgggggagagaacagtattttcaacaaatagtgccgcaacaatagttaactcacatacaaaagtacgaagtataaacccctactttacactattcacaaaaattaactcaaaatagatcaaagatgtaagagctagaacttgaaagaaaacctaagtgtaaatttttgtgacttggtaggagacagtggcttcatagatatgacacctaaaaacatacaaccaaattaaaagtacataaactgaatttcattaaattaagaaacttctgtgctttaaaggacatcattaataaagataacccacagactaggaacaattatttgcaaatcatgtttctgataagggacttgtatcaagaatatataaaaaacttataactcagcaataaaaagataactcaattaaaaaatgggcaaaggatatgaatagacgggcatcatcaataaagtgtaaagataacccatagactaggaacaaatatttgaaaatcatgtttctgataagggacttgtatcaaggatatataaacaacttataactcagcaataataagataactcaatgaaaaaatgggcaaaaaatatgaatagacattcatccaaagaggatatacaaattgccaataagctcatgaaaagatgctgaacatctttaatcttacccatgaggatggctataatcaaaaagaaagacaatagtaagtgttgacaaggatgtggattaattgaaatcctcatgcactcctaattggaatgtaaaatagtgcagccactttgaaaaacagtttgctagttcctcacaaaggtatgcataaagttaccacataatccagcccttccacttgtagatgtattgtacccaagaaaattgagaatatatggtgacaaaaacatgtatacatttggtctttcactatttt

SEQ ID NO: 26349 - DNA, 1071 bp, Homo sapiens
tattaatatttattaaatatttaaaaaccaagacaggtttttgaaatatttaatacttttggtaacctatctttttgttttgccatttgagatttttagatttctcccaattttttcatagatattaaaaaaccatgcattaaatctttgaatctctgctccatcaagcttagtgttagatacattgcctaattttttattaattcatatttatgtcatgtatttatttctggatatgtatattgtgaatatacatggttaaaaataattgacaatgtaataatacatgaaatttatagtatacagttgaacaagaacatttgctatttgtcatgtacttattcattcaggagatgtaagaagcttgtgattgaatgaaattattaggcttagcattgtacattttcttttttacctttttcattagttcatactctttgtatggctattgttctgacataaagtgaattttattttttctggaaatcctggcagagtaatttgttttaattgtctgtctggggaagaaaagactttgtagaaagtcaacaaggatacccaggaattgaacacagctctgcacgaagcggacctaatagacatctacagagctctccaccccaaatcaacaaaatatacatttttttcagcaccacaccacacctattccaaaattgaccacatacttggaagtaaagctcttctcagcaaatgtaaaagaacagaaattataacaaactctctctcagaccacagtgcaatcaaactagaactcaggattaagaatctcactcaaaaccgctcaactacatggaaactgaacaacctgctcctgaatgactactgggtacataacaaaatgaaggcagaaataaagatattctttgaaaccaacgacaacaaagacacaacacaccagaatctctgggacgcattcaaagcagtgtgtagagggaaatttatagcactaaatgcccacaagagaaagcgggaaagatccaaaattgacaccctaacatcacaattaaaagaactagaaaagcaagagcaaacacattcaaaagctagcag

SEQ ID NO: 26350 - DNA, 1035 bp, Homo sapiens
aagtactgggatgataagtgtgagccaccgcgctcagcctcacttacttatttttaaatttatttttacatatgaatgtctacttgatccagcacaatttattgaaaagactttttcctactgcattgtaatgttacttttgtcataaatcaagtaattttatgtgtatacctttctagataagtgctgtctaatggaactttccgctgtgatggaaatattctttatgtgtactgtttaattcagtagctattcactgcagatggctattgagtacttgaagtgtggctagtgcaactaatgattgaatttttaattttactaattttaattaattcaaatttaaatagttacatgtttagtgcctaccatatggaatagtgcagttgtagattctttgttttgtttctctgtttgccatctttgtgtcagtaccatacttcttcatacttcttagcgtagctttataataaatattctggtatcaggcagtataaatctttcagccttactctttttcaaaattgtctcagctattattgactctgcattacatataaattgtagaagtcatttatcaattttcacaaaagtgctggatttgtgaatggagttttactgcatctatagatcagtttggggagaatttatatatttataatacagagtatttcattccatgaatatgaattatttttacatttacttaattgctctttcggtgtcctgtatatctcttatctttttttgtgtgtgctgcagttttgatattttgtatttagccatattcaagcttactgattttatcttttgctgttaattaatttattggattctcttaaggatgagaccatcactcaatatacttgaaatgagaaaccactcaatttctttcttgataagcaagggagaactgtgcttcttagccatgacattctaaacaaagcgaagagttggtatcgcattgggctttggaagcctgaagactttcaaaaacaggagtgtttaaggactgtctgaaatttctgtgtatag

SEQ ID NO: 26351 - DNA, 1032 bp, Homo sapiens
agataccagtattatcatttgtgatagctactttattgtatagctctagcataaccaattccctgctgatggatatttgcattgttttcaattaataatttattttttattgtgttaaaaacgcataacacaatatatcatcttaaccatctttttttttctttttttattttgcgacagagtcttgctctgtcttccaggctggagtacagtggctcactgcaacctctgccaactgggttcaagtgattctcctgtctcagcctcctgagtagctgggattataggcatgcaccatcatgcctggctaacttttgtatttttaatagagatggggtttcaccatgttgcccaggctggtctcgaactcctgacctcgagtgatccacccacctcacctcccaaagtgctgggattacaggtgtgagccaccgtgcctggtcatcttaaccatttttaaatgtatagtgtgaccctgagtcttctctgaggccccatgtgtgggtgccagatgattgtcgacaaaaagagtcaaactgtaaaatatgaggagatttatgctgagccaaatatgagtgaccatggcccatgacacagccctcgggaggtcctgagaacatgtgcccaaggtggttggggtacagcttggttttatgtattttaggaaggcatgagacatcaatcaaatacatttaagaaatgcattggtttggtttagaaaggcgggacaactcaaagtggggacttccaggctataggtaaatttaaacattttctggttgacaattggttgaggttgtttgaagacctgggattgacagaaaggaatgctcaggttaaagataaaggattgtggagaccaagttttattgtacagaggaagctcttagatagcagacttcagagagagcaggttgtaaattgttttttatcggacttaaaagggtatctggctcttagttgattatctgctggatttgggaaggaaggtaggaaaacaaagggggaaggggattcactatagaatatgga

SEQ ID NO: 26352 - DNA, 1066 bp, Homo sapiens
aacatttccataatttcagaaagttccaaacccctgcctcttttcagtcttagccctcttcccctgaagtaaccactgttccgacttcaatcactacttttatcccacaggttaattttttggcttttttccactaaattttcaaattctttgatatggtactttactattgacgaagtactttcacactaggttatttaatattctttgattcacccaatatttagggaacacctgtaggggacaaaaaatgaatgagagcccctgccttccattgctgctaatctggtgggaacgagacatgtatttaattaagcatgtaaaaaatagagtgggtgatgaaataatctatatactaaatccccatgacacacagtttacctatgtaacaaacctgcatgtgtacccccgaacctaaaatataagttggaaattaaaaaaaaacgagagggagaatagagcatcacaaccagagtgctgagatgaattactttattaccaaagaaggaggaggactcagggaggtgccgacgtttaaacccagtcactgaagggtgtgcagaatttggataggcaagataccctgggacaaggtcattctaaaaccatgctaacatttgtactttttttttcattgtgatagttcctgaaatgagttgcataaaactggtacatgtcttagggcagtctctaattgatttttattttgttctatttttaaaaattagtcttcaaatagcagattcacatgatattaaaatatatgcacataaattatatacacaaatatattttctgaatgaaatttagtatctgcatatatttaagagctatttctgtctcatatgttcataatcttcatccattaaaaaaacttttgttaggcctttctcactctaagattataaaaaattctcccattatttacctagctagttttctagttgttccaaaaccatttattgaacaatccatctttttgacactggtttggcatgccttaattatatattcttgtgtgtgttaggatctccttttggactttccattctgttcattgagtctt

SEQ ID NO: 26353 - DNA, 1013 bp, Homo sapiens
taagcataatactgacaatttcattcctgctggtttaacttcataattttattttggcaatcttttaccagcacatattagatcaactttggttttttattaatttcccatattcaattgtgtataccacagcttgattctttagactcctgttgagtgacatttggttcattttcagtgttttgtattacaaacaaaattgtagtaagcatccttgaacgcaacatccttttatatttggctataagagaaatttctaacaaattgatgtcttcaatggtgtgcacatcataccaccaaaatcacataggagttcctgtttatgtgaaaaagggtatgtcattattttggtttgtgtttagttaattatgggtgagattgaacatgttgttatatatttattggctgatgtctatttaaatctgttaagattctttcttttgtggtcaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggtaaccccatgagcttccttttttatttccagttggagtaatcgagtgagacaaggctggaagatacactgctcaacagctggtgcatgtatgtgcaccagcctttgatttccctcagggtggcacaggatcggacaaagggtttagtaagcaactcaaaataaagtcatttgaattgcctcttccacttaattgtgttcaagaattaagttttcaggttttgttactatttatttctcaaaaggaaacaagttacagttaacttccaaccacactttttatttttttaaacagcctctcactggagactgggctggagtgcagtggcacagtcttggcctactgcaacctccacttccaaggttcaagcgattcttgagtctgagcctcccaagtagctgggatta

SEQ ID NO: 26354 - DNA, 1062 bp, Homo sapiens
agttatacaacataatgtacttactgccactgaacttatacactgaaaaatggttaaaatgataagttttattatgtatttttatcacaattttatttttttaaggaaaagttattttgtcatcttatttcctggccttatgacagagctgcacttaagtgtgtttccatatgcgagactagtctcctggcctttttgtggttgtagtctcctggccttgttggtgtgtgtgtatgtgttttagagagacggggttttgctatgttgtctaggctgaagcactccctcctgggctaaagcaaccctacctccagcctccccagtagctgggattacaggtgtaggtcaccacattggctcttgtttctctttttatttaccaaaatggagtgtttatgattggttacttgttctgtctatacctttggcagtttcacattttcctgactcttggttgcaagctgtgttttgaaggctatgactaaaattttaggcctgatgctttatctttgaactcttccatccttgtcttccatactcaattaggattatggtaagaactcaacctttttttatctttttttattctattttattttgagacagagtctcactctgtcgcccaggctggagtgcagtggcgtgatctcagctcactgcaacctctgcctcccgggttcaagcgattctcctgcctcagcctcacgagtagctgggattgcaggattgccccacaacactcagctaatttttgtatttttagtagagatggtgtttcgccatgttggccaggctggtcttgaactcctgacctcaagtgatccatccgccttggcctcccaaagtgctgagattacaggcatgagccactgcatccggccctttttttctatctaaatataagtcagagaagttttgtttgtggaagggatttttagttttctacctgttttgttttgttttgttttgttttgttttgttttgttagggtcttactcttgcccaggctggagtgcagtgacagcatacattgcctactacagcctcaacctcctgggctta

SEQ ID NO: 26355 - DNA, 1037 bp, Homo sapiens
gcctaggtagattgaggctgcagtgagctgtgatcgtgccactgcactccagtctgggtgacagagtgagaccttgtctcagaatgaaaccaaagaaattgactgacttgacacatgacttactaagtcataaacagcccacagaaaattcacagtattgagcataatattgacaagatgattgttcagctagtcatcttggacagaggaatggccaacagtgtgggtgctgtatgattatttatgtgctatatgataatcaggtatggtatgacattttatatttagtgttccggtgggataggagagaactgaaagagggtcctaaacctagagtagataatagaagtgtcctacacagttaagttctaaggtttagttgtaaccagatgaaattccttaatctcggctgttggtaggtatgtaaagggaaggaggccttggtaaacctctaaggtatcagctgacttttttgtttttcagagtttacccttacctgtgtcgggccttgaaaacattcgtcaaagaccgtaaagagatccctcttgccaaggatttttatgttgcattccaagacctgcctaccagacacaagtaagaaacccttctctggaaaaaaaggaattcaccaaatggtataagtaccacttagctgacagtcagaaaacttgagaggttgccttgatctgctattagctggctatttaacattatacaaatcacttttacctccctgagcctcagtttccttgtctgtgaagtcttttggcttaggttttctacctaaatcatgcaaaaaataggtttgttgctgtaaaattactttttcataattgataatcacaataattataaaacaagtacttataaaattgatgctgtaaaataccaggaggaaaaaatagtggtttgcattcagattttgtagaaggttgacttttgtaggagttatacccacttatccagaaagtttagtgttggagaaatgtattttcctatggagatgggattagatgtaaagggagtgaagcaaattt

SEQ ID NO: 26356 - DNA, 1108 bp, Homo sapiens
attttctaaaaccaagactccaaagaggataaaagctaaacttagtatgatctttttaaaatttttaagataatgatataatgaaaaggaaaattagtccttgagctcctcctactggtggcagttgaaactgttagactagagaactgatatttctgaagtcatacaatattcagtttatacctttaaaatgctgtttcagcagagccagtttcagtttgtcagctattaacatcctcatctcaagttttatcaaaaatgttgaaagtcaaaaactgttggaatgtaattttttttttttttgagacggagtttcgctcttgttgcccaggctggagtgcaatggcactatcttggctgactacaacctccaccccctgggttcaagcgattctcctgcctcagcctcccgagtagctgggattacaggcgcccaccaccacacccaactaattttttgtgtttttagtagagatagggtttcaccatgtaggccaggctggtctcgaactcctgacctcaggtgattcacctaccttggcctcccaaagtgctgggattacaggcatgagccaccgcgccgggccctcaaatgtaatttatttatttttaattaaatctaggtcacatagtaagcattctctaaaaaaagtcataatttcaagttaatgtcatttatttctttcagttgtagcattcatttgaagaaaactaccaaaatctcatgtatatatctagataaaaatttaaattcttgggaagataatccatgtttttcaatgatggatattgtaaaatacatcaaatttcccaaaataattcatggacttaatatagtttctataacaatcaaaaggatttgagataatttttttcattataaaatgcatcagaatgactagatgaactagaataacaaagaaaaaagtaaaaatcaaagatgtttatcaaagtgtaatttagaatgggggagaaattagaaagggcttacatgttcaaaaaaaaaaaaaggaaaaaaatgaatatttaaaccgtaggcctggcactgtggctcatgcttgtaattctggcactttgggaggccaaggtaggaggatcatttgaggcc

SEQ ID NO: 26357 - DNA, 1048 bp, Homo sapiens
atctatgacaaccagttcataagtttaatttccatttagcaagatgttgaagtgagtttaggccaggcgtcgtggctcacacctgtaatcccagcactttgggaggccgtgatgagcagatcgcctggggtcaggggttcaagaccagcctggccaacatggtgaaacccggtctctactaaaaatacaaaaattagctgggcatggtgacgggcacctataatcctagctactcaggaagctgaggcaggagaatcacttgaacccaggaggtggaggttgcagtgagccaggtttagttgaactagctaagaggcaagcggcaataaaatgtattcagtgaccctcttatagaatatattctaagtgaaatacatctctgtacatttgtcagtaacagtgaaacagctttttgctaaataggtcactaggcttttgaaagcagaagattatgccatttgttttgattggatgaaccagacgtttcactaaaccacataatgtgaaaaaaatgcaagtctttttctatagtttaaatgtagacatcttgaaaatgagtaagtaatctaataaattataaagacctttgaaatggttttattgttttatgagaaactattgatttgtaactttgaatgtaagttataaaataatgttacttaaatatgaccagtttacatgaatgtttttatctgatctgcagaaattcaagattatttaaatatcattctttagagtgaaagaaatgtaatcattccattaacagtgttttcacagggtactactgtgtaaatgcagaaggggtgagccctttgatatgggagaagtaattgaaattctcgtaatgagactaagaagacaccttcttcacctaactcagttattcacagctaacttagtggtttgaggtcacatgttttactaaacacctacctagtcataggatagctattttttaaaaatataataagccaggacctaaagataagaagtcacttcttttgaccagagaagtggacaaaagttagtctaaagtagagataattac

SEQ ID NO: 26358 - DNA, 1033 bp, Homo sapiens
tctgggtgttaaacagatgaacattttttattttaatagctatacaatataaccagcaaataaaatccatgttttcatggatattattgcttagagttagttaagttttaaaatgtgatttaaaggaaaatattaagtactagtacaagagatacccagtatgacagaaatgatagtagaaggcaaaagacaagtttaagaaatgctggtttgtgtcagcagtgggcagaaaattggggactcggggctgccatgagaatgataggtgtttgatcaccacagctataggagttctttgaaagtagatctggacattttgaaatagtcaaggggaggtgtcctcagggatgtcataactgttgacctcaagaccaatgcatcagttagaaaaacattttaaggatgctcagcactgctatgtatcacagggtccctccataggacatacatacttgatctgctagcgtttttgtcatacgttagaatgaatgaatatgtgttggaatgtcttgacacagttaacctgaacacatacagctggaatccccctgttgcagttgttattatatgtaatataatagcaattgcagacagcttggattctttctcacagatattccttttgttcaattagaaattctacataattctggccgagcacagtggatcacttgaggtcaggaattcaagaccagcctggccaacatggtgaaaccccgtctttacttaaaatacaaaaattagccaggcgtggtggcgggcacctgtaatcccagctactcgggaggcagaggttgcagtgatccaagatcacgccattgcactctagcctgggcgacaagaaagaaattccatctcaaaaaaaaaaaaaaaggaaaaagaaattctgcgtaaatctggccaggcatggtggctcatgcctgtaatcccagcactttgggaggctgaggcgggtggatcacttgaggtcaggagttcaagaccagcctggccaacatggcgaaaccccgtctctactaaaaatacaaaaaaa

SEQ ID NO: 26359 - DNA, 1035 bp, Homo sapiens
ggaatcaatgaagaagtgggtggttaatttttcttatatcccaataatgaggcaaggctttgaggggtggaggagggaaagaaccattaatatctgttcattctttgtcttctttccatctctcttttaacgctaacttctctctggccgcactttgtgtttctaccattatctgattttcgggcataatattaacgtacacacatcctactcaattaaaagtaaacatggcttctaaaagtattttttgtgctcttcaaaatattagtaaaatttatttttttcttttctttttttttttttttaggaaggaagagctactgttaaccaggatacaagattagacaacagagtcattgatcttagggtatgcctcatttatttattaagtgaagcaattatgccgcattagagaggggcagggataccatacctgtctcaggcttataaagctaaatggtatttgcctgactgtaagtatgataatacaggaaacaatttccttttctgactgacccttcccctaaaaagaattgcaggcaacaggagcggttaaatactagttaacaggatattgactttctttgttttaaaatgacaaatgaatttgaagccagtaaatgatcttgcttccaggtgatatcttttttagacaagttattcagcaagtagaaacataacctttaatatcactacaaagttatgaaaaaaattacatgcacatttgagatcaaccaggtggagatgagtaattaatgcttcaatcctttgaatttgattggagcaccaaattaaaaatatagaagcagttggctctggtggtttatgcagtagtctcatgggtcttctgtttccctttctggtttggttgcaagtgaaagagagtttagtggtttcatcattgttgtagtaaaaccattgcatctttcttaatattttgaccacatcttccttttttacttaaatattctactcaagctcaaattttttgtcaccttaagagttcttcttggctattctaccatcatgtgagtc

SEQ ID NO: 26360 - DNA, 1045 bp, Homo sapiens
tgtaaaatactgaggtttataaattagttactgaatcaattagcttttgttatataacaaatcaccccagtacttagtgacttgaaacaacaaacatttatttgcttacaattctgtgatgcacccaactgagatggctcatctgctccatgcaacattggctgggctcactgataaatctggcacatctctttctgtggcttcctctcatccagcaggctagcccagatatgttgatattcaggtaccaggagggttcccaaaggcaagagtgcgaaaccctaagaacagacacttttcaagcttctacttgtgtcacatctgctaaatattccactcgtcaaagtcacacagcaaaacttagatttaaggggtagagaaatagattctagcccttgatgggaggaaaagcaacatgattgcaggggaatatacatgcaggagcaagaggaagtattgcagccatttttgcaaacagtctaccacagccacatagggaaaaatacaaaacacatctgaaaaactactcaccaatataagtgaataataatggacctatcttgctataagttttttgatgatgtacttttattttattttatttttcagtttccatttttacttttcctttatttttatactttaagttctaggatacatgtgcacaacgtgcaggtttgctacatatgtatacatgcgccatgttggtgtgctgcacccattaactcgtcatttacattaggtatatctcctgatgctgtccctcccccctccccccaccccactacaggccctgatgtgtgatgttccccttcctgtgtccaagtgatctcattgttcaattcccacctatgagtgagaacatgcggtgtttggttttctgcccttgtgatagtttgctgagaatgatggtttccagcttcatccacgtccctacaaaggacatgaactcatccttttttatggctgcatagtattccatggtgtatatgtgccacattttcttaatccagtctatcattgatggacatttgggttggtatca

SEQ ID NO: 26361 - DNA, 1079 bp, Homo sapiens
tgagaaatataaaagtctgaggtctagtgtggtactaattcactataattgaaagaagtgcttgacctataaatgaagcttatgcttaccttagaattgaaacatatggctgggcgtggtggctcacacttataatcccagcactttgggaagccaaagcaggcagatcacttgagcccagaagttcaaaaccagcctgggcaatatggtgaaacatcatctctaccaaaaaagtcagaataattagccaggcatggtggtgtgagcctgtagtccccagctacctgggaggcgaaggttgcagtgagctgagattgtgccacagcactccagcttgtgtgacagagcgagaccctgtctaaaaaaaaaaaaaaaaaaaaaaaaaaaaaaaagatttttattttcaaaaggtggtggttttattattttttgaagtacttacctaatttatttttgttcttttgatgctgttttaattagcaaatacgtggtttcttgtgtttgggcattttgtacttctttgcctcagtgaattgtacatttaatttataacattgaagcattttatgttggtgcattatttgaagaactggtgtgtgacaactttatggcatgcctcttttctaactaatcttttttcaccccccttgcaaagatttaaaaattactcatttgaatgtgggtggttatgtagatctgtaagtatatttatcattgagtatatagtaagatttaacacattatttctgacaaccagaaagctaaaaaatgtatcggttttgctgaaaatctttaatagtcaagtttctgtgttaaaaattttagtagtttttgttgatataaggatatataaatacgcaaatggaaaaacttaatgtacatagtgtctctttcaccattattgacttttttttttttttttggtggtggtaataaatggaaatagtttagaaaaatatgagccgatgactacccaaaaataaaatttggtcatcccccagtctctaccaactgccaagtttatccctactgttaacaagacaatcagaatacatcaatatataggatttctgttatat

SEQ ID NO: 26362 - DNA, 1037 bp, Homo sapiens
tatccttcaactttactgattactgaatttatccgttctgataggttttgctggagtctttaggtttttccaaatataagatcatagcatccacaaaaaaggataattttacttcttcctttccaatttggatgccctttatttttttctcttatctgattgctctagctaagatttctagtcctatgttgaataacagtggtgaaaatgagcatccttgtcgtgttccagatctaagagaaaaggatttcagtttttcctcattcagtacaatactagctgtgtgtctgtcgtatatggcttttattatgttaaggtatgttccttctatgcccagtttttggggggtttttatcatgaagggatttgaactttatcagctgcttttttagcatcagttggaaatgatcatatcgcttttgtccttcatcctgttgatacaatgtattacattgattgatttgtatattttgaacctccttgcatccctgagataaatcccacttggtcacgatgaatgatctttttaccgtattgttgaatttggtttgctagtattttgttgaggatttttgcatcagtatttatcagagatagtggtctgtagttttctttttctgatctatctttggttttggtgccagggtaatactggcctcttagaatgagtttggaagtattttctcttcctctgttttttggaacagtttgagtaggattggtgtgagtcctttaaatgtttagtagaattcagcagtaaagccatcaggtcctgggcttttctttattgggagactttttattacggctttaatcttgttgtttgttactggtctgctcagattttggatttcttcatggttcaatcttggtaggttgtatgtgtctagaaatgtccatttcttctagattttccaacttattggcatatattgcttatagtagccactaatcttttgaatttctatggtatcagttgtaatgtctcctttttcatctctaattttatttatttaggtcttttctcttttttcctt

SEQ ID NO: 26363 - DNA, 1075 bp, Homo sapiens
tgggccattcagtatgttgagaaatcagtttgttcttcttgcattatgctcagatgactttcatatttttacaacactaaagtaagcaaataaaaaataaaatttcacttaaatcaacttttaaaaagtaataacataatggcctaatggttctcctaaagaatatttcactgaattaaactcatttctattcttttttccactttatttagcgaaagaagatctcacatctctctctctcgggtccattggaattcatcctcttttgaaaattttctagaggagtagattttatgacctttccttgttactgacttctgcatgaagaactcatactctcaatgctctttcaaaatttctgtgggagtagactagtgcttggggctgcagatacatggagcacctgggaagtgagttgtggggaagtgacctttgtttcactagagccttaagaaggtctttaggtgttactagtgatatacattgggtgggcaagcaggtaagtggccagagtctccaggactgttgtgagaatatgttaaaaatatacaaataaaaactcaagtatgtggcacaaaagttgcccaatagatccatgggcccctcactttgatcactgttggcattgtgggttcaaaggccagagttgctgtccccctagtgctagggaatcgattgctctgtgcagtaactcttaatggcataaagtaatttgtacctgttgcctattgcatctttttctccattgtgacatcctcacattgtgtcctctacatccctgtttgataggttggaacatcttctactttgtccttcttgatgccttctttgtatgaagttttctgttaggttcatcaaatctgatcatcttattttaaccttaaaaaaaacctggctgggtgcggtggctcatgcctgtaatcccagtactttaggaggccgaggtgggaggatcacttgaggtcaggagttcgagaccagcctggccaacatggtgaaatcccgtctctactaaaaataaaaaaaaattagctgggcatggtggcgtgcggctctaatcccagctacttgggag

SEQ ID NO: 26364 - DNA, 1035 bp, Homo sapiens
ttattataaataggacactattaacacagaaatagggattaatgagaaaagtagcagaggtcatataaaagttgctctagaacatgattttaaataaattggtaacttatgttcttgactcttaaaaaactgattatattaataaagaatgggaagtatacatttgaagatctgtggaatgttgaacaaaaatacttatctgaattttactccatattttgtagggtaatcacagggttaaatttttggaggatgtacccataaattttatgggttacaactcttaacccaaaattactaagtaacaacaaacatcaacaaactatttttgaagctttcgttacaagataatgcatatttcttttaaagtatgaagccataaaaagaacgagattatgtcctttgcaggaacatggatggagctggaggccattatccttagcaaactaaagcaggaacagaaaaccaaatatcacatgttcacacttataagtgggagctaagtgatgagaacacatggacacatggatagcatcacacactggggcctattggagtggagggtgggagtgttagcagcagcaaatatgtatgggtctgcagcaaccacaatccttgccttctcagaagaaaaaattcaactgaggggcataaagcagaaggagacaccaaggcaaggtttatagcaagagcaaaagtttattaaaaagctctaaagcagaaacaaaaggaaggaaatacagttggaagaaggccaagcaagcaacttgaaagacaagtgtgcagtctgatctttgacttacggttttatatgttggcatgcttccagggggtcgtgtcccttctcccctgattcttcccttggggtgtgctgtttgcatgcacagtagcctgccagcacccgtgaggagctgcaagtgcagtgtgtttactgaagttgtgcagatgctcacttgaggcattcttctcttaccagtccagtgttcctagaggaaggtcatataccagttaaattctacctttttgcctcttagt

SEQ ID NO: 26365 - DNA, 1018 bp, Homo sapiens
actaatgttccaaaaacaattttttgaaaatcctagcttagcatttcaaatctaccaactactacttacacttacagcttcttattcttgtgagctaaggagacatcaaataatggccagttttctcaaagtttggactctttaccatcttatcagaatcatctcagtatatttgttaaaaatgcaaattactgggctctgactcaggtctgttaaattggaataactgacaactcaattgggaggtaggacttggaatcagaattttagtatcgtccaatgttgaagtcttatttacatgaaaccccaagaactcaagagaggaattttatgtcttgccctttcagagtctgctgctgaaatcattctcaaaagtttgcggttttcttgtggtctctattttctttccaagtagtatactaaagaagtagaaagttactcagactcttactacttggagaggagaacaacacaaaactcagtgattaatatttcccactcagtaggtgctaactttccactgtgctcttaaagaaaaaaacatttcttcctcccaagtgatgttttcaggggcatttgctggttatgtgttacttgaaaattaaatatagtgattccttccagccactcattaaatttgaaacaattacacactgactctgtgagcaggtagtagaaaaaacttatttctaaaataatatttataaaaatcttgtttgatcatgctttttgaaatttagatttaacttggttttatttgacatctctggatttagagagaataatggaataattttaactttttaaatctagactaaatattttggttccaaaagcctttccaagtaacataagtaagatggagtgttttccctcttagtatttttgtgtctgtgtgtgaagcctcacaaatttaatttctactcagtatagaaaatgagatattattgttagccatgcaattataataaaacctgcttaaatgtttttttaaacaaatcttttgttttcatacttt

SEQ ID NO: 26366 - DNA, 1021 bp, Homo sapiens
cttggaagcagcccaccaccatcttgggagctctgggagcaaggacccctctccttccccccaccgccccaccccaccccacccggccccaccgtaacattatcatctttgttttgaggttaagctataaactaaattcctcccatagttagcttggcctacactcaggaatgagcaagggcagcttaaaggtcacaagcaagatgaaattaggtcacattactttcactgtcacaatttttgccgaggtggttagatacagagtcttacagctaataggagagtagtaacaaagtctctatgcaaatttgaggcacacagattatatgaatcaacttgtataaacaaatggaaaaagggcatattacagcaagttgtatccataaactaaagaacctgtagatacagagtgtaggtttcatccttcatattgaatgctttacagtctacatttttaggactcatgtatgttattttccctctgtgtaatttcctgcctgatcagtatctctggcctcttgaagtcttggtagaagtactgaagaaatgcaaacaaccctgctttctgaaagtgaagtgataagttacttactatttattttgatgaagctggtctagggaaaaagtgcttcagaaatgtgtactctatgggatacacaggcaacaatgtgtatgtgatgtgtgtgtgtttgtgtgtgcatatgtattgcatatatggcatacttttcttaccctaaaactcgtggttaaacttttgttaaaataaagacatcaagtttgtgaagaaatatgatatatgctgaagatctgtaaaactgaaaagaaaaaaataaaaagagtgctgcagcgaatcagccaaaaagcgaagaaacatgtgaatcttagtctaggactccactgacttgaagacagtattcatgtatgttaggcctttagtaacactctgcctaaagaaaagaaggcccagaagactgagtctggaaatacagaagagggatacgttttgcatagcatggtttta

SEQ ID NO: 26367 - DNA, 1021 bp, Homo sapiens
gtgacggggcagcactaaggtccaaggaaaagtcccacagtcactgcagtctctctccccacaacacacatattctctctatgccagggcatgggagaggagttgcattggtgatccaaggctgtctttcctaccctcttcagtgcctctttcagtgatagaaagttaaagccaggtactgtgattactcacctaatttttggttcttatgaaggtgattttttgtgtagatagttgttaaatttggtgttcctgtcaggggtgatgatcagtagaagtttatatttggtcaggccatattactccacctcctttctccagagcataaatttttagttttaataaaatccagttatttctttcctagattgtgcctttgttgttatatataaaaagttattgccaaattctaggttatctattttttctcctttgttatcttgtaagggttttatagttttgcattttacatttaagtctatgatccattttgagttaatttttgtataggatgtaagatttgtgtctaaatttattttttttcttgcatgtggaagtccagctgccccagtaccatttattgaaaaagactatcttttctttttaaatgtcttcgttcctttgtcaaatttccattgactatattcacatggatctatttctgggctttctaccctgttttgtctattctcttgccaataccatgctgtcttgtttactgtaactttacagtaattcttgaaattggttaatatcaggcctccaacattgttctttaccattaacattgtgttggctattctgggtcttttgcctctccatataaacttcagaattagtttgtgtttatccacaaaataacttgctagaattttgattaggattacattgattctatagatcaagtcaggaaaaactgacatattaacaatattgagtctttccatccgtagacatagaatatctctttatttacttagtttcttaatttcatttgtagagttttctaatcctaatatat

SEQ ID NO: 26368 - DNA, 1044 bp, Homo sapiens
ttaatttacattgccctgattatgacattgcttatttgctccttgtatatcttcatttatgatgtgtcttttagggtctatggctcatttttaaatcaggttttttattattgttgagttttatgtgttctttgcatgttttggataagagtctttcatcagatatgttatttacaaatacttccttttggttttaggcttctctttttattctattgacaatgtttatcacagagaagttttttaagtttttattttttgtgagtgcacagtaggtatatatattgatggggtacatgagatattttgatacaggcatgcaatgtgtaataatcacatcagggtaaatgaggtatccatcatatcgagcatttatcctttgtattacaaacaaaccaattatactcttagttattttaaaatgtacaattaaattattattgactatagtcacctttgtgctatatttgactatttgactatatttgactattattgactgtagtcacccttgtgctatattcttgtatttgtgctaccaaatactagatcttattcattctctctatttattatacccattaaccatttatgctagcccccacccccactacccttcccagcccctgataaccattattctactctctatctccactagtccagttgttttaaatttagcttccaaaatgagtggaacatgtgaagtttgtctttctgtgtctggcttatttcacttgacataatgaccttcagttccatccatgttgttgcaaatgacaggatctcatttttttaatggctgaaatgtgtatataatcatccactgtgtatatgtaccacattttctttatccattcactggttgatggacagttaggttgcttccaaatcttggtggttgtgaagtgctgcaataaacatggaaatgcagatatcacttttatatactcatttcctttattttgagtacctagcaataggattgatggatcatatggtcgctctgtttttcctttttttttttttgagtaacctccaact

SEQ ID NO: 26369 - DNA, 1031 bp, Homo sapiens
ggtgaaagtgtaacctcccaaatgtatgggcagataatattttgactaataatacaatcacttttatttcaacatgtttcacaagcaacttgataacagagtcagttttatgcctgtgctctaactatatttgaactgacctactagaacccaaatttcatgatgccagagtctaccttttgtccaattaaaaacttgcttcctatgattaagtattaattaaattaaaaaatgtatatatgtgtcttttgaaaacaatagttcattcaaggaattccattattaataactcctgcttagtgattaaagtgttaatattaaatttttttctgaaaaatatttgtctacagaatataacaggaaactgactttttaaaacaaatttcctagtcattatttgaaaaagaaaatttcaaaattcaagatatgcaattgcctgaaggtatagacttagaaatttaacatttaaaaacattttcttcattttctaagcttatatttcataactgtacaaattcttagctattctactattacttgtggatttgcttaaaagaaagctctttagtgtttagtcaaacaatagacaaaacttttagcatgaaacattattttatggtagactcagcaagctgaactagtaatatattctcttatttactgaaacatttgttttatatttattatttttgtataaggtaatacactaatttgtgatgaacttttaattatacattatttgtaaaattacttttttcctatgtagcaaattttaaaatagccagagtaagccatggaaataagccaatgtcaaagtttgaaggtcaaagtagtatgatctagtagaaagaactgtgcctttgagtgaagtagattgaataactgatgcaaagttttccttggctctggtaaaataattgattcattcctttgctatggcttcattttagcattttagagtgtgcttcctgcctccttgacttgggtgtgctttagccaaagggaaattagcaagtatgatgtaatcagag

SEQ ID NO: 26370 - DNA, 1069 bp, Homo sapiens
tttaaacgatttgtgctataaaatagtatacagtcagctatgtaatgttttactattgattacctagtattcagttacagggatttttaatttttatttatctttttcctcacaacttttgacattttcctggtcactaatgcctgcaggagacagtgaggcgaactcaagttaatcaagtcactgttcagtttttagtgcctttatgaggagcaggactttaaaactattgactaaaattaggctttctgggttatttatggattttatttaacatatttctttcccttctgcatatgcagtttgagagcagactgcatatattgtatttacactgaagagaaagttgaacaaatcaattcatggagataagagaaaatacacatgtaaaacaaatattgtcacagaaacaatagtcttatttcttgttgaaaattatgacggaattcacgaaatagaaggatgatagcttatctgtattttgtacttttttagtggggcatgaaagagctggtgtaaatggatcatagctttaaaatagaactgagggtatgaataatatttaaggaaacttgaagtcagtatgtctaaatagagaatcactgacaattatgtacttaatggtcagcatatcatttaatcacagatgctcttgacattgtttatgaaaatgagtcatgtagtaatttgtcaaggtcaagagtttgagccctgggccctataaggggtatgagtttgaatttaccctccacccttcactcacacctatgagctatttattcattattctctgctattctactatatgcacagttgctctcatttatatatcattccgtatatgctttttgttgttgtgttgttttatggcgctaaatgatctttggaagttgtatttgccatgatatttgtaggtaaggaatctaaaattatcatgacatatactacttgagtgtcaaggtgtatgcatatatatatttttatttatatatttgtatgtcttaccttgggctgctatagcaaattaacataggctgagaggctttaaaaacatcagaaatttatttct

SEQ ID NO: 26371 - DNA, 1150 bp, Homo sapiens
gagcttagctttctttcctttgagtgtgggtactgtctcatttttaattaagagtataaggcggaagtgatgatatgtggctttggggacaaagtcataaaaagcatgagcttctttgccctctcttggatcactgtccttaggcaaagccagctgacatgttatgaggacactcaagcagcccagtgaagaagtacacgtgggaagaaaggcagtcaagattttagcacaagccaacagctataaagtaacctcaagggatactccaaaccagaaccacccacatggctgctcccagattctagacccacagaaaccatgtgagacaataaatgttttatggtgctaagttttgtagtcactttttgcactgctatagatattaattcatatgtttacccacagggcagtcatttatttatgaatagacttagaagttcaaatcttaatagagttaagcaggttatgaatgagtaaagtatgtcaggggtgataaaaccaaatagctctaacataaatgttaagtaggatctgagtctaggctgcaatatctgaactagcttgggagtggcaggaattatgatggagtgggaaaaatgaaagtcccacttatggtagaacacctctcagctccacttatttttgccataaggaatattaaccatttgtgacatatcttttatttttgaggagaaggaagaaatacagatatttatttaaaatctcacaatttttaattattagcaagtaatcttttttaaaatttttttttaaaaaaataccatgcaaactaacctactatataggctagctatgaaagctgtgaaggctaacactataaaagccaaacactctacaaaaaaacaacaacaaaaatctctacaataaccttctgttgttgcttcagcacagagggcagcaggtgtcacctctggtttggtcatcatttatactggtgacattgagttactgagagaaaaggatggaattaaggcagccaacacccaactgtaccactagaggggactttagtagaaaaaaaaaagtcacctggtagagctggtatagtatacagaggagaataagccccttctgtggagaacaggatacaggattttctacgaaggttttctagtggtgtttgaacaga

SEQ ID NO: 26372 - DNA, 1049 bp, Homo sapiens
gagcgttctcaggcagacaatttaatgtgggagctggggtcattcaagggacgtagacttaagctgttggacaatgtgctagggattgttcaagtctgttagtatgtatttgtggcccaggggcttggggaggggggcggtggaggtgagggcagcaggatgaaatcatttgtgctgagagtctgcagtttttattggccaaggctgaagtctagtcagaagaggacttagaggatcctgactagtgtttggtcaaggacagagtctttgtcaggtaataaaaagttttaaaagaagttgcaggattaatgacaggtttagggctaagaatcaacaggttctaatcatgcaaatattggcattatatattcaatttcagatttcaatgtgaatttcatttaacctaaaatctgtgacttcattccacagataggattagaaagagacacttcagtactgagaaaaccgtgacacttgaaataagctaaaagcattgtaacaatttttttttctttacctcctgggcacaatgacatttctttacagtaattctctggaaaaagaatgtcagttgaactaaaatggggcaaatactttgaaatgactgctgttttaagatgcttatgattatgggtgaacaaacatatttggaggaaccaagagctgaatctattttttttcttcaaaataataccaaacttgaattgaattgttagagaaaacagttcatacaatcattttccttttcttattactgtagcttctttgatggtgacaaattatatgaagaagagttgacccatataaagcttttaaaaatgtagaaatgtttttaaaagccttacatttcaggccaattttcatactggatacattttcatagacaaccagaaatatttgcattatataaatattgcttcaatttactgattattagacaatagtctttttagcacatctcaaaacatacacaattaaatagggtttgaaatccacttgaaaatatttttaaagccaagaaagacaaagcttctttcagccttatttct

SEQ ID NO: 26373 - DNA, 1035 bp, Homo sapiens
tttataagatgctggtatgtagtcagtcaataactagtattatctttaggtacatttaaaaaatgtatattacacctgaacattgcataatctggaaaagataattaataagaagtcagtgaaagactgtttcgaaaggaggaataatttgcagtgaaacatttacatagacgacaatgccagtcatggtggctcatgcctgtaatcccagtactttgggaggttgaggcagtggatcacctgaggtcaagagtttgagaccagcctgaccaacatggtgaaaccccatctctactaaaaatacaaaattagctgggcatagtggcacatgcctgtaatcccagttacttgggaggctgaggcaggagaattgcttgaacctgggaggcggaggttgtagtgaatggagattgcaccattgcactccagcctgggcaacaagagtgcaactccatcacaaaacaaaacaaaacaaaaataacaatgaacattgatctctttgtgtttctcactgttactgttgaatcatgctggctaaacaataattatttttttcttctagaaacaataaaaaaattctataaattccgtctatacatgttagtcgccaaaatgtttgatatcatttgatattctcttatgaaagggcatgtacatatgtctggagtggggagttggggtgttgatgttataaatgtaaatagaaggacaacctctcttgctaaaatgaggcatttacctgaatttgagtttctgacaggcaccgatagcattcacctaaatttagggatctaaaaggcactaatatacaaatgtatctttaaagtttgcttttaacagttttgcaattaaactttcaattagtcacagaaaccttctttttatatatatatatatatatatatatattatataaatataaatatatgtatatatatatagagagagagagagcagagcaatgacttgaatctaaagaaaatatcaaagctcaaacaataagagcactttaagaccagggcaagaaatattcaa

SEQ ID NO: 26374 - DNA, 1053 bp, Homo sapiens
gggcagaaggttaatgtctcattttcttagaggttgaatgtactgaatattagatttttaaatttagtttgataactttttttatatattcagagctaatttccactttattttttgactgttttttagtgttaaaatctaacagttggaaataattttaaaatttacatggaaaatttcccaaccgatgaagtatcatcagtttcaaaagttttcagatgcttaggatgatttatttttttcttagcaaaacttagaatattgattaatatgctcctaagtttatagaagagagataaaatttaaattagcttattatagagtcaaaaaagatgtaatgttatttttaaagattagatctcatcatatctgagtccccattttattgtttactcatttgaaccaaaacttgagttgattctctgtttaaatgccttgattcttgtctacagtacatcttctacactgcagtacatccactaaacagttattatctatctaaggacaaaagcatatttcggacaacgttcgtgctgattcttgaaacataaatgtgagttctcactatcttgttaggcaacaaagagaagaaacttacgaaggagtggctgacatgaacaaaatcttgttaactgaatcctaaaatagtggaaatatttagagacacatttctgataaacacaagaaagtactcctttgcaaaatgaaacaatgtatgagaaatgtttaaaccttatgctgaatatatgctaacaatatgaggagattaaaataacggtttaggtacattcatggatggtaagggaaagtgagataggaaattggtaatagagtgtagtacaaagagtgctggatggggagcttcatgaaatgaattctaagacctgtttttccttaaggagatacatgtatcattaggcaagtctaatttctctcagtttcagttgccttatagctaaaatgattggacataattagtccattttttaagcagagaaatatatttttgttattcatatatttttctccaaaataaaatagtgctcaaaacta

SEQ ID NO: 26375 - DNA, 1035 bp, Homo sapiens
ttctctttccagatccctaggcaacattcaagtttcttgactgtggagattgcatcttctgttgaattaatttagtttatcataaacagagagttttagagtcacatgactagttttgtagattggcatgtaaatgctattattctaaaacactaggaagaatccgtgtgcaagtttttcagttttctaagttttaaagttccaactgaatttttttttatttttaaagttcaaaatttaaaacttagtcaactaaaaaagaatatacatttgtacctctaagaccaattatctgggtcccaaaattcctttcacatgtgctgacattgatacaccatttagtattcaaatcataggcattctaatgaccatactattgcattgtagacactttgaagctgggtgattctacccctgttggctatgcaaagggaaatggatgccctggggaaaatttcaagatttcaaaagattttttttaacatatttcaacagttgaaatgataaaaagactgccagaatttctattatgggcctgatttatagggtttactatcgaagcaggtttaaattacaacaacttgccaatagcaaagaaaatttatttaaaacaaaggtgaacccatttttcataatctcttaagactaaaatggtcttattttaccagaaaagtcctgaaagtttacacaattatttaaacatgtgtttttaaaagttttactggatgcaattttaaagtaaaaattgaactttatatgagatgatttcttattatgcagttaacaaatagagaacattttgagcaacgtgtggaatttactgatagttgagatttatattttatttactatctgatttttaaatgtagtaactttaatttagaaattaagtcagggacatagtatacccaacctaaggcatgttacattactttttgcaaatctaataattaagacaaacaatgagcatcatataatagatacagattaggtatatcaaataagataaaattactagtccatatctctaaaagt

SEQ ID NO: 26376 - DNA, 1071 bp, Homo sapiens
gttatataacctaatattttattcaatttgttgatgacattatcatcttaatatggacctatatcatctttttaaaacactgtataaaatttccttgtatgagagaaccacagtttaatcagcatattttctattgctgaatactttggtggttttgttttcttttattagtgttacaaggaaaatccatgaaaatacattattaaccactcctttaatgttttctataggattgtgccctacaatggggatggtattaaaaagacgtgtaatagtaaatttagcttaacacataacagtttgggataagctaaggaatgttcttgggtgtcggaagccatatgtcttcattttgaagtctgcaatgaagcatctatagtatgataggttggttttaaatgatctaaaagcctgcttatacgttttttctctctcctagaatatatttttcactttgactctccacattttctctagtccatctaccttttctttttctacataactcaaattcctctacagtgaactcagtgcatctatctaatctctaatcataatatccaactatgtatactttgttttttcttgccaagcattctctcttctcaagttattgtgtggcttaatccttcttttattctgctaaaatatcacctcctcagatacactatccttggccacccaatttaataattacatctcccctcgcataattatttttaatcatataattgagattttttatggccttattactatctaaaattattttattcatttatttgtttgcattgttggtttgacttgtaggatgtaagttccataacagtaggaacattgtctttctttggcactactgtatccatagatacaggatacagatgtacatattttccacatagtagacatattaaaatatttcttggatgaatgaataattttcaggagtgtgttacgggccagggttttatactctgtggaaggagaggagaagggaactgattcgtattgaacgtctcttatgtatgtactagagctttatatacactgcctcatctgaatctcataata

SEQ ID NO: 26377 - DNA, 1045 bp, Homo sapiens
aaaataatggaaagacctcctatgttcatggatcagaagacttgatactgtgaaaatgtccatactattcaaagtgatctacagattcagtggaattcctctcaaaatcctaatggcattttttacagaaatagaaaaaaaaaattctaaaattcatatggaaccccagtggatcccaaagagcctaaatcaccttggggaagatggacaaagatggagtactttcatttcctctttttaaaacacattaattacagagctacagaaatcaaagctgtgtagtactgctatgaaggcagccattacttcaatggaacagaacacagagcccagaaataaacccacacatactcaaatgatctttgacaagagtgcccaaactggacaatgaggaaagggtagcctcttcaacaaatgatgttgagtaactgggtatccacatgcaaaaaaaaaaaaaaatattgtgctctgttttacactacacaaaaatcaactccaaatggatgaaagacttaaatgtaagctctgaaatgtaaaatttaaagaaaagaatgtagggcaaaagggttataacattgatattcatgattttttgaatataataccaaaagcacaggcaacaaaagcaaaaatagacaagtgagattacatcaaactaaaaatctgcttttcaaccaaggaaacaatcaacagagtgaaacctaaacagtgggagaaaatatttgaaaaccatatatctgataaagggttaatgtccaaaatatataagaaactcatacaactcaatagcaaacaacaactaaaaacctgattttaaaaaatgggcaaaggacttgcataggcatttcttcatctttgtccagtgaagacatacaaatgactaatagagttatgaaaagatgtacaatatcattcatcatcaagaaaatacaaatcaaaaccacaatgatgtattacctcatagctataaggaaggccattgtcaataaaatgacagcaaataaaactttaaaatgatgtgctggcaaggatgtagagaaattga

SEQ ID NO: 26378 - DNA, 1051 bp, Homo sapiens
taggccaggcacagtggctcacacctgtaatcccagcactttgggaggctgaggcgagcagatggcttgagttcatgagttcgagacctggaaaacatggaaaaaacctgtctctacaaaaaatacaaaatttagccaggagtggtggtgcttgcctgtagtcctagctacttggggggctgaggtgggaggatggcttgagcctgggaggtggaggttgcagtgagcccagattgtgccactgcactccagcctgggcgatagagccagactttgtcaccttgtctcaaaaaaaaaaaaaaaagtcatgctgtgctgtagcaaaaaactggcaaatacctagataaatgtccataaaggatagctcctggggagccagtgagggctacctgcggcctgaggaaagccagattaatggagtttaagggaagaaaagaagatactgatgtagccatctctttctgtccctcctgcccagtttcttccttatttttttttccattttttccccatttctttccctttttctctcccctcacactccctagccactgcatatcccacactttttcagtctttattttctcagttttatgccttcaaatacaagcttacacttgagcctttttttaaaaacttgtctgaatttcaaagtcagcaattatttcacatttctggtcagccaaccctactttaacattgattttaactgtgttttgtcaatgtgtatactttctttctgttttatttaatatattgagactgccaagctacattaaataagtcaagccatgttaaattgtacttattctccttctgatggtaaatttcctatcttttttttgtttcctttccttagcccactgatatttgcacaaataaacccaaaaccttttttttattgctattgatttttgttttattttgaaggagttttagttttccttttaatttcaaattccatcaggtgattacttctaacactttttacacccccaaataaatccctatcagtgagatctcaattaagaaagccattcttaccacatgg

SEQ ID NO: 26379 - DNA, 1035 bp, Homo sapiens
atcccttgagggcacgacagctctatgctgtgtagtagaggaaaccttgaaccttggggtcaagaaactgagtttaaagctctagctactctaaccttattaccttaagaaagacagatcattgaatcattaactgagggtctaatgagtactagactctattctccactctctatcttaaatttaaaaagttcttattctatggagcttgtgtgtatgtttgtgtggggtgtgtgtgtgtgtgtgtgtgtgtgtgtgtgtttagacaaggaaggtatgttgcaaggggaaagatgggataatagaaatacaagtaaatgtataatgtaaggatggtgaaaatactaaaaagaaataagtcaggataatggaagaaatcagtaactgagcaggcaacatgatggaaatgttattttagataaggtggttctagaaggcctctctgaaaaggttgcttttgagcacagagagtgctgtattcagtgagcttcagaatctttaatgcatcagggataagagttctggaagaaggatttcatgaataggggaaggactttagattttactcaaggcttattttcctctttcataaaatgaaaagtatgttttacctacccaacacacctgctggtaaaaggaaaaaggtgtgcgataatatttgtaaacataaaatacagcctaaatccaaggaacttaggattttaaaaaatcattgttttgctgagattggaactggaagatataaatgctcaaatggaaattctttcttttgagagagacggcatttttgtgtaaaaaagggttttaggaatagtaatgcatggagttattaaatttcgtatgtatttctgcacatacgtatatgtgtatatatatagaaatatcatcaaatgactgtggggggtgtgtgtgtgtgtgtgtgtgtgtgtgtgtgtgtgtgtgtctgtattgccgaactcataacctaggactatgtttttaatgaagcaattttctaacatgaattcattatcttttgctttatggttgagattt

SEQ ID NO: 26380 - DNA, 1050 bp, Homo sapiens
tctgtttaagggcaagttctttctccgtcccctcagacctcaaaatacatacatgcccataagagcatgaatattgactcacatatagcaaacactcaggactttgatttggaccttttgcaagcactggttttctgattctcattgcagtaggggccacagcatgtcttcactttccttcttgaaaaatagcctagatgtcctattaaactgctaataaatagcttgtaggttcttgttttattttgttttaagccttaaaataaaataattaggatagagaaaatactgatgactattaaagttaattacttgtatacatgggagtttttataccactctctactttttagagtgtttaaaattttacattggaaaagtaaaataaaaagtgacaaaaagtaaacttggtattaattacattttttaaaagcctaaaattccttctatttgccctatcttgtgaatctgtcagtattgtagaaagatttgctttgaacacttattactggataactcattttgtattatctgaagagaaaaatgcatattctcttaccacaatcttatgagaaaagactaagaaaatattggctaagtaaggaaagcattgatagatatgagaaatccagagaaaattttatagaaataaaaatcaccacattgatctctgaaaattactttaaaggctagcatgctccattctgtcctgcagtccagccaatgatacctcaccatattaaagtagacccctgaaattgtacccgtagaaataaaaatgctcacataagttagtctgtttattttccataacactttgacttacatagcaacagtacacatagcaattgacttgatttttcttctccctaaacttcttgtgtttgtatatttgtttaatatttattgaagatctgaagttgtgtaaggttttgttcaatcactggagataggtgtgtaaaaaatacacagttcttgcctttacgagcacacattccactgggaaggcagacacccgaatgtaatcaaaatacagtaagctattttata

SEQ ID NO: 26381 - DNA, 1034 bp, Homo sapiens
aacacttgttcagcctgggtgcagtggctcacagctgtatttctgcactttggaaggctgaggcaggaggatcacttgagctcaggggttcaagaccagcctggggcaaaatgatgagacctcatcttttcaaaaagtaaacaaaattagctgggtgtggtggcaagtacctgtagtcccagctactcaggaggctttggtgggaggattgcttgagcccagaggtagagactgtggtgagctgagattgtgccactgtactccagcctgggtgacagagtgagaccctatttcaaaaaaaaattagaaacttgtttataacagaaacttattatagcttctgcccatctccctccactgtaggcaaccttgcttgaagactgacagacatttatcttaccttgttcatcatgtttaccattcttaaaatcctgtttcttaaaatttcataggtcactctgcagcataattttgttaaaagcatcagctcttccatcaagaatttttttttttacatcctattcattgtttacccaacattaagaaagtgagtacagtttgcttttgtaatgactgaccaataaggagacagaaataaacttaggaaaagaagactactaatgaattttctgagacctaccttctttctgaatccaatacaatgtttaccttcatctctattaatccatcaaatcaagcacaaaaggaaattgtactcacaatttgattttcatcatctattcttaccaatgtcacaagaaatattagaaaagtagcatttggttgttggtggtgttactctgtaatgtcaagtttaggtgaagatttgtaagtacagcaaatcacagggtcccagggtcctactctgtgatcagagaccctgtttgctcttttacccagccacctaactgtggattatctttgaatcttcaaagtatgtcaaatttttccacatagtattaaaatttatttgttaatagaatttatttttagagcagttttaggtttacagcaaaattgagcttcatctccat

SEQ ID NO: 26382 - DNA, 1026 bp, Homo sapiens
cccaggctcaagctgcagtgagcttgcagtgagccatgattgtgcccctgctttccagtctatctgggttacagactgaaaccctgtctaaaaaaaaagaaatgaaaaatcggtaaaatttcctaaaacttacattatatcttgataattatagcctttctaaatgttaaaaaaatttcaacaaatttagtttaaagatctaattggctttactggtgatctatgaatcaggcagcatcccatcaaagatgtagaaaagctgctttaataagcagagcaaagaagttgggctttataggcagaaaagggctgaagaagcagaaacaaggaacaaaaacacggattggtccttacaaagtaactttccttacagggttaaaaaagaggaacttcctctgttttaccagctggctcaggtaaaccaggccccttctgattgattgctgtgaatttccccttttttttttttttttttttggaaaactggttcattttaaagttcattttgattacatggaacctagcacaagttactgcattctagtttgtccagtctggtctgttggacctagtgcatgagctcagttcacacaatgatctcctataattttcatataatatagataatataaaaactgtcatatgataggtatgatatggtttggctgtgtccccacccaaatctcatcttgaactgtagttcccataatccccacatgtcatggaagagacccagtgggaggtaattgaagcataggggcagttaccctcatgctgttctcatgatagtgagtgagtgagttctcacaagatctgatggggttataaggggcttttcccctttttgctgggcatttctccttcctcccatcatgtaaagaaggatgtgtttgcttcctcttctgccatgattgtaagtttcctgaggcctccctagccttggagaactgtgagtcaattaaacctctttcctttgtaaattacccagtctcaggcagtcgtttatagcagcatgagaacagacta

SEQ ID NO: 26383 - DNA, 1049 bp, Homo sapiens
tgccaaaaaaattacataattctaattttgatacatattgcacattatcttccaagtagactttaccaatttacacaccaatcaccagtttcaacatttgatatattagtaattatttttccaaccttgtgaatgaacatttatctcattttcatgtgcattttgcttattgtttctaaggttgagttcttttcatttgtttttggacatctaatttattacgttaagaattccctgataatacattatgttcatgctttttttgttgacttgtttatcagtttaataaaacaatttacatattccagatagtaatcctttttgtataccactaatttattggtgactcccaacgttaagtagtatatacctgttgcttatttttatgtatcttctttttataagtggatattaagctcctccattagttcagggttcttctttcatatcttttttttactgtccccagtacccagaatagtctcaataaataggcacttaatattgattgtcaattgaggagggagactacaactgcaaaattaagacaaggatcagcaggaatgtgttgctggctccagtctcaaggctcaaggccaggagtgacaaagtcagctttggcttctcagatcagttatcaatcctgaaggtataaaaccagaagatgaaagagacctgtataccctgagatgcgaccactcattttcctctgttcagtcattcacttctgagtttgttattatacatattcattcatcaagtgatatgtttatattgtttatcttcactaacttatttagctctttccatgaaaatccacgtggaaagttggcttaagccaaaatatattcaaaggcttctgtcttgaagttatgtcctaaatgttactctacaaggctatatgcaaaagccaactaaaacatttagacatatttcatttgtcaaatcacttgtgttccatagtttatttttaattcagcctttatttaataaaaatctcttccacatacatatttataagcacatggaattatgcagattttgcttgt

SEQ ID NO: 26384 - DNA, 1083 bp, Homo sapiens
ctgggaaaaaagaaaactctctaaagcaagaagccaagctacaaaataaaagtttaaagatgtgatttccaaaaacttttaacaagtattttattaggaaaggtactttaaatataataaaacaaaaatttaagaatggaaagaaatgtttgcagtgcatttagtgtacaatgtcttaatattattaatatacaaagagtttccacaaatcaataagaacacaaatttctttaagaaaataatagggcaaaatataagaacaacaattcatgaaaaataaaaacaaaagtttctaaacatatttaagtatgctcagtcataagtgagtgaaaatacaaatcaaaacaaaaagttaccaacagaaacaaaatgttaatagtagccagcgtttttgaggacactaacatagattattcatgtgtttataaattgccccatgctttcaaaaaaaagcaatttctagtatctgtcaaaatgtctaatgtacatgtcctttgataaagcaaattcttttctagaaatctacccgttgcaatgcagtgattaagaactttggtttcagaaatatctggatacaattccctgcgattccatttttatatgtgtacccttgaagttcttcacttttataaggctgaaattactcatttgaaaacaagatagcaataggaaaatggcttcacagggttattctgtagattaaatgaaaccatgcacgtgaagcaattagcacattttaggagttgataaacattaaatagtatgattattattaattataacatagatatgtttccagtgtgaaggaatagctttatgagaatgtttattatattctaataacttatagtattgaatacaatcttggaatcactgcaattatctttgtacaattgtggcaaataaattggtcttaagaagacaagagatgggaaaacgttgctctgtgtgactaatgtcacatatgcaatgggtgaagattcagaaaatcagtattggtcaacaggcaagtcttaaaatgattattaacagatatatttaatgctttagaaaaattcaataaacatcagagaccaattcaaa

SEQ ID NO: 26385 - DNA, 1069 bp, Homo sapiens
acgtaaacacatgaagagaacatagcctatgtctgtgtaatatacatgtgagaataggggtgtgtgtgtgtgtgtgtatatttatatgtacaaatttgaactaaaacgtgtgacagaaagaaaattgacagggaaaaaaattggaatagcttgtatttgttctaatttgtataatcctagcccatgacttaatgttgatgcttggctttatcttttggatggcctaacctacattaacatgtacgcagaacattttaagagtttttttttttcaaaaatcataatttattaataaataaagattaaaaaattggaattgcaaaattacatttgagcaaatgtttttatagagaacttgcccaaaccagcagaccctctatttaaaaatgtccaaattcctgaatcatttactaactatgctttaattctgtgaaccataaactataaatatgccaggtcagttctcaaccagaggacttactatggaagtttaattggtagaattgattatttcagactatcttctagcctgcagaactgctaaaaagccttcacgtggaaaaagaaatttcttgatctatatcataatcacaagggtaaaaatgaaattatattttaagagatgaaatgcaaacatggaacaggagaagtttctattaacccattaatgctttactcctctatcttaataaaaaccaaaacaaaacttttattcaactgactctatgtggtcaagaaccaacagctatgaaatatcaataaattgctaaagtgtaaaataatttagtatttttttctggtgcaaactataagatgaaaacatggctaagtagcaaattcaataataatgtagctaattaatttattataaattttggaaccattcattcatctttaaagtcagaatatttggcttactcgtctcacaaacttgttataaaatgtaattgggtaatgattataaagtcagattttcactaagagtaaataacctattaatgttatctaggttgttttcaatttggtgaactgtattgtccaaactgtggcatctctgattatgacaaaa

SEQ ID NO: 26386 - DNA, 1034 bp, Homo sapiens
atgttaggttaccaggaagtttacaagaggacagaataaaacttatcttttcatgtttttatataaatgcagtaaatttgccccaggaggcatcagaatatgtcaaattgccttgtatatattatgcacctcctcaagtgacaggattgaatttaaatctgaggcaggaaaaacggtaaatacagcagctgtagacaattatagttaataaagataagtatgggaaaaaataaatggcatgaaagagagggatagtctgcatggtgcaaattaaaaagttcaatgtgaacaatcattccacaatgtggcaatgctggcatgaaataatccagcatcatttttaaagtattattgaatggagaacttagaggaatgttaccttgcttattcaatctgctgaaaagagacatagggaattaaaaaagaaaaaactatctaaaggaataccaaagatgatgagtgtgtagaacaaagcctgtgaaaaatcatgcagcaagagaaataaaagacagaaatggaatgtaatcatctgctggaataagaggtctagaaaataagcaacaagatgcctttctcatccattgccatttggtagctcctttcctgttaatttttgtaagaattatatctttatgttcattgtgctttctaaagagcaccatttgttcccaagtgatgtctaaaagagaaaattgtgctttttttttttttgaaacaatcgaatgatcatgagcccaaattcttccaaatgtgattttagagatttcctaatcatggggacacaggaataaggtcaaactgaatgattttaaaatactgaatcaatcactaactagccatgggatttaatttccctatcgataaaataagagtgattgttgggatgagtaaattattggtacacaagaagttctcagaacagagcttggcacattatgcactcaggccatgtttgtggcactaaggctgggtcactagggcaggctcactcacagtcacctatgtgccgaggactctcttaggccaggtcttcc

SEQ ID NO: 26387 - DNA, 1034 bp, Homo sapiens
ctatcatgatgactcaaaacagtagggcttctatggaaactaaaaagaaatgagattttaagataggtgttccctactaagaagtcttagtgaaacactggaagaaaaaagcatttctgaggatgcttaatatgcaccaatatcaataactggagcaacacttgcatcagccagaagagctctacctaacatgatttacaagcaatccactattctgtgagtgtgagaaagcaagaggcaaaatctcaggttgccaaaaaattgtgtaatcccatgccccttagttttcctatctctaacatgatggggtaaacaagatcaatctgagctgacataattatatgcaattacaatgcagtttttttccctgaaggcaataatttattatatttcttgaacttgaaaactgttttgtattttaagaatgcctcctccagtctcctgatgaggatttctctgcagctcttgtttaagaagctctgtatgctagtaagcaccaagtcttttgtaagtcagcactgggctgtaggcaacttccgcttttttgttgtttgtttgctttttctgagacagagttttgctctgttgtccagcctggagtgcagtggcgtgatcttggctcactgcaacctccacttcccaggttcaagcaattctcctgccttggcctcccaagtagctgggattacaggcatgtgccaccatgcctagctaatttttgtgtttttagtagagacagggtttcaccatgttggccaggctggtctcaaattcctcacctcatgatccacctgcctaagcctcccaaagtgttgggattacaggtgtgaaccaccgtgcctggcccgacttccacatttagaaaagtctacccaccaaagggagaacatggttttcttcctacctaagagaagactggcctttggtatgattttattgcagacttcatcactctgagaggccagaggaaatctaagttccctttctaagctgcacttactattctgcgtctcataagtcttcattagaaagaa

SEQ ID NO: 26388 - DNA, 1039 bp, Homo sapiens
tatctgacagacccattgctttattcattataatcaaatagaagaagaggaaatttatggtgttttgagaatgcatgcaggttttctttttgttttttcttttgaggtgtgaatacagtaataaaatactgactaatgcttgaaaggcttgaagaaaggactagcggtggagtccaaggacaagaagagatgagaagcttttttttcttttcttttccttttggtttcagagggaagaagctatgtaaattggactgggaattaatatccagcttcagtcagagaataagaaatagcttgaaagtacagagattgctgatgtcacctgaaacttacttttaatcaaaagcatctttctagaaatagaagggcaattatcacaggtggatctggggtatctttcccttggcctgagtgtgaacatcaaagttagagaaaagaagttcccaatgaagacctcctcaagttgttatacatttggggattccatgaaaggagatggtgcttcgctctggaaattggtaattaacactatatatctctactgagaaatataccagacatgtatagctgctcctcagaatcagtaaaaaccataaagacattatcatcccctcactgagcactcactggctattgatttgctaaactggtctttagtttgccaatgcttagcttccttccggttactagttcaagatcctgctgttgcagggaagctccatttcatatctttatagcagtgaaaagtatcacctaactacttcctggttcagatagtgatgggtgtttcaagcatccaggcattattatcaccttcaatccccaggatattttacagcaagtaaagccatacctcacaggaggttcataatttagagcctcatttagttaaccatttccctgttacatacatatgtatatggaccagagctctcttcatagactccattcttctttaatctgactcagttctattctccttagtatcctctcatgccttctccccttacctaactaatctaaataaaattgccct

SEQ ID NO: 26389 - DNA, 1096 bp, Homo sapiens
gagttctatcattctgcaaatgagtttagagcttccttgtattctttgtaattttattcttactactttccatctgttcatatgaactttttatctcagtctctttttatgtcatggctttctgtggtccaaaagtctatagtctatagattctttcattctactggggattgaaaacatttttcagaggactttattttttgtcattttttagagtgatgatacatttctttgaatgacttttgcatttttttcccaaagccttctccttttatttttatcaacgtgtttaaaaatcatgatttggctttccacaacagaggattgtcttaaatcttactatttgaacatttgattcatgaaaatatactttggttttctagattgaaatttgaaggacagaataattttatcagcactcctttacaattaattaactaaggagtatttagtacttttcttcaaaatattttaaatgagacactttttaatgatcacatagaaataaaaggaaagtataactgaataaaaacaaaagttaaacatcaaataaaacaaaaatttactttgcactagagtataaatttcctaatggcaagagttttcctttttgtcccatttttatatatcctgtgcctagtagagttatctagattgtaacaagcaatcaatactctaagtaaatacataccttgttaaatcattattgagttttgttcaagattttgtttagtgattacctattaatttcctatgttttatcccattctttatgtattattcataatactttgagcatgttagctattcagtacatatatatgtatatattttatttattgacacataaatgacgtttagaatggactcatgcagaacttaagatttagttaaataaaaaatacattttgacattcaacattgaatgttctacccaactgtgagatttttatatgcaatactgaaatgataagaattactgaggccaaaatagcatgaattaataaattggattatacaaagcagtatgtgatgtttttatctgaaaaaatacaataaagcatattaagttgttacaaatttaatactcctatga

SEQ ID NO: 26390 - DNA, 1250 bp, Homo sapiens
tactagccttgaaaatgcagctgcacccattgaaaggtagcgtctgttacagagcagcttgttgtgtgaccagagaatcattggagatttcacacaatctggaacacacagatgacacgtttttgtatcctatccattgaaatttgtacaatcaatttcacccaaatctgctgcttatcctaggtttttcctatttttcttatcttcaagtagtctgaccatgtttaagctgcctgaaaatctatacttctctaatattttcttattatttcttgacaatcctttctattcttaaaaaacagctccagctaattacccatagtttaattttgtgcttataaatgtaaaaaagaaatcaataagcaactgagggcatggtatagaaatggagaggaaacaaaagcaatggggtgatttttttcacgtgctccttttacagtagatatttggctccctgaaaatgacattaactcggtacatcataaacttgaatgtacagcagaatcatctggaaagtgctggaccctaaccccagagtttttgagtttcgaagtcagaggtagagttcaataatttgtatttgtaacaagttctgaggagatgctattgctgagaatcactgaaataaggagaaaaaggaatcatcagttataaattccacctgaagacaagatgctctataagcgacctttgctccctttgaaactgaacagcttggatggtgctgaaaaagggtttatgtgtgtagaagtttctttccgggcaaaatggcaactcttctgccaaaatgtcagatatatccattatttcacttttaattagtttcagggatgtgttatgaaatttagctaattttttttccagatatcacttagaattttacctggtctctgttggtattgctactacttgctgtcagcaggttccaggtgctttggaagccaagattgagcaatctggcctcaattaagcttgataaattgtttctgaattaaactgagaaagtttgagacaatacctataagtgaaaaaaaaactaagctagctatttatgaatgaaaaaccttttatctaaaacaatgttaatacctgagaacataaaatattcagaagattataattctgcttttagctctattgtttttaaaacttggatgatttattttaaaatatcttaaatgtattgtcttgttcttgtcaggctgattattaaccatttacactgtttacggatctctgcttctctcagg

SEQ ID NO: 26391 - DNA, 1047 bp, Homo sapiens
ggggaaaagttactttctttctagactaaaatattccttctaaggatgggaatttaaaaaaggctgatgattagatgacctaattccaatagtattaataatatgcttgctttcaatgcattttattgtttttaaatttattgtgttattttgtcttaacttttaactcccacaattagatccattacttataaaaaggaaaccaaaactacttagttaacaagttcagtttcgataatattccgacttaattggaataagtaaggataaaaactcctctctatgtacagataaaaaagaaaatgaagagaaaaaagaagggaaatgcatttagattccaaagaagtgcctcagattctaacttaattttaactgatacacgttaaaacaaatataaagtgaagaatttaaagtttcttaaaataaatgatgaaatatttttaatatcaatagcgatattttaataagttgtttatttgccataaaaatagtaattatatattggaaagagttttcatatgctattcgctctaatgaaaaagcaaatgatagtacaatttggaaatttggcagcattaatttttgtataaaaataattctgataactttgagtgatttttaaattataatctattacccttcttttttaaagtgttgggcttatgccacttaaccttggaacctgggaccagataaatctgttatagaaactctcattctagtaatgacatgtttagcctttaggcactatacaaaagtgttcaatgtgtttaagtagtagtagactgttaccctttattccagcaaaaatgtgtttaagtgtaataactgtttctccttagcgttactcataaaacccattgtcatttgaaagcagatggtcttttagaatgaagaacataacactattttaaaaaagcaaaattgtgatttaaaacaagtatttagcgatttcattaagcatgcaacatgaagctattttaatcagcaaaaagatacttgactatgaatagagaaaaaaggaatgtttttttcacaatgtgtaat

SEQ ID NO: 26392 - DNA, 1048 bp, Homo sapiens
tatatagtaagtttggcatttgttttaaacttttgggtattgactgatatttgacagagtgagagaatttgttattcctcaaaaactgatttaacaaattagatatgtgttctaggctcaaggaatcacagtaattggattggctatcaataatatactattaagtagctgagattggcttgtgtttaagatttaacccatgaataaactgaacctctgcaacccactgtgagttgcatcctttgtgatcaagattcagatggccaggttcatgttaaattttgcttaaagattatatatatatatatatatatatatatatatatatatatatattgctcctggttttcattctctatttcttgatagtgaaaagttgatttactgggcacttttagatgcaatgaattaaaactggttcagcctgcatacatgccagaagaaaaaataaaaataaaatactagtgcagtaaggtaaagcaacaggcttaaggacacatagttaataaacatcagaaccgtgactggaattgacatccccttggcttacatcttcttttctgttctttccaatttgtacatgtgccacccagtaatatagttttaaaccttttttgtactgactgcctgtcattatttatcaaaataataacaatggaatcaccacaaacgtggactctgaaataataatttgtaactaaatttctaaacttaaaattaatgtagatgtgtatccctacactaactttggcctttgcttccatcttccctcaagggctgctgtgcacactcacgcatgtgcaaacacacacatgcatgtacacacaacataatatttttttataaagaaaattatctggttacttgatatatgtgtggatttttcatgtgacagcatggagactaggagattatgatcagcataaaaaaaagtataaatggtactcaccttgcttaacttacagaaagatatcctaatataagggataaataactgggcataaaaccattagatcgtactacggtgcttgccaaatagtctttcaga

SEQ ID NO: 26393 - DNA, 1031 bp, Homo sapiens
gggttcagaagtgaggatccataaggcctcacaaggctgagatcaaggactccctcaggctggggacttatcgagagggtgtgaggaagaatcagcctccaagtttatttagggtcttggctgaattcagtttcttgtggttttaggaccaagggcacattttctttctggttgtcagctgcagccacgctcaacaattaaaagcaatctacatgtcttggcgtgcaacccctccattttcaaaccaagcagtggtgtgtcaaaaccccctcacgtttcatgattcaaatccctggcttccgcttctgtggccaaatggggaaaacactctgtctttaaagacatcatgtgactagaacacttagctatctcccttttgtcacggaatgtgatataatcttaagaatgatatcacattatgctcacagcttctacccacattcaaaagagagagggttagacaagggtgagggtcattgggagacattagaattccaactaacatagcgtattcgtctgcgcgggctgccttaaaaaaacaccacacactgggtggcttacacaaaactcatttatatcctcgtagttctggaggctggaattctgaaatcaaggtctcggtagggttggtttcattctttggcctttctccttggcttgcaggtggctgtcttcatctagtgtcttcacagggttatccctctgagtgtatctgtgtcctagtctcatcttctcacaagggcaccagtcatattggattagggcccacccataaaacctcattttaccttaattacctccttaaaaccctatcttgaaatacagccacattctgaggtactgaagtttaggacttccacatatgaattttgggaggaccaattcagcccataacacacaagataattttgctttttaaaatatattcttttttttttttttttttttttttgagacagagtcttactctgttgccaggctggagtgcagtggcaccatctcggctccctgcaatgtctacctcccgtgtt

SEQ ID NO: 26394 - DNA, 1098 bp, Homo sapiens
ttaaaatatttaagtaaaatgggaatatacagaacaatatatattatttttaaaatccctgataatttatatatattttttctatatagaatagtctgcaagaacatatgaaaatgcgatagcagctattacctagaagtggtcaatttcagaagatttgattttttttctttttgattgtcttctatgttcttattttaactaaatataacatagtaattaaagtacccacaaaatttgatcataacactctaattcatagcctggtaatgtgacttaaaattaatatgtgcgttgttaaattacactgtttctcagtaatttctttattatggaaaaatgaacaagcattggtataatgtgggaaaatatgtgcatttatgtcgcttctgaaaacatgaggtttaatttatattcctttgggtccttatggttacctcttctaattttctgttaatattaaaatgttacattaggcctcttctttttaataaactaataattactttgatgagatttcacttaaattctcatgaggtgtctactgtagagaagaacttaattatctgtgtttcttatggttatgtttgggaaacccattgaacttttcgtcatatttcatagctattgaaataacacaggtccacctacctaagacctctgtcccccatcacataaactaataaagaagctcttctcaattgataatttagggttttgatatacatctacaaaaaaagtaaccagcctaggaaaatcactgtctcactatctttttattttctagaggactttcatccattttagagacttatttgatgatacagttgaaataaaaggagatgaagttcatttactccatggctttgattctggagaatactagggaaggagattcttgacaaaatcataaagggtgggcctctagtactccaaactcctttatttttactattcagtctttttatctgtgctacaccttcatgattgcccccatctccgtaaatcccttcctttgatctattattcacaaagctgtaaataaataatagaaaaaggtttactttttttcagagctagttgttaccttttgtactg

SEQ ID NO: 26395 - DNA, 1066 bp, Homo sapiens
aagtccatatttggattgtagtagtgactgggtataacaattattctgaaacatttcgttacctccgctgagaggtatatatccagtaaatcactggccatctttctcctgtattttgtctggcagtgctaatttaccaccttctaacctattatagaattcacttatgttattttgtatttcttttctcccatgagaccattgatctctagttgcatagcttgtcaagtgtctaaaacagtactgggctggaagcggatgctcaataagcactccaaggatgaaatttgttctaataatgccgggcgtggtggctctcacctgtaatcccagcactttgggaggccgaggcgggcggatcacgaggtcaggagacagagaccatcctggctaacacgcagagtctctactaaaagtacaaaaaattagctgggcgtagtggcgggtgcctgcagtcccagctacttgggaagctgaggcaggagaatggcgtgaacccgggaggcggaagttgcagtgagccgagatggcgccactgcactccagcgtgggcgacagagcgagattccgtctcaaaaaaaaaaaaaaaaaaaaaaaaggaaatttgttctaatacgatgacctaatgacctagggtttctatgggttttctttttcaaatataacctcaattatacaaattggtatatagttgtttcagttttcaaatctaccttaataactcgttcatatttctacatgattaatttgtatgaaaagtattcactcattaaataaaaatctttggccaactctacctgagaggactaaaggaaaacatggcacaatataaaaatgaggagttcttgctagagggcattaaaaactcattccagggctattaattttattttatttttctttaacaaatgctgggaagacacatgtttgtggattattgtaatactaaattattaatgcctttcattaagatacattttattagttgtggtttgcaagtaaacaattgatctgtgttttttattagggtaaatctattgtgatttcttgttcagtaaattaggct

SEQ ID NO: 26396 - DNA, 1029 bp, Homo sapiens
aaaattaatcctagttttatatttatagatggttaagtaaaaggtgactaagaaatattgtagctgaacccggtgagtttgaaaaactttgcttttctttgagactttctatatattattcacatttgagaaaaactgttctagatgacatttaaatggtaagatacttcaaatatattttggcgtaagtaggcatttgaggactatgctaaagctctaagaactatttggaacactgtttctatgggaaaataatgttggaaacttttctgttagcactgatgaaaacataataggcaatattctgtttgttgttatccaatccaaaatacttaaatattttctaaaaattaaaaaagaggaggtggctgtcccggccatccttactaactcaaaaaataaaaagcaatgcccctaagttgaaaaagcccaaatgaagaggttggagggcacagggcaggtcggaaagaaagaaaaaaaccaaagattctttctcaacagcataaaatgtgtcatgatgtaaaaagctaacatgctcagtattgtagtaaacaatgacattattttgcacatgtaaggacaacgatttctatatagcataaatcattgtttgtaaagagaaataaatctagtttcataaatttatttttacattctgtattttcctcaaagtaaaataaccaagtctcatgggtggaaaaaaatggtgagccctttgcttaattggaataacaatttcctttcctccagtcctcactaatgttctgctattcaggaacacattgtgaatttgacccacagtcatattttctccaaatattaaataagaaattcacaaataagtaaaccaaatcaaaagatagtaagtcttcttaatgaaatatatatctacatatgtattttctttctatcccaagttgatacacagcttcaatggcaacaggggttttgtgtctatggctatggtctcacttctctgagagaatattttctgcctgactgctatgtcatggagccaaatacctcata

SEQ ID NO: 26397 - DNA, 1046 bp, Homo sapiens
caagatgacatcagtcactaaaaaggaatgagcaaaatactgtacatgatggtgataatttctacttacctaatgactacaatgtataaaacctattagcttgtttccctgtgtttttttcataaatcttcacaactgtcccatcagatggaagctattatcccccagttgagattcgaagatgttaagtactttgctaaggccatcctacaaagaaatacagggctggaatttaaaccaagaagtccaaagtctgtagtctttctgctaggctttgcagagcttacaaatgacctaatagattgccttgcccagcagagccagaaattgcttccagaggcatgtctatattagcagcatgagttgatccctatgtgataattgtaccattaatgtaatagaaatattgagcagctcagaacttcctgaccccaggctaaagtgtaaaaagggagaaagataatagtctcctgctggtttcaaccagggtcatttccaggacattgtctggcctagacagtaagaatcagatgcaaattgtaacaatcttctttgatctgtgtgttcagcacaaatagatttatgaattcctctcctttagcttagttagtgttttgttggagtcagatagatactttgttaaccccatcgtcagtctagagcaatgttgtcatagaggcatgaccttcctgtgatgtatcaaactcttcatttgtaatattatagtcttataatagagaacacaatattctgttccaagactcaaacctaactcttctccaggaaaacatatgcaactgactctttattagattgttttggaaactttttattttactggtcaatcaagtttagtgacctatttgatattcaggtatgtgcacaatgtagacatttttcaaattaccgtatgaatttagataatatctcctattgagaaagaaaagactatcacatggaataaccttgatttgttaatctggctagcacatttgccattgttatatctattccctgttgaaaaagccttcttgtcagacttgtca

SEQ ID NO: 26398 - DNA, 1048 bp, Homo sapiens
ctcctggcttcacagcattctcctgcctcagcctctcccagtagctgggactacaggcgcccaccaccacacccggctaattttttgtatttttattagagatggggtttcaccgtggtctcaatctcctgacttcatgatctgcccgcctctgcctcccaaagtgctcggattacaagcgtgagccacctcgcctggcacatgttatatttttaaaggttttttatatctttcacaaatttactttaaggttactttttattgatcaccttttaagagctttttgaattaagtgaatacatgcaaaatggttacaacattgttcagaataaagacccatcttacatactgttgttatgactttagttaaatactatggtggaaagtgaaaaaaaaaaaaactaatgtgtgtttgctttattaaaaatctaggagaaaatatataatgaatgttggctatgtaactatatcatattatgtatatccaaaattaatgttccttgaataacactgaacaatgatattaagaactaaaaataaatattcactatatgctaggaatcctacgaatgatgaaactgcaccttaagagtcagtcaatgggaatacaaaatgctgcagccactatagaacagagtttggcagttcctaagaaaaagtttgataattaccatacgtattagtttgttagaactgctgtaacaaaatattacagatcaaggatcttaaaaaccaggaatttattttctcactattctggaggctggaaagtctaaaggcagagttggtttattcggcggcctctctccttggcttgcagatgggcacattctcatgctttcctcacattgttagcattattatagtttataaatagttgctgtttgtctatagaaacatatgatttttgtatacatatttttaatctcaatcctggtaaactatcatatttattgtgatcattaaactagtttatttcagattttctacatagacatatcatttgcaaataatgacaggcttattttttcccttcatatactcttaa

SEQ ID NO: 26399 - DNA, 1059 bp, Homo sapiens
agccagcaccatcctgaactctggctgaagtatccagtccatctctgtctgactcctacatactagagattcatagaggggcatacaaattgaatgtatccagcgagcttagagagaaatgggttagaatgatttctccaccggaacatccatagggtgctgttatctgacagtatgacagaagtatagtagagtcaggtagattccagggccttcaaccatttgtactgaagactctttcagaatcttattggtagaataagggtaccagcagccccccgagatggattcctggatcatgaagagacaaaacaggtagggtagcttatagatgagtcatcaattgaaaaaaaaatcttatgttgagtatttttcacttcactctgagttaaaatctgcaccattgtctattagatgctgcaggagctggctggcccctgctgcttgcttgacctcagcaagtggaactcctagctctctgttctgggcacactagccttttctgaaccaggtgtttctcatgtgtcactgtatccaagaggacatcacagacaacactgtctaaaacagaggagaacccccttttccattacaggctttgtttttcttcacaacattttaacactccatggaatattagatgctgttttgttcactatctgtttccttctagtagagggaaaacgactctctagtttccctcttataatctccatgaaaacaagaattttgtcctgctgtagttatttctgtatgccataggtgctcaaatagtcactgaataaaatagtgaaatgatgaatataagccttgctccacttaatctaatacctctctttacctcaaaaaatactgagcatgctaatttgaaaaagagttaagactcagtagatgggagttggatgcgtgttgatttaaaaccagccttaggtaagaaaggtgctagttggtggaattagtcagtgatgagacaatatattcatttctctctactcaatggttttagcaacttaatatttcaataattagctcatagcataaaatttgtctcagcaatta

SEQ ID NO: 26400 - DNA, 1032 bp, Homo sapiens
aaaaaaaaaaacagcttaaatcagcatcccaaccggttttctgtaaggttaattaattgttgctaattgcactgtgtcgcagccagagacagaagcactgtcagagataatgcagtgggaaggaacagggataaaggagaaacatttatgaaatttgcacttatagaaggtactctctacttcagtgagcttaagatgcaaaaaaggtaacaccacattaggagaacacagacatcctgaaactagatgtaattgagtatttttttaaactcctgaataattacatacatatcaattagccaagtgaaaacttggcaattctttgtttacttgatccgtgtaatagtcaaattctataattcagtctcccaaattcattttgaagataatagatacagtcaaaccaaaatgtattatctttcagctctaatagatgtttcatgctggagataaaggtaaagatgaaaaataacattgataaaagtgaattatgtgcctggtattgttctaaaggagctataactcatgaagtaattaatactgttatccgcatttttataggtaaagaaatagaaagacaaagggttaaatacttaccaaggtcatagataataagtggtacaacacaggcttgaagcactataccatgctgtaacggcaactttattttatgcctctcataaatagatattggaagagatgcttgtattgttgtgaagatcagctataattttgacaaactcatagtggatttccagtttgaccaatgtgatcattcaggagaattttgtagaactagatgcagaaagaactcacgtttccattccattcctatttacatcttcatcagttaagagattgtattggtctggaaagggtcaacatacgtcaccatttagaaatatctgttaactctaacaaggcagaggaaacaacttgatttttaaatttctgtgcataatctaagatcaaaatatatgttagaagtcaagagattcacaaatctatgatattttatgtaaatattcaaat

SEQ ID NO: 26401 - DNA, 1049 bp, Homo sapiens
catgtaaaatagttacttatatatgtgcagttatgtgtgtgtgtgcgtatgaggttgaaatatctgaacttgcttacattgaactattttgacctataaaaatgttttcctccgttaaggaaattttaatttcttatgaaaggattggcacagggcacaatatttttgccaattattgataattacaaaacgtggaattttctatgttaagggtgatcacaatatgctggacataagtgtgaatgacataatagttgttggagaaatttagaagagattttccactgaaagaccaagtaagcatcaaaagaatgatggttgcttaggaaagtttagagaacaaatgtttgtgttacaaatacatttacataatgaccaaaagatctataaacataatatcacagtaaaagatttcatgtgtaactaagtgtttaaggaagatgaagttaacctcaccatattaattgaatacaaatgaacaaataatttgtagccttcagtatgatatgatgaaccatctagaatatttactctgaaaaagtgcaaaatgaaaaacgggtagggacctatgtaccagttacccgaagaaccactgaatcttcaagtgatgttggaaaggtagctttgggagatcttaattgactggcttagctttaagtacaattacactgattacagaaaattacagctatcttagtctaaaatgtgctattattaaaagaaattttggttaaatattatgtgagtctaacagaatgacagtcagcttagtataacagcaagtcagctacttaaaaatatcaaatatgtgtgtgcatatagatacacacatacaccactcttaaatattgtatgcattaaaaatcatggcttttttatttgttggtaattatagttgttgtcttaaccataaacatgtaactccagccacattgtttggaatagcctagctctacctgtgcatagacaagaatggtctaagagtaaagtttagcttggtgggtttaaacactaagacagctgctttctttatatgttgtaaaaaaact

SEQ ID NO: 26402 - DNA, 1107 bp, Homo sapiens
gctcaggttctggactctggatacctagattcaaatttctggctttgtaaaataccttagtctccttatttctaaatgggaataataaaagtgcttccctcactgagtaaatgtgttgttggattagtaccatggtctgacttgaaagtgttttcggtaagtgtgtcttacagaaagttgtggtattaaagttagatattaaactgttcctggtaaaatattttttaaaagctgacctaaaatgattgtaatacaactacagattgaaatagttttgtggaattcaaagttacctgctgactgattgagtgtgggaaatgtttgggatgggaagaaagttgtgagggaaagaggagagttagatgacaagataatcatggtacccagtaatgcaaataagaaaaattcatttggaaaaaaataaaatgtatgattatatgcatatcaaaaaacatcaatttcctctgctttggttttctttcccacacatacctaatgttatattaaactactaattttttagactttgtcctcaaatagaacgcaaacccctttatgacagcaacactatttatttgtattctctttatctccattgggtaggtgctcaaaaaatagtttttgaataatcaaatggaagaatgaactatctaaatgtgtattcaggagccagatatatatttatggagggatatcagaagaagaatgacaggtagtcaaataggaaagcaaagagggaaatcagattatagagcagctgtaaaagcctagagaactcaattaacctaagattttaaagggctatgtcacacagattttagtttttttaaataaaattctgtagcatgaaagcaaaaacaaatacaaaaaaaaaaaaaaacatttcagctgattattgacatgacaagctaccagaaaattgaaggaagttgctagaaagaagttctagcaagaatcaagaaactaggtcttaagtttaattcttactgcttatttcttaagtgtaatccctggaccaacagcctcagcatcacctgggaaaggataggaaccatcattttttagggaactcaccctagagctactgaatgagaaactccaaggcaa

SEQ ID NO: 26403 - DNA, 1035 bp, Homo sapiens
aaaatcccagaatttcagtagtttggcataaaaaaggtttatttatttattgtccagtcataatccagtgctggtcctggaggtctcagagttccaggagcttctattggttctacctttccctatgaccttggcattgtcctggatcctctgaagcagaccagggaagaagcaaaacagagcatctcccaggatgtgtttaagggccttttttagaggtgttatgcatcacgtccactcacaatccataggccagaagtcattcacatggccacacctaccaataggaaaagctgcgagatgcagtggagctttctgcccagaaagacataggaaatagtttgtgaacatctaaccagtctctgtcacatttctttatattttagagtttatttctgacattaaatctttaaaaaaaaaacataaaatatcccaaagtggttattttacttcaaggaattgatacaagttaaacacactaacaaaattatcaataagcaaacctataaacgactacagaccttctgaatgagctttttttctgttgaaaaacctagcatattttttttccattgaagtgtgtggactgctaccttctatagtagaattttgatttcatattatgtgactacacatgggaacaagcaaagacagtttgtttaaacagtggtaatcctaaatgtcaagcctccatgtacgtgtgtgttggctgtaccatgagcagctctaggagaccatttccatatactaccatgtaaatggcaccctcaagtatggccaggcccctgcattgtctccacaactgtgtgacctaagtacaacaatttccacgattaagatttacaccaaaaaggatccatctccatacaaagcttgatatttgaagtactgcagacagtggaaagagcctttgcctcagtgtaaaacacttggttttgaaccctactgtgccaattattagctgtgatattggccaagttagttaacctacaaaagctttactttttccaccagaaaagtgagtatgtacaagat

SEQ ID NO: 26404 - DNA, 1055 bp, Homo sapiens
cataaagcttagcattggtggccatgcgatagaagtgcttatttacttttactctgtaaagtaatttatccacaagaggaagaatccaacaatcctctatctctgtattttcatctttgtactcataaagaataaggaaaagttgccattacttatacctgatggaagatagaatgggttttagaccatcttaaatggaatcagtgtttcaataaatggctgttgcctgtgcatctgccactctttcaaatacttgctgtaaattgaatgggtaggcagagagcttcttcagagcagtggatgaaaccttttaaagacaattgggcagtcatgggaatcgtgaggcattataattaaaagaaggaagaaagactatgtcagcagaagggctaccacagacatagccaaacactgtaatacctcaaggagaacgcagtattggcacatactttcatgttaatgtaatctgataccatatagttcatatagtatttgacactcttattgccattgtcttttgtcttaactctgaatatgtccttatgtgatgtatatcaagctttcttcatacctttataaaagttgcaataaagctatattaggctgagtggatgtaagcaagatataagagtagtggaaagaaaagaaaaattcagacaaatatgatgtgtgcttttattttttaatctctgtgctagcagaaaacttcatgcattgcatataacaacatatggaaagtacaaggttttctgtgaaatgctttgttgaccatctgtcttctctggattgattgttcatgcacttagtactaacactttttgttagaaaaaaaggggcctttttttagtaatcaactttctttctggagttcttgaatatagtagcttcatacatttaatgaaaatgatctttaatcaaataacagttaaaatgcagttaaaattgtccaatgctttgagacatttagaaactattgatttaaacaaattattcccatcctaaagtatttctacattttagtagaaggggaattagtcagttaaattaaacatttt

SEQ ID NO: 26405 - DNA, 1104 bp, Homo sapiens
gagctagaagaatgtttataaatgggttgtatgtaaggctcaaatgtctatacgggtgaattaaacaattatgcttcaattacaactcaaagggctcctgtacattctgttaattttatttcttcccattacatttttcttttctcttaatctttacctcttctctgcaaatagtcttctgaagttagtaaataatatgttggactattcaatatgccattagattaccctgttatcctcaaattacaaaattgttcaggtccctgtttaagtggtcccaccatggagggatgttttcttacctttatccaaagttttctctgtctgttcttctctatatccacactctattcctttttttcatattacgtatagctatttatgaatatgtctgtttattcctcctcctctgtttgcctctagacccttagctccataatgggagaaaaacattctgtcttgtccactattatatccctatcacttagaatggttaccgacatacgcaagcagcataatgtatatttggtgaggcaaagacggaatgaatgatgttttctctcacacagtgagcttttctctatggctcactaactctaaagacaagatttgagttacttgtaaaattcactgatgtgaaacatagtgtttcttaaaagagattatgtaaaatgttccaaattttaaagagaagttgagcttaaaattcatactataactttttgcttaagtggtttcagagaaaaaaaaatggccacaatatctgaaatttgaattagagtgaggggctgcatactaattcagttcaacttaattgaatcaattttgattcaaaatattaaataaggtgcagtctatggtatacagtagatgaataagacagagttcactcactgtaggagcttccactctactgaaggaatccaacaattacttatatagaataatgtaatacaagccgaatttgactatgtgtcatcgtaaacatgtatatagagaaatgtggtcatctggctttgggtatgagaaaaagtaactaatgagatagaccttgtggagtacgaaatgcaggaaggaaggaagaacatagcatatatgaagatg

SEQ ID NO: 26406 - DNA, 1039 bp, Homo sapiens
cattaaatagttattaagtgccaagcccaaatcttaaactcgaattttctgacctcaaatctaatacagatgatagtatcaacagcatactgtacaattgatcaatgaaaagaaaaattattgtggtcgccaactgttaggaaagactaaattgaatatatttgacatgaaatgaggtttgaagaatagctaggctctctgaagcaagggaaggaggatatcttgggtaagaagtatagcataagcaaaggcaagaaaatgtctaaccatgaaatgatggataagactttttggttatcatgcagttttcccaaacagaggaggttgagaaaatgtacatttcaatcagtttgtagagagccccaagcaccagactaaaactgtaatgaatctgatgtatgcatatcgtgtggcagataagcacagcaagcgatagggaacaaagtgcagggtatgttttgattacatgttgtgaaaataaagaatgtttagcaggtgggaactctagcagaggagaaaaagtggtgtttcaggccacagtgaacattgtgtgcatttctgggtgattttccattcaaagtgttagtcaaagcagtagataattatgttatttaaatattcgagtaatacggttctgtaaaggggctttgggcaaacatattttagtttcaccattaaactaattcactttttctagaatctatgacctaccatcagcaacaaagcatttctgaggccttctgggcagatgtaatagactagagatcattgaagacaaattcctcgcagagaaagatttgtgaaatcctgcagcgaaccaaggaaactgtactcccaaactctctcccctgcagagaaggctttatcattgactgtctcttagcacttcaaaaaaactttgaatttgtgaataataacactgttaccttatatataaatccaaacagaaacttatgaaaatattgatggtggtcccatactatgaatggaggctctattcttactaatagacatttttgttcataaatataactttttt

SEQ ID NO: 26407 - DNA, 1041 bp, Homo sapiens
ataaaatacatatctaaatattatctgtttacacatacttacatgataaactctaagagccttttcagaggcattatgggatgtttattaagcacaataaaacattctgcattcctccaaaagaagatacctctttctgattcctgactttaacaactgcattatggaggctgcacattgaaggaccgataagtgagaagaagggaaattaattggaaataagctgaggaaaaatcaggaaagctggatatgaggaagggccaggaaaaccaatggactagtgccacaatgatcatagggttggaagtagtgagatgaagagagaagatggaactcaatgtttttctttagacacataaactccttggtcatttgtgcccccagaaacttcttgctggacatcttgttccttcgggctgtgtttaccattatgccgcatgggcctatgaacctctaccttgagccagttttctttacctcttgtagtttctctatcatttactgtcacctcatcaccccaaaatcttttctctgagaatctgtagattcttgttatttatctctacatagaaatttagaattccttgttaaaacactcttcttatcttgcagagataacaatcgtggggaagaacaagacatctcatgtcctcatcctggccacaaaaaaaagcccatccaaaagttttaaaagatggaatagtgtcttctcccatacatattagataagacaccctaaatatttttattttgggcatagatgatataattcccattattgcatattttaattttttaacaaaaccatgattttgattctttgcattttgtatttttcacaacctgactattctgtttaatataaggaaaagctgagagagaagtgattgagcttgtctggtgtcacaggcctgatgctcaggctcctgtgttcctcagcagctgctcttaacaactatactccaaggatacaattgttccggctgcgccacctgggacacgagtcagcagcactggccttctttcccagcaagaaatcag

SEQ ID NO: 26408 - DNA, 1069 bp, Homo sapiens
atattaataagtggcagagactcagagggagaaaactccctctgagttttgttcttataatttctctttggaggtccatactgaaatagcttgcctttttgttgtaattcatgtaaataatcctgaatattctatttacatcccctttgaaaattactgccaaagtaagacatgtcaagcctgcaaaatccttgatatatatgaagctcagatcaaataaagggtagtttactgaaaacaacataggaagattatttgaatactcttctccctcctagcctgacatttctttttctccaccccaaatccatgagaagacagtgtctgggataatgggaaaattattatacactctcataatcactgggggataacattccgaaaagtagaaacctaaaatagaaaactacaggggcttcatattactctctcattctttactatatttattgaaatgagatagttgttattagccaacaagggaactgacctttatcatcagctaacgagagatcaacactctcctgcaatgtgaaaaatcacagaaggacaaattaatcagattaggcaaaagggaagggcagagattggaaaaaaaaatacttcacagaggcagaaaagaaaatataaagtggagttaaggaatattgctttcgtgatgacaatgagatttttaattttcttacctaactctgatacagtattcagtcttttcaactactatctaggaagtaggattgacagataatatgtaggacactcagttaactttgaattttaaataaactacaaatacttttttaaaaatataaaattcaaatttatcggagagcctcgtattttcacttctcaagtccagcaaagctgctggagacaagttgtgttttttttttgtttgtttgtttgtttgtttgtttgtttttgagatggagtcttgctctgtcgccaggctggagagcagtggtgcgacttaggcccactgagacctctgcctcccgcctcccgggttcaaacgtttctcctgcctcagcctccacagtagctgggactacaggcgcccgccaccacg

SEQ ID NO: 26409 - DNA, 1050 bp, Homo sapiens
gaagtataattttcagcccttagttaccttccaaatttaaaaaaataaaagccaattttattttttattatatgagacatacagagaagtccagattcaaaggagtcactaacagcacctatcacatcacaaaatgatgatggagtattttccaatctcaatctcattgttttctttaaacacttcagctgcagcatgtaaatacttttgccaaagtctaaaaaatgagttcgtctctgaaaatagaagttgtagataaatatgaaatatttatacttcattttaaagatgagcagtcttcttattcagttttttgcttaaagaacaggtaattacagaagtttctctaattcaggcagattttatctacttagtgattaatcaaaaaatcattagtctctctcataaccaatgagagaaattttcaaagaaatccatatggaatttttggccttctgtacaaagttattgcaatcatatattttctttaaggaagaccagttgcagtagaacaaattattattttaaattaaaaattgtatttttaatgaattaacatttagcatatcctgatatttagcttctcatattagtgcattttgcacataactgaactgtaataatagcctggaaactatatatccacttaaaattctggaaaggtaaaatttttagaagatgaaatttcccctagaggctaagagtaagttaggaacaggaattccaggtggatagtactttgtattgctagttcatttttcattctgtcaacttgcatattcttgtttcatagtttcatatgattcatataaataattcacacacttagttcaaaatgtggaaataattggtgagagattatttggagtatttttgtttccagcgttgtatacatctgtaaattgaagtcttgaatattttttaaaacattgggttctcattatctttcctgtgtataattattttcatctctgtacccacaatgtttgtatgatttacagctgcaatataattgtgatagagaagagagagtattgcggttgagatgga

SEQ ID NO: 26410 - DNA, 2000 bp, Homo sapiens
aaatctccaaagcagacagtttccagtaatatctacttctaagtaatttctgaaactacagcacagacttagcaattcaaatatatatttttaatgcaacattacactttgaagtattgtaaacatttttgaatatttataaatgaatttattttatttaaaagcatcaacaaagatttaagattcagtaatgtctaaatgtatttggcactcttgataatgtcccccaaagcactggaaatttttgttgaaaacatattttctggatccaatctccagcaaatttctttcttccttcaccttttagcaggtaactgttagtgtggtgctgtgtggtagaggaatatgggctgaaaaataaccacacactcttcatttcctggcattattagaggtctgtaaaagacagctggattttctctagcttattcttgttcttcaaaacattaaaaagtgagagcatttatacaagaaagaatattagactttgatgcttcattttcagaggagacttgtaagaagcaaaagtgacatcatgtgatttattctcatgacacgattgtaaagggagccaagacctataaaaactcaatctgttgtcgatacattatttacatgtgtacaccatgtcttacttattctgaatgccatatttaaaaaaatgagtgcttcagaattggaatatagactctttatatcgagctagattcaactttaaacaagtaacttctaacttcttagtttgatggcaattacatggttttaaaatgtactttcttatttttgtggtagcatattttttcagtagatagctctgtgtatgctgacattaaatcattttgctgtccttcaaaatacatactagctcacttaagttttaaaatgtggagatctatttagctgtacatttcatgtctttcaattgaaaagcaccatatatgattttctaaataattttaaagtcaagtaatctaccttaaaattttaattgctaaaaaatttaattgctattccaaatagtacacaaaagtaaactgttgcttcttttttttgcacatgtattatatcataaaattaaatgcaatgctttctttataaatacaaatacatgtaatttcctttctcatatttgaaataggtcaagagcatttgactaaagaatcatggacctatattattttaaaagtaagaaagaaaggctttacaaggaaatccagttttcaacgattattgttttcaccatatatgtgtgaaggttttcttatgaaataggtaatttttgatgttatgcataaagaatcatccctcaaagtgcttacattctaatagaggagttgcaagtattaggaatcccagttgtgtaccaggcaaaataaatacagcaggactgttggtaaaccggggttttttttttgcaatgataattacagcaaactgtagactgtgatagtccagtggactgtctaaatatacaaatagacacttataaggatcagcgattataaagtcactccatcagattttggaactaaacattaagtactcatggtcatgaagatgtcaacaatagaaactggggacttctagaggggagaaagggagaggagaaagggttaaaaaactattaggtactatgctcagtacctgggtgatggggtcatgcataccccaaacttcatcattatgcaatataccaggtaacaaatgcacacatgcaccttctgaatttaaaatacaagtttaataaataaataaaatagaagtttacatctgctatcttccatgactttgtaaggcctctgtggaataggtaatgtagagctgacaaacttatgtgtaaatgagataatataaacatttagtttcatagccaataattagattgaattttgtattcaagatctttttgtctccatcatagtaggaggcctatggatcatttagtggaacaaatagattcaccataaaggtaaatgcctatagttataattaatatcaca

SEQ ID NO: 26411 - DNA, 1084 bp, Homo sapiens
caaaacaaaagacacattattgaatgcctatatgagacagactaagaacaactgtcttagcccattttatggtgttgaaacaaaaacgttgagactaggtgacttataaaaaacagataatttctggaggcttggatgtccaatattaaggtgtcagcatctggtggggcccttttgctgcgtcagcccatagcagaaggcagaggtgcaaaagaaaaaggacagaaggggaccaaactcatccttttatcagcaacccactcctgtgataactaactcattctcacaatagccacattaatccatcaacgagggcagaacccttatgacctaatcacctcttaaggttccacctctctacaacattgcattgggaattaagtttctaatatataaactttaggggacacatttaaaacatagcatcaacctttttgagcagtataattttattttaacccagaaactgttgtaataaatagaacttgtttttaaatgtcaatttttatattgtgaaatatatcaacattttttctcatctcacagaattaaacaactaagcagaactcactcataaaatgcacttataattaaggcaaaaaacatatgaattttatatatacatttttgtcttaaatatgaagctttatattaaatatgtataatgttataattatttttataacatatgcctttatgctcatgtatatttgtcccattaattattttagctaaatgagagctaacatgtgatcacataaaaatgtcattaattttttaaaaagcaggatacaataattgttgcatagcattgcctagatatgagacataatataaccttcaacttttaaaaattttgtattgttatcagatttttcaaggtcatcattattaccactgattattatactctagactttgtcttaacctcatattaaattgctccagcatttttgggtgaggtgtggggaggcaagaggatgtttgcagtgggcaatggcatattccaagtgacaaaaaaggaaatattttaaaatctgatatattttatatcttaatgacatagaatttataatggagtata

SEQ ID NO: 26412 - DNA, 1025 bp, Homo sapiens
ggagctcagtgaatatttattggacaaataagtaaaaataatgcaaactccctgctctcaagaaatttataatttttttttgagaagggaacacttatgtctacacataggcaacagagggtgaaacacaagataatataattatacattatctaagccacacaggtggtttcgagtgttaattgaagggctggtacttgaatagccagaaaagaaggattaagttattccaaaaggggaaacaacatgggcaaagcacaagaagccaacattttagaaaatgtgattaaatgagagaaaaacctcaatgatgagtgctgtgaggtcattaaacagaacaggacattctacatgcagacttagtaagtaagttggtatgtgcattacacaggtagggtagggcccaaatatggaggagcttgataaccaaagtagattgggtaaagataaggaatagggagcctagatcttgaacaggaaagaaatatgatgaaacctgtattttaggaagctgtgtctcgcaacgatatgtagacagaatcacagtaagaccctctggtagtaatcccagtgtgatcctgtaaggtgctggcagagagattagtgagagggctgtatgagagggatgttctcaaggaaagcacagaagagaatttgatagatgggtggctatacagaaggaaggaaagaaaagatcagctcatttgcaaagctcataagttcagttttgtttgtaccagccttgaggtgtttgtggatggattgagaaacgatgctggaggaaattccccccatcagaaggcttcttagctggtcttaccactgcgtactttcaggccaccactacaaagaagactcggtttttactcaaaagcctaagttctgggattacatctctcctctcccacacattgaccttgagttatttagagcaatatggagggttgaaaatagggtgtggagcagttaggggtccaagtacttagtgctcagtaattacaggtgagtaattattgctcactttg

SEQ ID NO: 26413 - DNA, 1045 bp, Homo sapiens
taattgaccatagagctacatttagaaaagctgaaataaagtttttttgatttctattatagcaataaattgtttatattaaacatgtctatgaaaatatgagtttcatgacacagaatcagaatagattgtgtgggatggtggatgtggttggttttgttttgtttttagtattattaatacatttgttcagcctaattcaagactagctttattgtaacaaagtagtacaaaagtgtttcagcttctgccttcattcttaccacagagtgtatgaaaactaaagtgtttttaactttccccaactaaaggatatatcctgttagatttggctaattgcctaaatacttcttttggtgacaatcactataatgaatagattataagaaaaatttgaaaagatactataaacaaggaaaccgtagcttgtaactaccttctttcaagtaccggattgttatctatattatttattggtagcttgtccagttctattattaaggtttcctagctgtagcatttccatagggaattgattccatgagctaataaattacaccgtcagggagtttttcttgaaattcagcttaaattttcccattcttaatttcatcccgttactcctggttatacccccttgtaccaagctaaataattattctttttccttagagactcttattatgtacccttctgtttgtcacttaaccaggctattcatagttagctcctttaatctgtcctcataaatcaattcttccattgccttaattattattattgctcttctaaacactctctaattttcaaacatatacagttctcaggtgccccagatgacatcagcatttgcacagggttctatcctgacagacttagtgtcttccttccctgtacaacaagatccagaactaaatggcatcagttcgctgaatcaaatcagctcttgctcatcttgtccaattcagcatggtctaaatggtgttttctatgtgccctacctccattcaaggtttattttgatttgtttcaattttgtgagatt

SEQ ID NO: 26414 - DNA, 1050 bp, Homo sapiens
ccttcttgtctccacttattagaattttctcatgtttgatttttatagataatgtccagtgtttttcgttgttacttagtgggagaaagagagacaagtacatctgtattatttccctcagttagattctgtagttggagctcttggtacttgtgtctcaaaatatagcagactttctagatattttgtgtcatttgttaaattgcttaactattttgaactggaaagctttgtgcaagaatcctagggattattcttttcaacctagtgcaatattataccaatgtaatactttctaggaataaagaaccaattaggttattcttcatttaaacataattgacaaatagtaagcttttcatgtgttgacctctttaagatggaaagtgtattaacaaacccgagtaaaatacttcactccttagtgatgaatatttgggtagtttagaagatatccatcatgattattttgcttattggtacttatcattttgaaaacatttcattgttttttaagcaggccgagcatctgaattccagtagaattaatagaaactatataagagcggttcctctgtccagtattatatagcagggatccaactgtataacatgctgagaactcttaatgttggaagagagtcaggagagagagcaagaaagagatttaaagataacaaatgctggcctgcccagagaatgtctggcagtctgaatcaccagcttccggagatgtagggaactcacatctgatcaggcactctgtctgaagctggacagatgcagttataaggcttccaagtgtcagtgttcagaccagtggagtctagcagagttcccataggtctgtgtcagaaggaaattcagtcctaggaaaggggtctcaaaagatccatatgtgaacatcagtgctatcactaccttacctatgttttagagcccaatttactgctatagttgtatttggaaatgagttggagccagagatccatggaaaaggcctgttgggtggaatggccccagaggtgtgaacccggtgaaataagggta

SEQ ID NO: 26415 - DNA, 1698 bp, Homo sapiens
tgcacagtctttggataaaaagggttataactaaataatactacaaaatgcaatttacacaatgtgctgactacacatttgtatacccagcatttattaatttgggaagcaaccaactactgtaacttctctttactttttcataagaaaatgacaatgaggaaggaagtgcagcagaaatcttgaacattaccactattatgcaaaaaaaaaaaaaatgctgttaactgttttcccctcagtgacttgatgtgctctcagatggaaaacttatgattcttgtgactcttggctacccgaaatcacatgagatgagcaaggaagaaagacacaaaagctatatttatatctagccctgaacttctcagaaataccttaatatgattccttgcagagactgataaaaatatcagatgagggagactttcaaatgatcaatgattacaattgacaatacaatattgctatatattaaacttctaaatgtttaatgtaaaatgtctctctgaaaatattttttaaataaaggaaaattccttgctcaggaatgaatttaagtggttgtacagcttaaacaaatatcattcaaattatctgattattatgaggagtgagattaaattagcatccaggtatatctgtgtattttaccttaagaggatcatgatttttcagttctgattccataaagagatttgctgcactgcttgtaaaatatattttattttatttttgctgtaacattttctagaacctgttctttcatgaaagtagattagaatatgataagcaaagaatgaccaggacagatttggaaattcgtagagtcctagttacaaagtttcccttgttttaagtaaaatgattatcacagagagatattcatcctggagcatatttggtctcattagtattgtcatagtaaaaataaaaatttttaaacttcacgtttaatttacttaagagatttttaactatcagctatcctgctctgtcctcctacgtcctctacaatctggtaggcagaaaatttgagagtgcccctatttttcaaattctcccttattttaaaatattgcagtttttgacaatgacctttaattgtttatgaatttttaacttcaacattatatatattcaccttcatcagaacactgagctgttgttatatatgtttccccagaaaatgattatgattacctacaggggcataaatcatgatgaggacaagacatttatggagtagttgggataggaataaggcaggtacgttttagaagtttgtatcaagcagtgaaacaggtattgttgttacttctgggatatttgttgtacaaactgggcattccaagttttgatatgtagaattaggttttcaaaaagtatgcttgcatagattagcaccattatagccaccccaaggggaaagaaaagcatgaaaacaaaatgtgaaattctgacttgccactaagcatccagagtttccagaggcatagcagccagcatgcctcttcatgagtgcaaatacttagttgcttttgactcttattgaaaaaataatatctttcccccatttgtcactagaactgccaccagaagaaaagcccttcatttgctccaaataagcacttctgtttttcacagcttgcagtaatgcttaaagtaaataagttcttgtgcagctagcactattggatt

SEQ ID NO: 26416 - DNA, 1054 bp, Homo sapiens
catcaataaaatagagacatggggggaaatctgtccatggtgtaggtggtacaaacagaatgactattaaccaatccaataaatacttgagattaaatttttaaagtttaagaaagaaacagaaaatttataataaggctgatatttttcttagaatcttgaaccgtaactttgttattccatctagaaacatctaaaaccagttaataaagttatcactagaaaaagcgtttacagaaattaactgtttttcaatgtcatctttcctttcaacaaagatgcaactttctacaaaacattatgctatcaacttactatatttcaagcgttctattggcaaatgagtggattctatagattagatactggttaaaaattatttctatttacgctgtatttttactattaaaccgctagacttttaaaatcttttaatggaagaaatttaactttcatgtgcttattctgaccctctgaacaatatgaatttaaaatattttaataatgaattgagaatatggggtttgagtatctggcttgataccactggagttaagagactttgtggggctttttaagcatcctcttctgtgtttggcattctgcaaaatgatctctccatataaagctcatcctaagaatatgcttatttaattgtggcagatcaatctgatgatcaaattctctcatgtaaaatattctacgtgttttttgctgtttcaggcagaaatcaataatttcacttcactctgaagttatgttttgtggtaatacggacattttcgggagaaaggtgaaaaataagaaatactgtatctctgggagtgtcatctttattcattcattcattcatttttagagacagggtctcactctgtggttcagactagagtgcagtggcaccatcctagctcacagcagctgagattcctgggctcaagggatctctgggagtatctttctatcctctgatttcaggcctagtttcgggccttccctcatgacccttcctgatcatttttaggacacaaatgaaaagtgcaatttagaggtg

SEQ ID NO: 26417 - DNA, 1085 bp, Homo sapiens
agaaaccaacccccgaaaacaaacaagcgaacgagcgccagcccagactcggaaaggaaacttctcgctcccctcgctctcagcccgatcacccggcgcggggccgcgtagacgctcccgaggcaggcgctgggacgcagcgcccacccggcctcccggcctccgcagccccagcccgcgcctcgcggggaccgcccgggcccacttggagcaactttcctctagagaagacaattgtgcgcgcccccggcctgccccagagctgcgcggcgcggggagggggcggctgggggcgcagtgtgaggtgctggaaggagcaaaacacaaagacgagagaattttgattagagacaaatgatgcttttctctctctctctctctctctctaggttttgtgtgtgtgtacgcgtgtgtgtgcgtgtgtgtgtcttttgcttgttgtggtggaggtgtcgagccatatgggggagtgatagaggaattttagtcagaaactgttcgttacgttatcctgcctttcccctttgtgctgtctttgatctatttgcttggcttagtattacagaaaaacaagtacaataatatattccgagctgcttccccaagattcagttcaggctgcttctttttaagtctctccctctctctttctccctctctctctctcttaatttaatttttttttcactctggtgtctggcattatttaaggtggtccttacacaggagacctccccttccccatctctgagtaatttagtagacactaaaattacacctaatgtccccctctcctctcttgtgtttcctctgttccttttattaaatgttggttattgattttctaaaatcaatgtctgttgtggggcttttttccccctcttacaagtatctaaagcacgttgctgatcaactggataacaaaagctttgtgtcaaggaggcttttttccctcttctgttaaacagtcattttttttttttgagagaaaaagagaatgagatttaaaacaaggctcccagaagtgttcttttgcagggaagactatttaaagtgtgcatttcttcttgccttcctccttccac

SEQ ID NO: 26418 - DNA, 1014 bp, Homo sapiens
tattggcctgtgagggcatacagagaaagtgttatttgggggctgagtcatgagttttacaacttcaggacttcatgtagattaccattgtccactacaaagataatgtgagccatgtaatgtagttttaaattttctagtacctgtaagaaaaataaaaaggtttaattttaattatatatttaatgcaacatatcaaaaatgtgtcattctataatcattatagaagaacagtaaggtattttacattcttttgaattaagtctttaacatttggtgtacattatatttaagcacatctcaatggcctaaatgtttactggaaattcttgctgtttagattccataaaatgtatagctgagaaagtaaatttacattttgaaattgttctaaacatgctcagaattttctaatagaactaaatatccatttttaagtttaaaaaaaaattgagtcacacattgaagtgctcagtagcctagcgtggacagtgcagctcttgaagattttaaggaaagaaacttttaaaacagtggattccccaagtccattggcatcccttataggccctagtaaccagaatttcatttcttgtagcaacaaaaatgagtacagagcattgccatttcttcaaagaaacaggaaaagtattttacaatactggagggtttttttcccctaatagtcttattttgtgagagctgtgaaaatggaaaggttacccaagtatttaaattttttttttttttttttttttgagatggagtctcctgtcgcctacgctggagtacagtggcgggcgcaatcttggctcactgcaacctctgcctcccaagttaagcgattctcctgcctcagcctcctgaatagctgggattacaggcgtgcaccactatgcccatctaatttttgtattcttagtagagacagtgtttcaccatgttggtcaggctggtctcaaactcctgacctcatgatccgcccacctcggcctcccaaagtgctgggattac

SEQ ID NO: 26419 - DNA, 1056 bp, Homo sapiens
aatcgccctaaaggaaatcacaaggcagttaaatctggaaaatgtagttggagataaagtttttgtaagtatcatttcagttattttattaaatagacttttaaggtaatgtctttataccatgtatatttttatatttctggaagggtagggagaggttcagaaattcttaattgaaatatatgagattctttcataaaaatgtgtaatgtataggatacatttagtcattaagtctacaatacttggatttttccatagtaggttatagtagctgtaaaatagctaagaaacccaagtttatgtagatattctgagtttatttcattttctgtaaggtgaatactttgattctgtatctctggagatagattaacacatttttaaaaataccatgctccagcagcctatttctacttttttgagacttgagtagcctgtgtatagtagaaaatgtgctaaatttgaggctgcaataggtgggtttcagtcatgccttacaaccctttgactgcctgataatcctgagctaacaagtatctctgaattcagattctttacatgttaattgggcgttattttattatccatacttcacaggattattttgaagaagaaagaaaacattacacatcatttaacttaaaaaataatttgctggatggtaatgtgctgtacaaatgtcagttattctgttttcagaaatttattcatacttcattatcatatcatcttatagtctcagggcagtgaacaacatcagtaaaagaaactgacttgaaatgttttgaaacttgtattaaacttttacctttcacctaatatatagggcctaaggaaaacatgataatttaattttgcacctacctgaattttcatgatgaaattacctagcctcatactgcttatgcagttggagtggattatacacattccaacttcattttctggttactggtgaccatgcggtggcatcgctctaatttctgaactgtgtgctttgtgctgcaatgacaccgccatagttgtgtaagactcctagcatttatgagtttc

SEQ ID NO: 26420 - DNA, 1024 bp, Homo sapiens
ctttaaataggtttttggcttttcttaattacattcattttcaaattctttaaaaaaaagaatgcattggtaatatgaagagatatgtatgatatcacagtacaagagcaatacaatgttatttaaaaaagtatgcttcatagaaacctttaattcaatgggcttttaactgattacaatgatatttagtagagtaattgtcagagagatgtgtaatgtactaactgagacatgaagtttataagggccatgtcacatgtttaatgtgacatgtagagaaatatttattttaaaacttggttgtttctaaatttgtattaaaagttcgggtaggtgattgagagaatattgtatcagtcctggctcttgtttcttaaaaagagtcagatatgagatgttctagttaaaccttttatctgtaaagaatttgaaaacttacttgttaaagaggtcaatttatttatattctgttcttactgcttgtagtttaaaaacgaatatggacttatttttatcttttacctattattatttcataaacttttcatatttagttaataaatcatgctttgaaagaactcatggaaatagaagaagtgagtgaaaatgtattacaagttcacttaaatggtaagtatgccattattttgccattggagattatgtaaactttgtggggtttttatatgacttgtatatttcaaatccattttaatagttagattttgaaaactagatccatgttttacttagcacaccatatgcagtatttttagaaattaaaataataataatgaaggagtcgcagaaggactctggtttttgtgggttttttggtttttttttttttaatcattctaatcccaaggaggattgttttttgattctaccgaatgtctttattgctaagttttaagaagaaagtgatatgaactcacaggctttgactgggaagatttacttaactggaaaacaacctgctgtatcaaatacatgtttaattttaattaaatacttttaaatg

SEQ ID NO: 26421 - DNA, 1039 bp, Homo sapiens
tcttcattctattttttttcttgtctgcctgtgttatttcaaacaatttgtcttcaatttaagaaatgcttatgcttgatgtagtctgttattgaaggtctcagttgtattttctatttcattcattaacttcttcagctgtaggatttctgtttgtttttttatggtatctctgttaatttcttattcgaatcacaagttgtttttctgattttgttcaattttctatctgtattcttttgaatttcactgagtgttgtcaagattattattttaaattcttctggcattttctgtatttctttatgattcttgtctgttactagaggaattattgttttcctttggaagtgtcatgttttcttgcttttttatgtttaatgtgtccctatgttgattgatacgcctcaggtagaaaagtaaaattgtcttttccaatcttacagaattgatctcgtaaggaagtactgatttgtgtcaatgtgtctcgaggtgtcagtttgatgtggttcattggccttggttctagttggatacagtagtgtggtctttgtgtagttttttcagctgtaatccacactagtgtcatttacaagtgtctcagtggcctaggctgagagttgtttgtggtggcagttgtacagctttgcaaggggtgggtttgctgggctggttctcagtttgggggcatatgcatgcatatggtgggtcaatcaccttgggatctgacacactggcagatggggctattaatgtggccaggagcatagtcatgtggttgcttagccagtcttggtgaatgtttgccaggaacaactcactggtttgtttctcaggcccaggagatgcctgggatccaggtgcaaggctgcttgatcccaacagaggtgtagggatacagttcctcgactggcttagggccgtatctgctgaggggttccacaggattgtttctcaggtttaggatgcaggcacaaggctattcagctggcttatgggcatgcccactagaggcgtcctgtgaggctgtttctcaggc

SEQ ID NO: 26422 - DNA, 1362 bp, Homo sapiens
atttgcatttccctgatgattgatgatgttaagcatttcttcatgtattcgttggctatatgtatgtcctttcagaaatgtctgttcagataatttgcctgttttttaagcaaattggttttttgcttttgagatactggagttccttgtgtaatctggatatgaatccctatgagatgaatactttgcagatattttcatttattctgtagattgtcttttcatgctgttgattgtttcccttgctatgcagaagcttttgagtttgatgttagcagatttgtctatttttttatgttgtctgtgatttgcagtttttattcataagatattttcctagactagtgtcctgaagtattacccctatgttttcttctagtagttttatagtttcaggtcttaacattgaggtctttgatctattatgaaatgatttttgtacaggatgagagatgggaatctagtttaattcttctgcatatccagttttctcagcaccatttattgaagaaattgccctttccctgatgagtgagtgttcttggcctttgtaaaaatcagttggctgttgataagcagattaatttctgggttctctattctgttctattggtctacatgtctgtttttatgccagtaccatgctgttttggttactacagctttgtagtatatttgaagtaaggcagtatgttgactccagccttattccttgtgctcaagattgctttagcgatttggcatcttttgttgtttcatatgaattttaggattttttttctatctctgtgaagaatatcattagtgttatgataggaatatcattgaaactgtagattgcttctggtaatatagtaattttaacaatattcattctttctatcatgtgagtatgggtgtcttttcatttgtgtgtatcctcctcaatttctttcttcagtgctttgtagttttccttgtacaaaactgtacctttcacctccttaattgaatttattcctcagtaattacgtttttttggtagctcttataaatgggattgccttcttgatttttttttttcgggtagtttgttgttagtatatacaaacagtactggttattgtatattgattttgtagccttcaactttactgaaattctaagagttttttggtagagtctctaggtttttctatatataagattatgtcatctgcaaaaaggaatgaattgacttcttcctttcccattgctttggcttgaacatctagtactatattgaataagaatggggagagtgaacatccttgtattgttccagttcttacaggagaaacttttagtttttccccatttggtgtgatgttggttttgggtttg

SEQ ID NO: 26423 - DNA, 1038 bp, Homo sapiens
aagacatgtaaaactttataaacttagggtggtatatttgagtgtagcagacctttttcccccttatttgtcctcctagtgaaaaattgtcaattgatgtttgttccaacatggtcttttgtccttaaagaagtagagatttccagtggaaaaagaaaatagcatgtattgagcatgtactatgtgtctttttattgtgttctctcatttattctttacatcaacactgcacggtagggtttttccctttgttataggttagggaactatcatatcatgcattctttttatttttcctacatcattactatttgtttaaccctaacttacacagtttttcagtgcatgctcacatcttatatcattcttgtctccttttgctctttatcatatttgcttagttacctcaaaaagatattcttacttatttccctttactcttttctttgatatcctttatgcaatataggagacaaattatgggtgttaacttttgaaagcaattaatttcaatgctaagtagtctgtgtaaaatctgttctcatgtattatatacaataaatttcaatttttgaccaatgtactttaaaaaaatggatgagaagcaaaattttttttaacatttaagcaatgtatattgaaattacattattaagatgagtacgttaggattttactgttatcacatctgaagtattgtttaatataaattgagaatttagatctaggtaatttctttcaatatttcacaaattgtcacatttatatataatcatatttgcagtaattttttagtttcaaatctatgtttaatttgttttagtcctcatactcagcttctataatcactatttcttcattcttgagttttttattatggtttttctttgcatttgaattcactgttattttgggtagttttcacaagagggctatgtgaaatgtttttaaatttcaaatttttaaatttttaaatttaagaaactttttattttaaccattctaataggtatatattggtgtctcattgtttgtact

SEQ ID NO: 26424 - DNA, 1032 bp, Homo sapiens
acatgcaggtttgtgacaccttaggcctgaagacctaagtcttgactgtaggccctgaagcaaccctgtagcttagttccagccccactcagctgtggactagggcagtactgcctgttaaggaatctactcagtgatccagtaggagccctcccaggttcccagagaaagccaaaccatccacacacctggtaacaggtcttttctctgcatatcttcatccactgtacagaccgaggtcctagaaaaagtccagtccgccaagggaccagatagggttcatatcctgctacagcccctggtaacaaggtcctatcgggaggacagggccctttccaagtctgaagcctggaccacagttggggaatctgtcacgtgaatgaagatctgccctccaattgacttttccaggtcttgggccccactggggtttcacagacgcctgcctgaatctcaacgctaacacaaagaccattttgtccgtgggtggctgtgaaattattgttgctatttggggacacaagctgaagggcctcctatttcatcttgctgctgtcattctcgcattattataatgttaatcattggtgatttgatgataagtcagctttttttgagttttatgagttctggcagtaaaaaagttccaaaatgtctttcactgagctaaattcagggtgttagcaaagctgtgttccttctggagattagatgagaccagaatacacttttttaaaaaagtggttaacttggttggatccaaatcctggctcttccatttatatactgtttgattttggtcaacatacctagcctatctgtgtcttctaaccttaaaagaggattataatagtagttattccacatgatagttttgaggattaaatgagttgataaatgcaaagcatttgtaacaattcctgatacctaaacactgcttaagctgttactgtctatctgttaaaatttattcctataggaaatcagtgctaagaaaattaggtcttttagtcaaaggtcttttagtcattt

SEQ ID NO: 26425 - DNA, 1053 bp, Homo sapiens
cttgtaatcccagctatttaggaggctgagtcaggaggattgcttgaggccaggagttcatgacttcagtgagctattatcgtgccactgccctagttgacagagggaagccccatctcttaaaccaaaaacaaaaaaaagttttcgttgattcaagtgtctgtcgcccttatactatttatccatccaattaaacacattagcttggattcacaagcttaaatcctgaaggtagcctacttccatgtgctcagagaacatagactactgttgatcactataatatttaagatgtagttatgtcagtgccagtaagatcatataatgcatttccaaagcttctaaaggatttctaaatacgttgcaaatttgtgttagttcttttgttagcctatataattcagaagtaaatgcattttaagacgtatactttaaagaagtcctccaactagtatttcttttttattcattcatcaacactactgcagaattgatactttgtatcatttacaaggtgtattccatggttaataatcaaaacaactgtagtaatgtctttttttcattttgtgagacggagtcttgctctgtcttgccctggttggagtgcagtggtgcaatctccgcttactgcagcctccgcctccccggttcaagcgattctcctgtctcagcttcccgagtatctgggattacaggtacgcaccacgacacctggctaattttgtatttttagtagagacggggtttcaccatgttgtctagtctggtctcaaactcctgaactcaggtgatccacccgcctcagcctcccaaagtgctgggattacaggtgtgagccaccatgcccggccaactgtagtaatttctaaatgtctttctttactgaacatatcatagtattaactctctgattatccttctgggggttgtttatttcataactatttacctcccatgttcttgaaaacaactttattggcttattcatgaatatcaaggctctaataggtactttataaagtaagtacacttattaaaagatatatatgt

SEQ ID NO: 26426 - DNA, 1047 bp, Homo sapiens
acattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaataatgtgtgttttcattacagtattttttaaataccattattgattcttaagtttctatattaatctttttaaaattctttttaatgcaattgagaattttggattcattgtagactttttcaaattttcttttatctttattgtctattaagtgttggggtaccagtctgagtattactttgaaataatttatgttcaggaaaagaagaagaaggataatacatctttaaacgcatatgagtcttgtccttatccctactaaaaaggtaattctctcttaactcctgagttgagacagacaaatagaactatgccttaactgacaaatttatttttcaattttagcaataggtggaaactgcagtactttacagaggtgcctcatttgagacagagcttgtttttacagcatcataaacttcatctttcatttttgaagcttttgcaaataggaataggcagatctaaggagtaaatgtaacttccacaaaatgaattgaaatagatttttttctgttttttcttctttgcatgaaatgcctgttttgaaaaggactacatggagataactttttaatcacaccttgttttaaaacccctagcttagttaacatgtcatttgataagaggtgttgcttacgatctagaactagaaagttttcatttattttgaaatgatgaagtgtagtgattgccacagcatttagaagaacatttattgaagtgtatatatatatatatatatgcacatcatatgtgctcaataaatttttatgtgtgtaaccagcacccagatcaaaacacagaatactcaaacacactcatcctgctcccttc

SEQ ID NO: 26427 - DNA, 1086 bp, Homo sapiens
tccctatagtaatatacttttaaaatatatcacagggagagggagatgagaaatatctgtaagttatcactgacagccaaacacaaactccctgcttacaagtttgtcttctttcttaaaacttcaaagtgaatacctctgggatatggggacaaaagttgtcctcaggaaccatgagtcatagtgactttaggaaatgatgatttgacaccagacagcagtaagtgaactatttcaagatgtctcagagtcttagtgttggaaggatcctggaggctgaagtcccctcagcgtttctactcaggggctgtgcattcatgttccataccctttgagccacagcagccactgccgtgccagacaggctgctgctttttcaggcagctctagttgttaggaagtctttctctgtattaacttccctggaactctcttaagcctcattctgccctgtggaggccctcagattctgtctcatctgtcctctgtatgacactaacatatgcctgtttccaagttccaactctaaggttgcctacttctgacctaaaataaaactgtgaggggtgttcgtgtgtgtcctctggtgcttgaacattgaacatgcatgtttatgcccacacttgctaagtgctagctgggctcattgatttttcttttcttttttgttttttagagatgggggtctcacctgccatgttgcccatgctggactccaactcctgggttcaagtgatcctcctgcgtcagcctcctgagtagctgggggaactatatgtgcaagtttgttcattttaaaggtggctttgcccagtaatctctagctgggagcatccactgaccctaggagctaatgcacaggggaggatgagaggtactcctgggagggtgagtgcctttgggttatctcagtccctggcaccttcacgggggggtgggcaggcagatgagctgtcattctagaaagtgccagctatgcctgcacactcctctcagcctcgaaggcacacaccctaagctctgaatcaaaggtagggctgctgccccaaagccgatgtggcttgttaagaacttgagagactgtag

SEQ ID NO: 26428 - DNA, 1032 bp, Homo sapiens
aacagaaaaccaaataccacatgttctgacttataagtgggagctaaacattgggtactcatgaacataaagatggcagcaatattggggactattagaggggtaagggaaagggggccaaaggttgaaaagctttattgtactatgctcagtgcctcggtgatgggatcatttatgccccatacctcagcttcatgcaatacactcaggtaacaacctgcacataaatcccctgaaattaaaataaaagttgaaattaaaaaacaacaacaacaacaacaacaaaaggtgattggtaaaaattcactgatgcaatgccatttgcaaccttcagtgcaagtctgattttgacagagttcttaccaattattgcagatgtaaagagattacctttttagcttatgccttgatattatgtgttttgctttagatggtttggtggttggttggtttgtgggataggttctttttggctgtgtagtaatgacatcaaatgcccgcagagaattagttgtaaatggtaatggtctttttaaatggtttaactgctgtactcaaaatactcttcaacctgatctggtgtcctaaaagtttagtacttctaataagatctaacatgtggttgcatttgttataaatgccaaagttatatttaaaaacacccaaaggggctgggtgtggtggctcacacctgtaatgtcagcactttgggaggcccaggcaggaggagaacctgagcccaagagtttgagaccagcctgggcaacatagtgagacccgcatctctacaaaaaacaaacaaaaaaaataggcatggtggcatgtgcctgttgtctcagctacttgggaggctgaggtgggaagatcacttgatcttgggaggttgaggctacagtgagccatgattgcaacatgcaacactgcattccagcccaggggaccatgagactatctcaaacaaacaaacaaacagacaaacaaaaacccactccaaatgtaaagtgaatagttcacatcaggtgtactggaggc

SEQ ID NO: 26429 - DNA, 1050 bp, Homo sapiens
tatatgtattttctatggtatcgtatggcttgtcttaactgatgacacagcctagaggatttctgtcacaatttgtgctttatttgaatacaaagtcttttttttttttttttttttttttttagacagagtctcactttgtcgtccaggctggagtgcagtggcgcgatctcggctcactgcaacctctgcctcctgggttcacgccggttgtcctgcctcagcctcacaagtagctgggactgcaggcgcctgccactacgcccggctaatgttttgtatttttagtagagatggggtttcaccgtgttagccaggatggtctcaatctcctgacctcgtaatctgcccgcctcaacctcctaaagtggtgggattacaggtgtgagccaccgcgcctggcctaaataaaaagtcttgaaatggaagatattcacctaaccctcaacaaaccatgatgtaatgaagcacgaatcacaccattttgtctctttcctaattcaaataggtccctggcattagttcatgccgagactagaaaactgaaccctagtactgttttttaaaacagttttaacagaaaattaaactgtatgtttgaaatcataagtaaaagtttgttgcttgcataagagtagcctcttgattctcatagtggtaattttgtgtcatatcatttagatgttgaaccatttcatttgtgcatgtgtatatgtgcccaaattcatcctctttgtttagaatctgcttacaaataaaactaatagaatctgaatacatttatcatatattcttccagggtttttcttaactgactatagagagtggctgtaagttctggggcaaagcttgattgtattttcagtgatgtatagttacattgtttcatgttaaaatcatcgtgcatggaaagtgaaatgtgcgtatgattttaaattattgtaatatgtactatacccttcccctaaacttctttcattgatgatacacagaattcctctatttttgcttgaaaatagtcctttagattggagtagccttttcttagat

SEQ ID NO: 26430 - DNA, 1024 bp, Homo sapiens
tactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagc

SEQ ID NO: 26431 - DNA, 1022 bp, Homo sapiens
cactgtggaattaaactcataaactatcaacactctggcatcttttcatgttgtgtcccaaataaataagaccagatattctaagcagatcattggtgcatcaggatgccttattaagtcagatatttagcatcttattgtacagatcctatgattttacatacatttacatgtttagatgaatgaagctgacattatttaatcaatgaactatctgatatttttagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaa

SEQ ID NO: 26432 - DNA, 1044 bp, Homo sapiens
acccaggtcagagatttcaaacagctccatgactggaaagacagccttgccttaccattatctcagtaggataaacactttatctttttatataattggtaagataacctggaattttaaacaggcagtctggatggataaggttaccttgtacttagcattttctaaacactgtttactttattaaacatgttcaattgatactgcacagatgtagtaatgctgaggaggaatagtatcctctattttggcatgtgtgaagaaatctttggattataaaaaccagtagtaaccttaaaatgtgtctgcatttgcccctgctttacttcaagaccataattataattgtcatccaaagattggtgatcactgtgtcattttaattcctttaggagaatttgcgacttacttaattggccaccatatctccagtatgaaaagtcagcaaattacattggcagagtatcacattgctaagaaatgaaaggcaacagtttttggaaagggaagcctataggagctctgaaaaaagttaacgctgtagccagaattaatcctagatccagggactgttgaagcaaaaggggaccttaaagagcacccaatatagtatttcctagactatattatttataatatgggtcctatgtgatatcagtaagtgttatgggaaaataatcctgataccaaaaatgtttgagaaaacacttaggtgaacaaaggtagtctggtttctttactacagaaccctgaatatgccaatgtgtattttatatctccaataggacaaatagtgtgcacagcttcccctaaaattgtgactgcagatctgcttttccattgagcatcctatgggtccagtggaacatgtctagggaaagacttagtccaatctcctcattttacaaatgatggaactgagaccaagagaactggcttttcaaaggttgtatgcctgggccaaagtcagcttaagatctctttctcctagtctagcaagactagatgatgaatggcaacaggtcagttatatattctcctgga

SEQ ID NO: 26433 - DNA, 1556 bp, Homo sapiens
aattgcatttgtctaccttgttcccagcaacactgtgctgtgtccagcacgggaacaacccatggtgattggctggcccggaacttccagtgttgctctcaactcctgtacccaattcccacccagtgagaaatcaggatataaggtcatttgtaccagggaggaagctgtctgtttttcatacatcttcaaaattgacgtgtccagaatgaaatcataaggcaggttctccaaagtgggcgataggaaggtggtgaagataattacagggacaaatgggtacattcttccatcttttaaactcatgtactgtcatttgcagagtttacatattttgatatggctctcgttattgtcttttagcaaaacagaagcaaaaagtggtaagttgtgtttcctttttaaatctactgttaaggttcctatatatacatgcctgcaatgctccatttcagtgacccaagtggctataaaataagggaagagcctcctcggtggggactttgataatcatttgtcgttcaacctgagaattatgaaattatgaatgttgtggctgtggagaggcatgctcaacctcaccttgtcacgcgtgtcgaatcatctttttcagacggagcacattcctccttacgatgttgtaccgtcaatgcgtccggtggtgttagtggggccgtcactgaaaggttacgaggtacaaatatcatctgttactcttcagttcttgatcgagcacccaggagacagtcatgttgacgcttgctcctcaagggtctgtttccacgtgggtcctgatggaagccagtgctcagcatgggaaggcagggggtaccgtgtggggctcatgaggccctctgccctttctttcctctcttgcacacttctcatcttttatgtattacattgtttagaaatacctccctcaaaatattcacaatgggaagatctggtcaaagatttgctgtacattaaatgcaaagaaaaggactttatctgtcttgaccattctcattattattagaagtaatagagaatgaacagcacaagaggacaaacaatcaatcttccagcaaacccaaacctttaaagcccaaacagagttcaccctgctgggtttttaagatgatggcatatgccaccaaatccttctctgcttatttattttaaagggcacatgttttaaaagaccactaaaaacattagtgaactttggagattaaacaaaaccatgtgacaaggaaaagagtagagacttcgtttcagatgtttgttttgactttgtgctagcttggattaaaaaataggtagaacgtgacattaaactctgaaggtgagcagcctccagggcaccattcccatcgagctaggacaatgtgtggcacatagtaggcactcagtacacatttgctgaatgaattaatgaatcgctttcaggcagatctaagaatcctggctctatccccctctctttctctcttgtctttctcagagttggaaatgtcagagggatgagcaggagagtggtctacaaaaatccagccatgggcatggagaat

SEQ ID NO: 26434 - DNA, 1028 bp, Homo sapiens
tcagttcttaattctgatgcccacataatcatcttgtaagaagaaatggtttctccaggtctaactgcttgttttgagctgtgtttgacatctgactggcacattggtgcctggtgttaggttaacaagcagttcataagaccattcccgtcagtgatggttttgtctgatttccgcactgagtaactagaagagatgcttttgcagagtattccaggtctcggctagttctccacattctcttagaaatgaggtcaaagaaaacatttggatagattcttgaaattctttatagcagaatttggtgtgttttgaattatttaataggatgagggccaaagaaagctttgtactctcaagttctattttcaaagaatctggggagtgagtctttagttccttttctatatcctaggaaatcaagtggaaattcttcttcaagtcttggagaaatggtatctgggacattccgagcaactcccacatcaacaggtgagggttgtagttaaactctttttcatacactgtattccttttaaaaatatttgaacacacatgcaagtagttttgctaatttggaaacaatttgaaggcttaatttaaagattctctaattaatatttcatttctcatttgttttctatggtaatttgatttcatttaaaatggtattaaaaattcatgtcattagaatataattttgaaaaatcttatttacccctcagtgttaataactgtccattgtgtaaattgatattcaaaaaattcattattttacctaaggaacggacagagtttaagatggtgaaggccaataaaaaaaggaaaaaaatgatgcagactctcaagaaaatgctgttttcagtctccatgtggaatttcaggatgtattagtacagcccgagctggaagggttgaagcagagagtaaggcagggcccaaaggagggagggcctcgtttacatttggacagcagacagccaagccctggaattaatggtaatgaagagatattggtggcctaatag

SEQ ID NO: 26435 - DNA, 1050 bp, Homo sapiens
gcaggtgtcttacatgcctggagcaggaggaagagacggggaggtgccacacacttttaaacaatcagatctcactataactcactcattgtcacaggaacagcacaaggagatggtgccaaaccattcatgagggactgcccccgtggtccagtcacctctcaccagtccccacctccatcactggggattacatctcaacatgagatttgcgggggacacagatccaaaccatattatccctttttttctaaaattttgtcttccatgcccctttttagacacatggggagcatgtgttcctgtcttggggtctttgcatttgctgttttttcttactggaacctttttcttcacacttacacccggccactccatctgctttatatctttgttaggtatcaccctttcagtgacccctttcctgccaattgtatttaaaattgtacccactccccttccctgtacttcccatcccttccctgacttagttttctctgttgcacttattactctcagaaatattatatatttacctatctatcttgtttggtataagctgagcatccataatctgaaaagctgaaatccagaatgttccaaaatttgaaactttttgaggactgacatgatgctcaaaggagatgctcattagagcattttcgatttcagacatttggattagggatgttcaactaagtatatagtgcaaatttccgaaatctgaaaacagtggaaatccaaaacatttctgctcccaggcattttggataagggatattcaacctgtactgatatgtcctactagtatatgactcaataagggaaaggattttgtctccccaatgccgctgtcttatttctactttccaaaacagggatgtacaatccatatttgttgaataaaataactgaattattatcattttcaaagttttattgttattattatttcttaattgttacagtcatgggccatataacttttttgtcaaagacaaaaagtaggaaggtggcagctcccgacggcatttgtgggcttcagggaag

SEQ ID NO: 26436 - DNA, 1029 bp, Homo sapiens
aacatccctgttttcatcctcaaggttgtttttctgctcagtgttcttgttgaccacgtctgggctgctgcaggacaatgattgaagttttagtagtgaaagagttcaatagtgttgacattgaaactggaaaatcattttactaatgtaagatgatgctttactatattgaaatcttagacaaatagatgacccatagcccaaatacaggtaggatttatcttttgtaataagctgagtctctttttcctttagatgtatatgcaaaagagaagatggatgaaaactaacgtttcacaagtgatatgggcttaatatagcacaaaacaagaagaattggtgctgagtatcacataattttcattgcagtttacttcctagcacttaatctagtcaaaatatttttcttcacaacattgctactttccgaataactcagatgcttaactatattctgccatctaaatttatatctgcaataaggcatggagtgtgtgcatcaaattttaggcaaatgaaaaagaactcgccccaggatactgttatggatgtgacaatttaagaagctacacatcatctgaaactattctattttctttgccagggttcagcggattcctacacaagcaggccgtctgactccgatgtctctttggaagaggaccgggaagcaattcgacaggagagagaacagcaagcagctatccagcttgagagagcaaaggtgagtctctttccttctctttggctcaaaagtgggtcgttgctcagtggctaccagctgctcttcccttacctcacatttctggaataatcattttgtgattattctaacaaggctccagattgggaagctctctgatcctttcacctctaagtgaggttagtaacatctccaaagaggcatttcctcagaaccttcacctttttgtatttggtttggtggtgaattattggtcgtcttccaacttagcaatatcaaacctcccatgcccagtgttggcagacagccccccaggcaccagctgg

SEQ ID NO: 26437 - DNA, 1132 bp, Homo sapiens
agttcaagaccagcctgggcaacacagcaagactccatccctacaaaaaattataaaattagccagccaaggcagcacacgcctatagtcccagttacttaggatgcagaggtgagaagatcccttgagcccaggaggatgaggctgcaatgagctatgatcatgtcattgactctaacctaggcaatagagggagacccccatctcaaaaataaaataaataaaaaggtaaatttacttatcagttgaccttgagatggggagattgtacaggattatcccagtgagtcttatgtaatcacttgggttcttgtgagtggaagagggaggcagaagagagagaacaagagagatggcattgtgaggatgactcagtctgacattacttttttgaatattgtattagtccattctcacactgctataaagaactacctgagactgggtagtttatgaagaaaagaggtttgactcacagttctgaaggctgtacaggaagcatggctgggaggcctcaggaaacttagaatcatggcggaaggcgaaggggaaggggaggcaggcacatcttaaccgtggtggagcaggagagagagagaaaagggcgaagtgccacacacttttaaataaccagatctcgtgagaactcactatcacaagaacagcaagggaaaaatcagccccataatccaatcgccctccaccagaaccctcccccaacactgggaataacaattcaacatgaaatttgggtagggaaacagagccaaaccatatcaaatatggaggaaggggcctatgagccaagggaggtggctggctttagaagctggaaaaggccaggaaacagatcctcccttagagcctccagaaggaacacagtcctgctgacaccttgattttaggccagtgagatacattttggacttctgacatccagaactacaaaatattaaacttgtgttggcttaagccattaagtttgtggtcattcttacagcagcaataggtaagtaataaactcttagatgaagaaaggtcagtgaggcatgactagattagtgtggctcatctgctgtcgttcatgttgttttaaaccaagattcaccatttgatattcattatttggcat

SEQ ID NO: 26438 - DNA, 1032 bp, Homo sapiens
tgtggcatattcatagtggatgtgtgtgtttagtcataacatgaattaatcaacagttaatcaatgcatattattgaatttctgtatggaatgtggatcatagaaatggtaaataaggattttttcttttttttgagatggagtctcactctgttgccaggctggagtgcagtggtgcgatctcggcttactgcaacctccgcctcccgggttcaagcagttctcttgcctcagcctcccaagtagctgggactacaggtgtgcaccaccatgcccagctaatttgtgtatttttagtagagacggggtttcaccatgttggcaaggatggtctccatctcttgatctcgtgatccgcccacctcggcctcccaaagtgccgggattacaggcatgagccaccgtgcccagccgtaaataagaatttttaactgagtctcacgtctgtcattcttcagttctggactttagctgagttacttatgtctttgaacctttgtaaagtggaatgagatgaacgagacaatgctgttaagcacctagaacagtatctggtaggtgattggctgaaaaataaagcactctgccatactttgcccacttcacctgtgtatccaattggatgtgtatctgtcggtaggcatagcctcccctgaactctcactggcctctaaatctgaccaagcggcgacattcacttccttggacatttttacatttcccaagtttacaaagtttacatgacatagaaagagagcagaatagtcttggtttcacataggtaacactccctttcccttttgtcccctgtgatcacactggtggagacagtgacctcaagttcttattattcaacctagaaagcagctagctggtctttccctcagggccggaaaacttttctgtctgcattttgcaaactttatatagttcagctattccttccttctcaggcaccttataactctcttcagagtaggacaggagtgtcgtcagggtgttgtcctcctcaggcttctgattctatagcca

SEQ ID NO: 26439 - DNA, 1058 bp, Homo sapiens
gctgtttgaacttctgctccttgggaaattaaggtgggctttctggcactctgcgttatgcaaaagctgtttacatttctgtttcaaacagcacagaaaaatccatgaattgcactttacaactgaaatttgttatagactgagttgcttagttgaccaaatcttgggaatcttaaagttgatatagttttgtttgttagttttgtttttgacggctggtttaagacttccttcattcaccagcacctgaaaactaaatctatactagtttgggaatttgaaaactgggtagattcagttataaggaaaattataacaaaaggatttagtcttttggaaagcaatccagatctcctttgtctaggcattttatattccttgaagggaaagctttttgaaaagttgatacttcagttgaataaaagaacacatccgatcttgaagaatatctaatagccttatcaatgctatttcttcaaatgttatcagaagtctcatgtttatattgacattgcatgttttgataatttgtagtagaatgtaaacacagaataacttgaattttcttgagtgagttcagcatctgcattcaagtaaagtggatttctatccgcatatggatttgtctgtaactactgtaatgattgtttctaaaaatttagttatagtaacacagtgtgcttcgctaggttcagataaccaggttgtatttaggctgtttttgtgttaaaaataggaaagactacacaggctaaaaatcaaagcctaaatttcacatattcagagacaacatgataatttccatgaattcggcctcatgctaagggctttgatgcattgtctcacttttactcaagaaatcctttgtggtatataagtgtaataggagttgccttattacgaatgaagaaactgaggcttagaaaattagtcagatatccaaaggcaaagttaataagtagcagtcaaggatttaaatcaaggtctctgattccaaaacctgtcactcttcagtttaagaagcttccttccatctgcacaagaaagccttgtttgaa

SEQ ID NO: 26440 - DNA, 1035 bp, Homo sapiens
agcaattcgtaggtttaaatggctggttaggggagcccagtaaattcagggggcattatgattcgatagagctctggaccgactggttattactttcctatcttgtggtattgcacatttatttaaagctaatttgatattaaaagagtaacaagctattagaaataatttttttaaaactaatgtttttgaaaattatgatactattgcctttcttagtttaaaagagaatggatttctgaagtacacaagaccagagggtcaggtagtatttatagcttgctctcccacgcaaagttcagaaatccagtgactataggggtgccgtgagatacatggctgcgaaagatttatttggatcttgctattttaaatttttcaatctatcttaaaaatttgagagttcattttctgttatgaagaaaaatgcattactaaataacttgcaaagccctgtgtgtgtgtgtgtgtgtgtgtgtgtgtgtgtgtgtgaccaaagtttatggcttttttatacttttggacttacgagacatacctacaaatataagaggtccttgattttttttacattctcctctactttctatcagtaccaatgtacattatttttattatttggctccaaatttatactgttttctatgtagatgaatgttattttccttaaatatttgatgcaagaatcacttctgagaattggcatttagatcaagtaattcagtttgtttccatttgcgcctcttggggaaaggctttggacttagtgctccaactaattttccatccaatactgcaaaggaaatgaccaatcagactgagaactaagagaaattatatcaaaaatccaaatcttcatgaggaattacttatggacttggctaaaaggtggcggatatttttctctttgtaatgatctacttaagctcaaaaactcaatagagttgaagatttttctttgaattcatttgggctttgaaaaagctgtgtaaaattggcaatttatctgtgtatgtgtttttagctcacaaacat

SEQ ID NO: 26441 - DNA, 1042 bp, Homo sapiens
cgtctcaaaaaaaaaaaaaaattacgtagaattaccatatgatccagcaattccacttctgaatatatgcccataaggactgaaagcaggaatttgaacaggtatctgtacaactgtgttcacagcagcattcttcacaatagccaaaatgtggaagtaacccaagtgtccatccacagacggatggctaaagaaaatgtaggatacacatacaacagaatactatccagccttgaaaatgagggaaaagtttgactcgtgctgcaacataggtgaaccttgaagacattacgctaagtgaaataagccaggccccaaaggaagaatgttttatggttccacttatatgaaatatctagagtagtcaacttcagagacacaaattctaatagtggttgccagggtttgggggaggacagaatggagagttagtgttaaatgggtacagagtttctttttgaaaagttgaaatggaagatggaaaagttctagagatggatagtgatgatggttgcacatcaatttgaatgtagttaatatcactgaactgcacacttacggatggttaaaatgctacattttgttatgcatattttcccatgatttgaaaaatggttaaaaaaaaggcacatacacaaaaatacaataggtggtagagttgtcagcggagagggataaaatggtaacagtaaggccttattgacagaccaggtgtgacttgccggcacaaagtacttattaactcatctaacttattgctcatctccagcaaccctctgaaacaggtacttattagccctgctttatagatgacacaactgagaaagggaagattacttaaggctctactagtcaatgggaagtttctaaggtagccgtgtaattgaaggtggaccttggaggagaggcaggattggggtggaaagaggataggaggtattctagatagataggagctggctaaggaaagatccagaaactggtgggaacttaaatattcagctgccatgacgatggttggtatgtagggttcgtatgaatg

SEQ ID NO: 26442 - DNA, 1051 bp, Homo sapiens
tcccagcactttgggaagctgaggtgggtggatcatgaggtcaggagttcgagaccagcctggccaacatagtgaaaccccgtctctactaaaaatccaaaaattagctgggcatggtggcgggtgcctgtaatcccagctactcaggaggctgaggcaggagaatcacttgaaccctggaggcggaggttgcggtgagccgagatcgtgccactgcactccagcctgggcaacagagcgagactccatctcaaaaaaaaaaaattgttttagaggtgctggttgaggggagtaatggtggaatcacagaattttagagctggaggaaatggttcatgaaggttttggggcttacattcttttctttctagaattaggaagcttggtttcatggttttgacaaacgagcactttgtacaagagagcacattcagccttggtttacagcgccttgccttccatttgtttttgtccttttgattaacattcctttggataattaaattaagttaaacatttaaatttctaatagtggaacacagtgactgcataaatgttttcataattggttctctgaggcacaaaacttacaagaaatgaaaatggccaacaagacttttttttaagacagtttttccatattaatttaaaattatgattttttttttttttgagacagagttgcgctctgtcacccaggctggagtgcagtggtgcaatctcagctcactgcaacctccacttcctgggttcaagcgattctcctgcctcaccctcctgagtacctgggattataggtgcctgccaccacacccagctaatttttgtatttttagtagagatggggtttcaccatgttggccaggctggtctcgaactcctggcctcaagtgatgtgcccacctcagcctcccaaagtgctaggattacaggtgagagccaccatgtccagccaaaaattatgattctttagattctacgcaaattatctgtaagaagaaagctttagaaagaggcctgtactggaccaagaatgactcttttgtttttg

SEQ ID NO: 26443 - DNA, 1071 bp, Homo sapiens
taaaaggcaaaatagattctcctgtttgcagcagtcaagttgaaaccagccatagctgtaggcaagaaattatagagagattatcatcttagtgattgttctgtaaaattgctctaggccaaaggtgctgctttcacatttttgtaatttaacctctttttaccttcctgagccacagtgtgcatttgtgtttctaataagctgtctttttccaggaaggaattttggtgatgtttctgcctgtgctcacatatagaaaaggggtgctacgtgttctgggccattctagcctcccctgaatggacaatccatatgatataaaaatatactgttatataatcagagtttccaggtaaaataattgccacttccttcttaataactcatttttgttcttgtttatctaaaaagctaactaatgttgattttatttctatatgatcaatttatttttctcttattataatagaggttgttattaaagaaaaagttttccatccttccattgattctcagttactctaaggaccaagacttgttgatttccaatctgcctacattctagctcatttatcagaacttttcatcccctctatttcaagctatgttctaaaaaaatctttccaactgttcattacttgtgtttttttccttttcattgaatctgcaaatgtttaatgaatccctgctagctgcgagtcactgtatttagagctgcgggatgcacagctatgcctaaggtaccgtctgaactctcttggaactgtaggactgggaattccagtctgtgctcttggaggttgcgtgagggagagggagaagaggctacttataagactttgagggtgtactttgatccaccttttcattccttgtctttttttttttaaaatgtggtaaaatatccataacatttaccattttcaccatttttaagtatacattcaatggcactaagtacattagatgcagaatttttgctcctcctcccagctcctggtgaccactcttctactttctgtctccataaatttgactactgtaggtagctcatataaatggaatcacaca

SEQ ID NO: 26444 - DNA, 1046 bp, Homo sapiens
caaggctaccgcttatgaattcttccttctttatcctagaaattgcaattgattgttaccaatggcctggagcttgcatatttctcttaaaaacctagctcatgccctctcttgtgcacaccatacagtcacctgagagtattccagtgctttctttggttcttctgcctccatctgctctcttctttcttttaccctccccaacagttggtccctaaaatagtagtactttagatctagaagcaacctcagagaagggctaagatttggctctttcactttacagctgaagaaaaagaaatccagcaaaattaaatgatttgcccaaggtcctataaccagtggactgcaaggctggactagagggcagagtttccatcccatgggtgcaggccaggtcctgagggacacgcttctctctgtagagagctgtctctcctgctcacatcctgggtaaatccttattggcaaagaataaggtgggagagaaggtggccaacaaagtgctagctctgccaacttctctcatcgtcaggagacaagtgttgcaggtactttttattctctcccttttagtgtggggatgaagtggaggccagttggtttcctattggacagattctctttctcccttggattctgcctggccgtctgctgatggccccttctggatgtaacacatgttatctggaatagcgcaggtggggatgggtgaagagcattcagatagaagtttctgatggtagtgggcagcagggtggaatctcactttaacccacgggttctcagctggggtgattttgccccccagggaacttttggtaatgtctagaggcattttttgttgttacatctagggggtgctagtgagtagtacatctagtgagtagagaccagggatgctgtcagacattctccaatgcacagacagcccaccataacaaagagtcatctggtccacgatgtcagcagtgttacccaactgaacttgagtcctctcacccagcatgcacaaaaatccaaacactgatactaggatttgcagg

SEQ ID NO: 26445 - DNA, 1070 bp, Homo sapiens
gccaaaccatatcattctgcccctggcctctcccaaatttcatgtcctcacattgcaaaacacaaatcatgcctttccaacagtcccccaaagccttaattcatttcagtattaacccaaaagtccaaagtccagtctcatctgagacaatgcaagtcccttctgcctatgagcctgtaaaatcaaaagcaagttagttccttccaagatacaatgtggatacaggcgttggataaatgttgccatttcaaatgggagaaattggccaaaacaggggctacaagccccatgcaaatccaaaatcccacagggcagtcattaaatcttgaagctccaaaatgatctcctttgacttcatgtttcacatccaggtgatattattgcaagaggtgggctcccacagtcttgggcagctctacccctgtggctttgcagggtacagcccctgctcccaccctggctgctttcacggctgccgttgagggtctgcagcttttccaggcacacacacagtgcaggctgtcagtggatctgtcattctggggtctggagaatggtggtcctcttctcacagctccactatgcagtgccccagtgggggactctgtgtggggactccaaccccacatttcccttctgcactgtcctagcagaggttctccatgagggctccactcctgcagcacacaagtgcctggacatccaggcatttccacacatcctctgaaatccaggcagaagtttccaaacctcagttcctgtcttctgcacagccacaggacaaacaccacatggaagctgccaaggcttgggacttgcaccctctgaagcaatggcccaagctgtaccttcgccccttttagccacagctagagtgactgggacaaaaggcaccaagaggctacatacagcaggggggatcctgggcacagcccatgaaaccatttttccctcctaggcctctgggcctgtgatgggaggggccactgtgaaggtctctgacataccctggagacattttccacattctgttgatattaacactggactcctggttacttatgccaatt

SEQ ID NO: 26446 - DNA, 1025 bp, Homo sapiens
tttatttactttgctgtcagctgatcaggctgagctataaaagacccagtgtggagggtatgtgtgaaggaagaatttgattctactgaaaaaaaaaaaaaaaaaaggcgtgttctttatgtgcttgtgatgagattcagtgggaggttggttgggggtgagtatctggtgatgatgctcttatcactgccacttctgctgcaagatcaatttcctaggaggctttgaggtcttgacccacataaaaatactcctcccctgccctccaaactattgggctttgttttatcccatgtttctgtgatagcatgtatgcaggtatttatttgggaattgattccatggagtgggattggagcgggtgaagaactaatatcagaatatattaacaagttggccagtgctgggagcaattagtgattggtgataccatgcctctctgtgaagccccatgaaatgtggatcagaaatgtccaccctggacagcggtagggggaagcatttattcaccggcatctgttccccattgactgagagtagcctcacaggggttagctccctcatactacctagttgcacatgcgtgagtgccaagcatccggcacctctttgtggccagaaagccaaaggtcaccgcctcagtgtgaagctggtcaaagcctatgtgggcctgattattgccagtggctagaggggtagggcctagaggacatgacatggttcccaaagggaccaactgtgcatctcaaagatatcaacatctctttcatcagttcacttttttatagcctctgtgaaaggagaattctcctttctatccttccagaaaacataggtgtggattcttcggtctcatataataaatctatactaatgatcttaccaccctgacccttctaatcacctcctcagatccagcatctccacctcattaacaggaaaccatcttcctatccaggcttcttggagccattccatctgggtgttaggactggtttcaggtgtccttgtcaggagtttgaacc

SEQ ID NO: 26447 - DNA, 1144 bp, Homo sapiens
ttatagcaaaatatctgtacatttaaaaagatcatataactacacatccaaggaaaagggaccttcaccaaggggttcacataagcacaacataaaataggaacttcagcggttaaatactatacaataaactttacaattaatatattgatgtaccaagaagataagccagaagcagaatgtatattatgaaaagtacaaatttagcttcagtccagtttttgactttggaatggatcaagtgccctgccagagaggaaggaaaataacagtggcttagtgggccatctagtcccattacgtattatttaagcttaataccatgttaatacttttcagcaacttaaactgcaattctccataagtagtctgggaaatgcatgaaaaacttagcctcgatacacgatgccaagtgtatcttcttgaatttataaaaaataagaaaaaattgcgattgtcagaggagagtaaggccaggttcctaacactactctgctagcagatgtaaccttgaatgcttgttgatagagctagtaaacttccttgcaaggcaccaatttctgttctcagaattaataatggtcctcagaaatgctaatgctgattactgagatgttaattttaatgctaataaatacacttgcattatttaaaaagctgcctctagctgaagaacacagtactgcaaataagtcttatacactatatccccacattcatactagtgaatgcctctcacagagcatcgttctctagcgcagaagtagtagaatgtgaaactggaaacaaaggattgagtgacctttgtgccactgcagttgcatcctgtttgcactttgccagggcctggttatagacaaaaggagtttcatcatgtgactttccttcttccaaattgcaagtaaaatacaaagttgatggatatggctaaaacaaaattccttcgaagacatctcagcaaaggacccacagcagatgcattgatgttatttacaacatcaggaaaccaggtgggccatgatgggacaatcacaatggcaggtaatgagtttaataagaactttacattttggttaaaaataacatactggtgtaaaaagatacctaatcaaatcaaatcctattgctttgattaatctgaaca

SEQ ID NO: 26448 - DNA, 1050 bp, Homo sapiens
taacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtgtgtactagtatttatttctacttaaactgctcagctctaaagaaattgtatgatcactttaaaggtactaaatccctgaaattttgcttcatcttacccacaccgctagtttactttccttttttaatatttaagaatattataaatcag

SEQ ID NO: 26449 - DNA, 1725 bp, Homo sapiens
gaggctggcaactgcttgagtccagaagttcaagaccagcctgggtaacacgatgaaacccggtccctactaaaaatacaaaataataataataataattagccgggtgtggtggtgcatgcctgtagtcccagctactcaggaggctgaggtgggagaacctgagcccaggaggtcaaggctgcagtgagctgcgatggtgccactgcactctagactgtgcaaaagagcgagatcctgtctccaaaaaaaaaaattattcgcgctatgccaaaggttactgtgttaaacgtcacagccagtagaaagatttcagtccttattcaatgaaaacttaacatttactactcttgataggttcctttatcttagtgactttctagacttgatcatgttctacaacggttaaaaacacaaattgtttagccttacctgaagaatttgaattagtaagtctggggtggagtctgaaaatttcatttctaaatttccaggtgatattgatactgttggaccatagtttgagaaccagtgcgctagcatgttaaccttctctgcagagttaggggtatgctgcccccatttcacattttaacttggaaaaagtagaaagaacagttcttcttaaagctaatgatgtagaagttctgctcacctccttcatttgggttcagttgctgagaatttagtcacagggccacaactagctacacaaaggaggctagaaaacttagcttttagctaagcagccatgtgcccagaaagaaggggaggacagattcttaggagggctattatacactcttccacaacttaagctttaatgtctctgatgaaggttttgcagtggtttaaaataaggagacatatatgaaaaaataataatacagtgaaaataaggtctgggtcatagaaaatacgagactataatgtaaacaatattgaagatggagactgtgaggcaaaattttgatgtgaaggctgttacggttccttaaataagcttaaatgtggctttgaatcagattgctatgtgtctggcatagtttctgattactactaatataattggtgttaagtatgttgtattaatattctttcagatattcagcctggtaattttcctgttgtgctatttcaaaagatttatttaggactttagtgaaatgaattaaaagagaagattggcattagacaataaaagatcattaatggagagcttctcagtagttatgattatgatgatgactagctttttatttagtgttcatttgctaatcagaaaattcatcatgtctgtgacaaggaaactatgatcttgtttttcttatgtcttaaaactggtatttgaagtcagttttgtctggaaaggattgatctgaggctttcaaggagaaccagaggaatgtatagtgtctcagaagccaagagtttggaattttaagatagagcatgatccccaaatgcacagaatcagtatcacctgggaaattatgaaaatgcatattctcaaactccacgtcagacttacagaatcagattctggaaatgggacctaacaatatgatttttttaaacagtccttcaaatgagtctttgagaaacccctgaggtaaaggaatccacctaaagtaacatgttaagaaatttttatggaatgaggactgaaagaatactgttaagggtggcatttaaggtgttaagagtggcatttaaggtgtttag

SEQ ID NO: 26450 - DNA, 1021 bp, Homo sapiens
tttttttttttgagacagagttttgctcgttacccaagctggagtgcaatggtgcgatcttggctcactgcaacctctgcctcccgggttcaggtgattctcctgcctcagcctcctgagtagctggaattacaggcgtgtgccaccacgcctagctaattttttgtattttcagtagaaaacggggtttcaccatgttagccaggctggtcttgaactcctgacctcaggtgatttgcccatctcagcctcccaaagtgctgggattacaggtgtgagccaccatacctgaacggctttttaatattttccttatttagagtagtgaggggatttttctattcagtgtttggatttagccattttttctaagttttcataaattcagtttatacattgtacaaatgtgtgtgtatatgtgtttgtctccatgacacacagaaggttgagtttgagtatattgaatttctttaaaactgttgtgtcttgttgactagctttttctgactctgaagagcttattacttgtgatagttacatgtgtatgcttttttccttatgcccagttttctttgcatttcaaatgatttttctgtataaatttttgccactgtatcatttggcactgcattttagacattttctatcttattacaaataggataatcagtaatacgaatggaccataattgacctgttttcctatgggtgtacattgagttaactgtaatttttcaccattacacgtaatattataaataacgtccttgtacatgtttgcaacaatatgaatggaagttttcagagtgaaatttcaggttcaagcggtgatgtttgcatttttaatatttgtaagaactgctgaattgcctttatgctaatttcattcccaacagtaacacatgagagtgagaaaaagtaccctttttctcacacacctttcgcattgtatattaatggtctttgtcatttatctgatgagcaaaaagtttttattaatgtgtggttttttgattggcta

SEQ ID NO: 26451 - DNA, 1030 bp, Homo sapiens
caggagggaggatcttttgagcccagaagcttgaggctgcagtgagctgtgatcttgccactgcactcctgcctgggcaacagagtgagaccctttctcaaaaaaaaaaaaaagaaaaagttgttacattgtgagtacagtatttttcctatttttattttaacctggttatcgtctattcagattattttgtgtatttgtcttgtaaccaatgacattaccagatttccttatcaattcaaatagtattttaaaactgtaactagatttcactggaattttatatgtgtaaaaatagcagtaaaggcaagagaactttacttctccaaaatttacaccagtaatttcattttattgctgtggtatatttgctagaattttagtgattccaggcatgtttttgtgattttaatggaagtggctttagggtgataactgattgccttttaatcatttaggttttttatttcttaaattatttcatttgagcattttgcttttatttttttattttttgaatacttgtgaacttagttttctgggtgtgatttgatcatacaaagtttaatagtgggatcacgtgttttttttttttttcatttgattagatagtggaaataatttcttctgtagattttctaatattgaactactcttgcacttctacagtaaattctgcttggtcagagtgtgtatgttgttaaatttaaattcatgatgctcttctggtatcttttctgcttcttgttaattaatggagagcatttcatctttttttccccataatctgaaatcatgatgtaacattgcaattctgtgttctttaaaggttgtataacattctgctgtgaaaccatctggttttgtatctttctgttgtgtctgtgttgttgggatgttcaagtgtgatgtgctttttctggggtcaattttggttaagtgatttgcttggaaatcattttctctaggttttgattggttgtaaatctgtatctgtgattgtatttttcctcaattctgtttattattt

SEQ ID NO: 26452 - DNA, 1046 bp, Homo sapiens
acttagtagagaaggaggaataagaaagatagatacctattatagtagggaaaagagaaacaaaaggctaagttgaatacttatcaaactgcctccaagtgagtccaagtaagtttgtgcattgaaagttcaaactctgagcatgttttgcactatagatgtttattttgtgggaaagatagcaagcacttaggttatatgagacagtctcaaaatctttagagaggatgaggaggagtaagtactatgaatatatgaataaatattaaagctattatgaaggagagcatgatttatcatggtgtaaatattttgcctgttttttattttttaggtacagcatctggtgcagtaagtactcttttaacctttgtaatattttaattttactatactttaacctactttacagttattcttatttctgttctaaggattatctgctaaatctttacattaatccatagttttcccctttttttctatgacaaggattgaaaaattgatttattttaaaatctggttttggtgggacttaatgagagatgagaattacatgtatcaacttttaaaaggatttaaattcttcccatcacaattagaagggaagcagaacttgtaggtacacagtgcttaacctagtaattacaagttaagcattacattaggagataatcttttttttttttttttttttttttttttttttttttttgagacacagccttgctctgtcactaagactggagtgcagtgatgagatcttagctcactgcagtctccgcctcctgggttcaagtgattctcatgtctcagcctcccgagtagctgggctacaggcgcccgccagcatgcccgactaatttttatatttttagtagaggtggggttttgccatgttggccaggctggtcttgaactcctggcctcaagtgatctgaccgccttagcctcccaaagtgctgggattacaggcgtgagccacagtgcccgacagatgttagatgataattttacatatatatatatatgtatgtatgtatgta

SEQ ID NO: 26453 - DNA, 1036 bp, Homo sapiens
actctgtcacccaggctggagtaagtggtgcaatctcggctcactgcagcctccgcctcccaggttcaagcgattctcctacctcagcctcccaagtagctgggactacaggcacatgcctggctaatttttgtatttttagtagagacagggtttcaccatattggccaggctggtctcgaactcctgacctcgtgatccacccacctcggtctcccaaagtgctaggattacaggcatggcccaccacacccagcgataattgaattcttaggaaatttttacagttttaggtcaggagttctggacccaatttggtctgcagatatactttggcccacacaaagttcttcaattttgtaattatcgctaacatttatagtctgcagattttgagtttgaatttattttgaaaagttggatgatctgactattcaatacttaacagtagtcctgtcaacacagtaggtgctcagagaatatacgttaaatgaactctggttgagttgatatttgtactcagcaaacactagaatgacgtagtggctccattctttaggtgtttagtctgggctctccttggggttctagactacttcagagttacttttctgtcatctccttggcccttgtattaatagccattggagtaaatatcagttcccaataactggccattttgactagtgagattttaatatataatagtaatgcctccagtatcatgattacatagttttccacataaattgatattccagatgccgaactttatgacacaattatgacaatattttttttgttataaacagtattggtcgaaaggtgttgaaaatgtactgtgtgcctttctgtgggttcaaatgggactaaattgatttttttaagatgtttcacagatttcattatttaaaatgttcttaaatacctaatacaattattttcttttatttagatatccagagctgggtactgttaccctcagtaatcttggaaaattacataattttttttttttagttacttttaatacgct

SEQ ID NO: 26454 - DNA, 1027 bp, Homo sapiens
ggcctggtctactaaactcttaaatatttgtttttttgtggctttggttttaaagaagattttatctttatgtgtgtgataaagtcaggatatttcaatttgaatttatatttatttgtacagtctgctgctaccataagagaatttttttttttttttttttttttttgagacgaagtctctctgttgcccaggctggagtgcagtggcgcaatctcagctcactgcagcctccgcatcccaggttcaagtgattctcctgcctcagcctcccaagtagctgggactgcaggcgcgtgccaccatgcctgggtaattttttgtatttatagtagagacgggtttcaccgtgttagccaggaagatctcgatttcctgacctcatgatccgcctgccttggcctcccaaaatgttgggattacaggagtgagccaccacgcccggcgagagactgttctattgcattatgcagattttactctactttaaaaaatacctttaattcttccgagaagttactttgattagtttttctctctaagttttcagaccttgatctcaatttagcttagaattctagttttggttatgttactagcttttgattttatatgtaggttacttaaagtagcaggcagtttccctgttgcctgtcatgcatcttggttgctttcccacacaaccagttacctgattcagcgtattttacattggcctaaagcaaaattaattatgaggatatatctgttggcgggagatgtatgggctgggagtaagcctagttgtagttctttctcatttgattgttgtattttttctccttactttgtaaattatttatctgattctcttagtctggatgatggaggcttgccagtgcttcagttttcaaattctataccttagaaaaaaatacatattatttggaccatattccaagtcagccaccacattcttatagtcacaatttttgtcaaaaagttcttgtttaatgatgtttagacagtttattggttgtttttaacc

SEQ ID NO: 26455 - DNA, 1023 bp, Homo sapiens
tgggcttttatcattgacatattgaatcaaaagctgacacatcgcactctcatttgacctaaactttggccagaagattgagggtttgaggatgggtccctgagtccaaataaaacagtaattgctgctgcttatgtttagtcttctcattatctttccagtcttttaacatgagacctaggggactatcggggcaatatctttactgctacctttatcctttttactccttgtcttgcttagggtatttcccatgtcaggtcctagtattagagacttcttgcctattctctggaggcttgttaaggctcagtcccttgtattagagatttcttgcctatcctttaaccccgcctcctggaggatccttgcatccttcttttgctttgtccactctggctacttccctcgtgggaatttaggcccctcttggcattggcatgccggtatgaaacccacagcaggatccgccctaagctgtatgaagtgaccacagaactgcagataggacccactcactctgcacagcagtagtgcttggtaccattcacacaagcagcaccgcaagcagtagtgcttgtgatcattcacacacactttcatcctccagaatatcccaaccaccaaggaaatactttgtcacccctgcaacatttcttaccttggtctgtgcagagttacctggttgctgcagcatgtgagaatccttttgccaagctgctggcctgtatcttttcttgttgccgagagtctgggtttatttgttgcactggatgggttccaatctctcacactgaggccactgcaacaaggcgatgggatgcgcctccccacaagaagtgaccagagaccggttccccggaggagaatgggaatcctgggtgggcccccaaattgttggaagtaaatgcttggtgtcacaaagtgaaaatatactcaggcaaaagttttctcatcaaggcaatttacttctgtagaagggtgtgtctcgcggatggagcaatggcaagagcacactggaca

SEQ ID NO: 26456 - DNA, 1047 bp, Homo sapiens
attttaatcataacacaaacatcccctattttggctaatatatctagggccattctgttttctcaggccatctggctagtgggccccaattgttctgttaccctttgacagcatccgtggtgtaattataaaccactgctgattataataaatgtaatttatccaatctacgtttttattagttgtcactcacaaaaatattgactcaaatcctgcagctatttgatctcgagttttaaatttaagagcattcacatcttgatatcctgtctcagttgccaaagtttgttttaggtctttaacttctacaatagctaccttggtcttttcattagatggaggaggagcaatagttttgttgtgagaggttttggaagaaggcttaggggaaagtgtaggcagtaggggatcaatgcagcatatttcaaaggatccaataggttctgttcctgaaacctcagcccccatgccataaaactggcttaaagaagggaaccggcttatagaaggggaagaacttggagggtttgagataataacctgtattggacagtactggtttagctcacagctaggggaagctgtttctttagtaaagtgaatgtatggctttaggaaattacagctactggttggggcagtttatccgtgctctttagtggtctacagaacgtttacaactactggttggggcagtccatctgtgctctttattggtctacagaacattggaccaactgcagcataaaagctctgtcttggcggggtgtggggggcaatactcccagttgacattggggtctttattgaaacctttccagactaaatgatcccgattcactaatatccagtctgagcagagccaggaaggacagaggtacttttttggagtggagagctgcttcgacgtgtcaagtctccacagggtataacaaggcaagcatcaaatataatagtttgaggcgaaattgactcggttacattaataatgaggtgatcagcaatagagaggaaagaagaaggagtaatagaatagatgaaagagag

SEQ ID NO: 26457 - DNA, 1019 bp, Homo sapiens
ttctgagaaatttactgatgacctcaaaactaagaatttttttctttattatttaaaagtaaagtgtggatccaggcttttatttttaatgattattttttcaagaatgccaattgaagttgatggtctaagtaaatattatctgatacagcaacataactgattttggtagaccatgtaaataaatagaatctgaaaatagctattgttttggtttagagcgaattttattcctgaaatatcttcctctttgtgtgttggaggagggtgagggagggtggggagtttgtgctctataattctgattcttcataggacagtgccaataggtagttcattttccacttatactatttttttttaatgcttgttgcttctacactcctgcttatgagctgtcccttccatctctagcataaattgtaaatggacattttgtaggagtgatttggatcaaaaggttttaatgctgattcagtgatttcggtagaactgagtttctagagaagcatccaagaaaggtaacaggttcagttaccatgagtaattttgtgcttcatgttaagttctataatagatctttaggtggctgggttatttccatttgagtatttccataaatcatcaaaaatttaggctaacaaaatattttggaagccaatttcatgtgatcttttgctaattagtactgtttgataattgtttaagctttcatggttaaagttattggtgaaattgcagtgggaaaaggagcttgctatgtgtctgtctctttttacttaaccttaagagtagaagggcttaatgtccagtgattttcctctttttttttttaatttggaatattgcccttaattttgttaaaaaacaaaacaaaacctttattcaaaggcaccagccccaaaagattctgcttgcaggagttctttaaataaaagagccttttattctgttactctagaataacacaaattttaaaactctctaggtgatggagaaacaactttgattcctcttct

SEQ ID NO: 26458 - DNA, 1167 bp, Homo sapiens
tccctatgattttatctccgacccaactgatcagcactcttgactcactggccttcccccatctgttgtgggacttttccttagttcacctaaaaatgcggtccttgtcacacagccatgaaaatttaggctcacagacgatttgaagagtgagaaaaaatgggatttcttggttgaaaaggaaaaaaaaggaggaaacagagactcagagaatcgagagagtatgcttcatgcccatgggcttcctgcctcacagattgaatcccaggttccatacaggaagaagaggggccaggctcctcctcactgcaaatggtgcagacttctgtagctccaccccagtgtgcatttctcccagtgcacaggccagctggagcccttctcagctgtctgtcttacatacaccaaattatccttaaaatttctgatctctggatggctggggagactgatttgagtaatagtaaaactctggtctcctgcatggctggtgctgtgtgaattagcctttctctattgcaattcccctgtcttgataaattggctttgtctaggcagtgggcaaggtaaactcattgagtaattacatggggagggggaagaaaaaagaaacctattggtattttattagaattactttagaactatgaatctatcgtgggtggtgattggctatctaggcaatgttgttttctgattgagaaacagcccaagttggctttttccctgaatcttccttcacgtaccctacacttttgttgctaggattatcttagttaatatttttgttattgcaagggtgcaagtatagtattttattctaattttatgatagctttttgatctcataaagaaaaaacattgatttttaaagtacacttatgtattcctatatgtatacttgtcactattaagcattataattattataaaaacagtaatgtttctattaagcttaagcaccaaactggcaaaaatactattaataaaaataattaatttgaggcctaatatgagccaagcactttggtaaatatttttaaataaacacctcacataagcttcacaataacccatgaaattgattcttctatggcttatctttcatagatgaggaacttgaaggttgaagaggagactcagctctttagtggtcagcacagctga

SEQ ID NO: 26459 - DNA, 1035 bp, Homo sapiens
tccaatatttatactttttattttcttcgcctgtagcattaactaggacttccactatgatgttgaaaagtgatggtgagaaggaacatccttgctttattcctgatcttagtggaaactttaaatttcccaccactcagtatattagctgtttgtttttgcagaaattccttatcaagttgagggcttttctctctattcccagtttaatgagaatttttatcatgagtgagtgttggattttgtcaaatgttcttttgcatttattgatgcgatcatgtgatttttcttttttaacctgttactgtggtaaattatattaattgattttggatattaaagtagcctgcatacctgggataaatcctatttggtcatggtacataactccttaaatacatcgttaaattctattttctaatctttagttgaggatatttacatctatgttgatgggaattttggtctgtagttttcttttcttgtgatgcttttgtctggtgtgggtattaggataatgctggcttcatagaatgagttaggaagtattgcctcttcttctggaagagattgtagaggattagtatattttcttccttaaatgtgtcatggaattcgttaatgaacccacaagggcctcatgctgtttttttgggggaaggttactaattattaattcaatttcttaatataatcctattgagatggtttattttgagctaatttttatacatggtgtgaggtatggattaaagttcttttttgcatatgaatatttaactcttcccgctccatctattggagacacaattctctctttactaaattgcattctcatttttgtcaaaaaccagttgccgttatatatacatatagatctatttctagactttttattatatttcactgatttatttgtctatcttgatgccatatccacactttattatatatgtattatattctaattgaacatattatatacttttcttatttattttgtttgttgtctgtctttcttacaccctaaaatgc

SEQ ID NO: 26460 - DNA, 1044 bp, Homo sapiens
ctatgctcactacttgggtgatgggttcaattgtaccccaaacctcagtatcacacaatatacccttgtaacaaacctgcacatataaccctgaatctcagaaaaaagtttggaaaaaaattcttcaaaggttgcacagagaggactttattaggagaatgaatagacatgttcctaagaaaatgcaatgaatagaagggagctaagctaaagcgaagaaagtagtctttatcattcttaaaaagaatgatacttcttttcaatagtcttctgttctttaggtttgactactacttttaatcatattttggcatatagatttatctggtaatacatactttatcatgttttctctagaattattttttaagttcagccttacttgggtaaattctccatgttctttagttttctttttatcgtttaaattttgggagatcagaaccaaagtaaaaacattttaaaaagattctatgagtaagctatgaacaaaatattctgtactgtgctctgattgtaatcaaaatcaatcttctttcttttacttacaattttagctctgaagaaccagcggacgcaagtgaatcatttccttttcctccatttttaggcattatacaaatttccatattattcttgataaaacgacgataaaaacatatccattgaaccctttaatttatatatttatctcttgatcaatttttttcgtctttacatgctttatcattttaattttaaaacacttaaaaaaattccatggaaattcgaatctaatgttttccttaatacatgtggttgacattgataacttaacaatggaagatatttttggataaatataccccataagaatccttagtaaagatacttgtatagtatatatatatatacgtttcagtccctgttattcaatatactttttcttatttgaatgaagaaattccaggtattctttctcttctttttacttttttttttttttttgagagatggagtcttgccgtgttgcccaggctggagtgcagtggcatgatctcggct

SEQ ID NO: 26461 - DNA, 1050 bp, Homo sapiens
tttgaggaattgccacactgccttccacaatggccgaactaatttacactgccactaacagtgtgtaagcattccttttcctccataacctcaccagtatctgttattttttgactttttagtaatagccattctgactggtgttagatggtattgcattgtggttttgatttgcatttctctaatcagtgatgttgagctttttttcatatgattgttggctgcattgtactggtacaaaaacagatacatagaccaatggaacagaatagagaacccagaaataagaccacacacctacaactatctgatcttcagcaaatctgacaaaaactggcaattttgtgttccataaatggtgctgggataactggttagccgtatgcagaagtttgaaactggatcccttctttataccatatgcaaaaattaactcaaaatgaattaaagacttaaatataaaacccaaaactataaaaaccctggaagacaatgtagttaataccattcaggacatagacatgggcaaaggtttcatgacaaagacaccaaaagcaattgcagcaaaagcaaaaatggacaaatgggatataattaaactaaggagcttctgtaagcaaaagaaactatcaacagagtaaacagacaatctacagaatgggaaaaaattttacaaactatgcatccaacaaaggtctaatatccaacatctatgaggaacttgaacaaacgtacaggaaaaaaacaacaaccatatttgaaagtgggcaaaggacatgaacagacacttttcaaaagaagacatgcagacagccaatactctagctgtttcaatcatactgatctttttttgttcctttaacatgccatgtttccttttgcctctagtctcctgcatatgctgttccatttcctaaggacacttttcctcctgcttggcgacttgctaactctgatgaattctttctaagtttcagtttaaattttacttcttcagagaggtcttctttgaatctttagtagttgtatcctcttgtaatatgctttctc

SEQ ID NO: 26462 - DNA, 1050 bp, Homo sapiens
actaaatatatgtgtacctaacacagaagcagccagattcataaagcgagttcctagagacctatgaaataatagtgggagacttcccacacaataatagtgggagaattcaacaccctattgacagtgttagacagattattgaggcagaaaattaacaaagataattaggacctgtactcaacacttgatcaaatggacctaacagacctccacagaactattcatcctcaaacaatggaatttatattcttctcattgccacatggcacatgttttaaaatctaccacacaatcagacatagaactatcctcagcaaattcaaaaaatgaaatcatactaaccacactcttggaccatagagcaatacaaattgaaatcaagactaagaaaattgctcaaaaccacacaattatttagaaattagacaacctgctccggaatgacttttggataaataatgaaattaaggcagaaatcaagaagttcttttggagtaatgaggacaaagatacaatatatcataatctctgggacacagctaaggccattttaagagggaaatttatagtgctaaatgcctgtatcaaaaagttagaaagatctcaaattaacaacgtaacatcacaatgagaagagctagagaaggaagaacaaaccaactcccaaactagctgaagacaagaaataaccaaaatcagatctggagagagacatgaaaatccatagaaaaaatcaataaatccaggactttgtattttaaaaaacaattaacaagataactagactgctagctagactaataaatggaaaagagagatgacccaaataaacacaattagaaatgacaaagggggcgtgaccattgacctcacagaaatacacataaccatcagaggctactgtgaacccctctatgcacacaaactagaaaatctagaataagtggataaattcctgggatgcatacacccttccaagactgcaccaggaagaaactgaatccttgtaaagagcgataacaagctctgaaattgaatctgtaatca

SEQ ID NO: 26463 - DNA, 1031 bp, Homo sapiens
tatcattatggtatgcagctcttcatgttggaaagaggttcagaatcacttcctttaacatctttctattatatcttattctcagagagagtttttaacctatgcactgatgctattgaaaaatcagcccacagtttacaaatcattttagatagcatttaacagagttccgcatcagaagcaaatatctaaggtgcagagttgtgaaatagaacagaagttgacagcttagactgaaaactggctaagggcagaagttaagggtagaagtaaatggaaacatttcaagcaggacaaagaataccttggggaagaagattaaaacaaaatcactaaaacacatagtgtttgtttgatgtctggtgctgtttatttgatgcccaagatgatcctatgaagtaggtatttaactatctccattttgtacaaaagttaaatgagacaattaatgtgaccaagtcacacaactagtaagaggcaaagctgaaattcgagtctggacagcctgacttcagaatttatgctctttatctttaagctcaagtgatattgcaatatctgaaacatattttccaattctatgccctaaagggctcttaatctaaatacaatattattaatttaaaaccagcagaaaaatgtagaaaaaaatggatatttggctcaaaataacttgtgggcatttgttctctatgtgattgccatcctttgtatatttgggagaaattccagtgttacgagttgtgccctctgatgtgaaactcagaacccaaattcttaggctctgtcattgctggagagtaagcacatgatgtgcacgagtctttaatttggagaaaataaacatttcacggagtttctgtttggttggtatctggcactgactcccagatcaattttgtgatgcaggcatggcatcagtgcaggaggcagtaatgatggctgtaaagtaaatctgggcctggtacttggtggtagtaacagaagttgtgttggtacagtttcttacagttgtctggcatgatttgggc

SEQ ID NO: 26464 - DNA, 1052 bp, Homo sapiens
gctcagtccatagggatatgccgatgagggggccacaatcctgtcatcatggaacttagaggataatgaggagtcagggcagagaagtgaacaacgtatatgttgctcaaaactggaggcagaattcgtgctctcctgaactctagtccatggtcctgcatagctactttatttatttatttttttgaggcagaatcttgctttgttgcccaggctggagtacagtggcatgatctcagcttactgctacctccgcctcccaggttcaagtgattcttctgcctcagcctcaggagtagctgggattacaggcatgcaccactatgttggccaggctggtctcaaacttgtgacttcaggtgatccacccgccttggcctctccaagtgttggaattacaggtgtgagccaccgcacctggccaattgttatatttttgatatcaagatattttattggtactttttcactttctaaaacattctcattttttactcatattttgtatttctctttccttttaaaaatatattttatatacttatatcatttaattctagcatctaatgtttctatgggccaaaactactatttacaatggactcttgcttatggtaccttttttcctcatgtgtttgtgaattttcattatgagctcaggtttactgcaatgtttaaaggcatgggcttgttttttccttcaccaagagccaagacttaggcaatttccgttagaaggacttaggcaatttgccttagaaggtttcagggaaatagtcatccttaaattgagggctttctaagcctttttttttttttttttttggacagagtcttgcactgtcacccaggctagagtgcagtggtgtgatcatggcacactgcagccttgaacttccgggcctaagcaatcctctcacctcagcctcctgcatagctgggaccaccatgcctggctaagtttttaaaattttttgtagagacagggtctccctgtgttactcaggttggtcttgaactcctgggcttaagcaatcctctcacctcggcct

SEQ ID NO: 26465 - DNA, 1031 bp, Homo sapiens
atatttaggagctttttttttggaatagaataaaggtgataaacattatgttccagtaaaacattttattttgatgcagtaattgggatcttagagccaatcacgctgaaggttatatgaacaccacagggggagaagctcattttcagaagtctgtggacagatgatagccagtctttgtcctaatatgatctaaaagggtgcacagcttatataaatgaatcgctatgttgagaggcaattattatttgttggttggttaggtgacaaggtgacagaatgtggacctcatggttgatggtgatgcttagcttgactttctgttgatagaggtgtttggaatggtcattccctcaatgaaggtgaaactcatacggtaattcctcttttttttttttttccccttcctttctctcctttgcagatgagaagcccaaggtcaaccccaaactctacatgtgtgtgtgtgaaggtctctcctgcggtaatgaggaccactgtgaaggccagcagtgcttttcctcactgagcatcaacgatggcttccacgtctaccagaaaggctgcttccaggtttatgagcagggaaagatgacctgtaagaccccgccgtcccctggccaagccgtggagtgctgccaaggggactggtgtaacaggaacatcacggcccagctgcccactaaaggttcccatggacttttctatttctagatcaaggggttttgttagtgttgtcctgggtccgtgtgggttaaagatctaagtagctatgaggcattccacctacattttgaatcagaggcgaagagctacaaggaaggtcaccctgggtgaagaagagaaaggaacagccttttggcatctaaaagaaggatgggcattttggggaatgtaagcaaggtgatgtccatcttggggacagcttagctgaccagttagctttctcttggttgctgtgactcaggtgaacagctcccaatacctttttatgttactgacccatgatgtcattcataatttctgaaaca

SEQ ID NO: 26466 - DNA, 1049 bp, Homo sapiens
agcatgcattttctcattgttgcctccatgaccggcttgtctttgcttgctctgacttttcctcctgcctgtggggccctttcaggccttcccagcagcattcccctcaccatctgtattagcttcctagggctgccataagaaattaccacaaacaacagcaatgtaactgccaaagttgtggaggcctgaggtctgaaatcagggtgccagtagagttatgctctaactgatggctttaggggagactctttcctagctcctttcagcttctggtgtctccaggtgtttcctggtttgtggcagcatgactccaatgtgtaccttcatcttcacatgaccttctctctgtgcctctccatgcgtctctcataaagatgcttgtcattggagttaagtaccacctacagaatccaggatgatctcatctcaagattcttaagttatttacatttgcaaagacccttttcccaaataaggtcacactcacaggttccaaggttagaacgcagacaaattgattggcaggctactgttcaacccactacactacctcagtcagcagtcataacttatttctgtgacctcttgacatgactggcatgcctacacaacttattgggaccccatcatctctatcttactatttttggataattctcacctctttcactaaatcataagtccttgtcttagtccatttgtactgctgtaactaaatcccttagtctgggtaatttataaacaatagacacttattgcttacagttctggaggttcaaagataaaggtgtgggcaggatttggtgtctggtgagggctcactctgcttcaaagatggcaccttcttgctgtgttctcacatggtggaagggggggcccagggagctctttttttataagagcatgaatctccctaatgacttaatcacgcaccaaaggctccccccctcttaatactatctcattgggtattaggttccaatgtatgaattcttgtggggacaccaacattcagaccacagcagctcttgaggtcaaaagggttt

SEQ ID NO: 26467 - DNA, 1090 bp, Homo sapiens
tttagaccatataggataacttcctgacattgccgtggcatttgtaaactgtcatggcgctggtgggagcatagcagtgaggacgaccagaggtcactctcgtcaccatcttggttttggtgagttttggctggcttctttaccgcaacctgttttatcagtgaggtctttatgacccgcatcttgtgccgacctcctatttcatcctgtgacttagaatgcctaactgtctcggaatgcagcccagtaggtctcagccttattttactcagcccctattcaagatggagttgctctgattcaaatgcctctgacaatcacataacagaacaggaaggtgtggggaatgcagtaaggtgacaggctgtatttgagaggacttgggatgtccaagtagagctgtctggtgagttgtcggaagaaaaacagatggggcatgctggctcatgcttgtaattctagcacttagggaggccgaagcaggaggattgctttaggccaggagtaggaaatcagcctgggcaacatagtaagaccctgtctctattaaaaaaattaaaaataggccaggtgcagtggctcaggcctgtaatcccagcactttgggaggctgaggctggcggatcacctggggtcaggagttcaagaccagcctggccaacatggtgaaaccccgtctcgacaaaaatagaaaaattagcagggcgtaatggttatgtaatccataaccagtagtaatcccagctagttgggaggccgaggcaggagaatctcttgaaccctcaagatggaggttgcagtgagccaaggttgcgccactgcactccagcttgggtgacagagcaagactgtgtctcaaaaaataaaaataaaaagaagaaaaacaattaatatatttaatagcttagagaggaaagggctagatacagatgagagcctctgcttcctggtacaggaggcggtaaagttcaagtggggatcagaatttcctgagagaaaggggagagggtggatctgtcaccttggtccaagggatgagttcttggagaaggaccttgagagaagagtctgggaacagcctgagaggtag

SEQ ID NO: 26468 - DNA, 1026 bp, Homo sapiens
tatctacaatatttctccccatgtgattttcaaaattaagtttaggtaagagaagtaatttttaaattttcataggtaaaaattaagtgagaaggtattcagcttcatttaagatgagaatgtgtaaactactctcccatctcctcatattcatggtaacattaaagcagaaaggaaatggggagaaagtactattcttttaaaaatattaggaagcatgtagttatttctgagaatgaaatgaaatcaattatgttactatataaatacctgctaaataaatggcttgggttggatttgatgtggttatctccaaggtttcttccagtattaactaaagcaatatgactagagaagttgatatagagttgggatttaggatttaagtttgtagtcagtcagcctacagttaaatatgggctctgctacttaataattttgtgaccttagatgaatggcttaacccttaagtctttatttcttccatcataaaagaagttaactgcaatatctgaataaatgagataatgaacataaagtgcctactgcagtgactggcaacaaaacacatgctcaactttttaaagataaatataaaacatccaactacacagtgtactcttttaccaccataatttaaagtagcagttgtcaacttgaattccatccttagtttgttaattgtgactgctagacattgtaagattgacctgaaataggctagtgaatgcattcgttaaaatatatttactaaagagtatatatgaaaaaataagttcatatttcatttttaagtgaaatactgttgtttctgttatacttttattgaaaaagttttatagcttattctatttactaatggctggagactcattagatcccatcagtacttttaattcagctttatgatcctaaagtcttacagtagctacaacctgaatccacatggtctttgctactcattgaaaaagcattgagctccaaagtttccagcaatattaatgcaaatgaactggtcttaatatt

SEQ ID NO: 26469 - DNA, 1064 bp, Homo sapiens
aaatggaagtatgctggtagtttcagatttctctttctcatatttgacttactgtacttcataagccattggaatctgttcatttgaacagtcaatttaatcccctcttttactttagtttctctgttaaataaaaaattattttgatgccattaagcagaactcatcatgtgaatagtgtcacatgagaactgtttaaagtgttgagtaaaacttacacttaaaaaattgtttttgaagattgatagcctaaatacactgttctcaaatagcttataacatttactctgtaggaaaattgctcatttgagttctcattcacaggtgctggttcctgagctagtccatttagatacaaactgcaaattattggtgattatctagttataatatacaaatgcttcttttacttcccagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggtacctacactttatttttattattctaaagtagaagtcaaaccatagcaagaatttttattgataagagtgttctggagatgatctcactggaatcaagattaaagttagattttaggttggctaaggaaggtgagcctgtattttcaaaggatatgactcattacctggtcttttttttccccccgagtttccagtttaaggatctgattgatgatagttcctttggttttgaacctttctgcttttgtgttcagtttgtgcttctagaatatagaatttaattgacagttggacttttttgtacagttgacccttgaacaacgcaggatttaggggcactggccccacac

SEQ ID NO: 26470 - DNA, 1044 bp, Homo sapiens
cctgggttcacgccattcttgtgcctcagcctcccgagtagctgggaccgcaggtgcccaccaccacacctagccaattttttgtatttttagtagagacggggtttcaccgtgttagccaggatggtcttgatgtcctgacctcatgatccgccctcctcggcctcctaaagtgctgggattacaggcgtgagccaccgcgcccagccgcactatatattttttaaaaatcaatataacttctccaccttgtgtacagtcttcatcaagtaattaacaagtttgttcacatttcccttatacgcaaaatgatggctggactgtaagtgtccaagcctctgatgatatactgtgctcaaaaatagcgatgctatgattgactttttaccttagataaatttgtgtaaatgattgcacacaattgtacttgtgtagttatattttcctgtttttgtaattcttctttctcttacccttgttgtgagctttcagtgtattctaatctgctgtcttatttatttctgaattagtctttaacatacatagtattcctaaagaaatgtcttttcttatttgaaggcttcaatagcatccttgagtacagattctgagttttctgaacacttttttctcacttggttttctgaattagtgacattggaatttgcttgcagttctcatgagtcatatgttgggcactattttttgtttgttagtggatggttggaagctgcagaagggatggagtatgccgagttgctgaataacattagaaaccttgtctagaaagggatgcgtttttttaatcattatttgctactagtaaaaaagagtatagagtatttatattgagatgcttacattgaatgaaagtataattccatttatccagaaatgtgtcatttattaacacatatttttagtacctaaaacatgagtttttttcattttgtaggtaaaataatttttttttaactttcacagtgttgtagtccatgtttaaaataaagccttttacagcagccccagtcaggggcttacaga

SEQ ID NO: 26471 - DNA, 1051 bp, Homo sapiens
ttagacatgccagctgcttagggaaatgattaaccttgaaagctctacatgacgtgaagaaatttactttaaagagtaactgtttttaaggcactgttggattcagtcaggcctaagtagcagagctgaggttttttcactaacatgtctcatccattctgctttgtttgttgtaggaggcaagtggtcaacagcaggtggctgtcgagacgtctaatgaccattctccatatacctttcaacctaataagtaactgtgaggtatgagggaaaggtcttcataactggggggctcaaatcaagcacaatctatagggctttttttaaaatcagaatggtgattgggataactcggattttatcatactgctttaatcgtggccaaggcatctagtcttgttgaaatattaaaatcagtgattttatgaatttaagattaatcattttgtctaaagagaatgctttatactgaagccaaatgtatactctccccactaaaaagaaaaaaataaaaatctgtaacatcagagaacaccaagaaccaaaattgttctataatacaagtatcctatatcatattactttaatactcagaaactggaggacctatagcataagatgttgctcaatctagcattacaagtttagcaacatcttgattatgaatttagataaatgtcaatatccttagattgaaagattatattcccaactctcacttgaaccacaaatttcaaaacttttcactttaccatgcagactgtaataaaatagctgtgtagaacttagaataccctggtttctgcattgccctggtgatatagaataccttggtttctggattgccctggtgataacatgtatttttgatttcataaagtcactctttagagacccaaatgaatttggctctaaattagaaaagaaagtattttgcaagtcctggatgtgacaggcattgaaagtaaccatcagttccagagtctgcatttatcagtctaccatcagtgatgagcataacctttttcaaacacatatctctttaaaacaa

SEQ ID NO: 26472 - DNA, 1034 bp, Homo sapiens
tctgacagtggttttatacctatttttttcactggtgataagaaaatatctttttttcttagtactgctagaaaaggaaacaatgaagtttctttcataatcattcttttcaaagtttgctttttgagcagaacttccttgtaatattatatttagtttcaatttatcagggaatccaaatgaaaaataaggttttctttggtgtattttggaaggtagctttaagaaattttgttcataactctatagtgtttagaggattttgttattgtctaagactgctaatttctgttcttcagtttttccattccattgcattgccttcagagtcttaagttttaggaaggcttaaaacaattgaaagattcagtcttaggattaatcattgagagaattaatatgtagcacctattgcttgctggctgtcttcatcctaaccccattcctgcattggttaatgtatcttcaggaggagtggacggatgatggaagcttttccagttttacaacatgagaactcagatcaatttaggttcactttttaaatggatttaaaggagatttggatattttctgtgatttgtctctattttaaggatatgttctaattctcattttataccattttgataaacaaaatccctccttagaaagacaggaaagcaggccactcttctgaaagaatgcccaggctgccccagggccccatgcagcaccaggagaccccatgaactgctgcccactttgcttagtgtttgtgtcatacaaggagttaaatacttttagcatcacttctggactggcatattcatgttaaagagtacattcctacggtcggtaatatcgcagcccatctctgataactgtaaagacccagaacaaaagaggtcaagagccaaagctctagctaaaagtttttttaagaaggggcatacctgggagaaattcagtggttgagaaaaccctaaagaccggagaaggcttccaagatttggggaaaatttgtttatcaagtaattcaacaaatattattg

SEQ ID NO: 26473 - DNA, 1027 bp, Homo sapiens
atcaaaatttacatgtcaggtccttctatagattcaggagtcagaagacagagagatacttaatggagaaacagcataacaggcacttatactaaagagcacaggctcagagctttccacctggccccgcctcttgtttgagcaaatttctcaacctctctgtgccccagtttccttacctataaagtcgggataatcataatatctgcaacgtagggttcttgtagggactaagtgggttaatgtcaagtgctctgaacacttttggcatgtattaatgttactgctactgggaagcttttttaaagcttctaatggtcaatcccagttgagagcttgatttcgtctttttatgttataactgaaaaagctgaggctcagggaaggttaaatgacctttttggagtcacaaaactaggaaggggcaggcttgggaaaagagtccatatctcctgaaatatccactcttcttgatttgccactttacttttcacaagtgaatgttacacttaactctgctctttatcatgaggatgaaatatctgtacttcagtttcttgccaaagaacttaactttgtcctctccactgggcaggtcttgacacaagctcttcgaagaaataagatttatgaagaattgtatgaaggatttggagtttctttgttcatcacagagcttcccaacttggcagacagaggaaaggataatatttgtattatgttatattggcattgaattagattatgttggattgccacctatggatgaggctggtcattgctggaggtgacaggccccacccagtctccaagggttgacagaatcagcatctcctgacatgtttaagagaactagtccagcaagtgtagttttaaaaaaatgttcaacaaaactatatacaaaaatatttataagtggtatttttaattatatgctttataagtacaaatttacatttataaacttatcagggagaacagtgagacagttttgataaactcaaaaatgtggataacagttgcagaa

SEQ ID NO: 26474 - DNA, 1031 bp, Homo sapiens
ccttccagtctatgtccttgttggtcactcctcttcttactctacccacctttctttcagatttgccattccttttattgtttttgtttgtttgtttgtttttgtttttgagacaaggtctcgctctgttacccaggctggagtgcagtggcacaatcacagctcactgcagccttgacctgggctcaagtgatcctcttgtctcagccttttcagtagctgggactacaggcgtgtgccaccaaattttttttgtagagtcagggtcctgctatgttattcaggttggtctcaaccccctgggctcaagtgatcctcccaccttggcctcccaaagtgctgggattacagatatgagccaccaccccttttattcttaatgacatgtcatttgtattcagctcactcagccatccaccccctctgtgaagccttcctcaacctttttgtcccctgtcttttcatcctccctcctccctgatcttcccttggttgaactctatttttagaaactgtactgtactacaccattataagcaatgcaattaagggtagctaaggctgggaacccactcttaaaagcttttcctttctgatgaatgcattctctggcaaggaaattttgaaatcattgccttagtccccttactttctcttttggccctctagttttgtggtgattaatttaaatttaatgtcttcagtctggtatcttcatattcacacacccataccccttataaatgctgttacaaaaactagatggaacaaattgcacaaaaactcttgtgtgtttcctggcccagagttctcagtgggcaacttggcgagtcgctggagttcttagaagaacttttgaaggaaatagaacaattgggctgataagcattcaggagcacagaaccaacccttaaaagatacttgaatgataaggaatctaatgtcttgatgggatctggaaggaaatctcagtcagtcatgttgtattcaacaatgcaagtcttaactttaattcttttatctgaagcata

SEQ ID NO: 26475 - DNA, 1030 bp, Homo sapiens
tttccatgctactgcttttttctgtttacttcgctttgaggtcctggcgtagctgcaggccacacctagaatgctgttcctgtctgccctgtcctctgggcaggggtccaccatagtgtttctccatgtttgggctctagtctgtttttccctttcctgttctggaaagcccactggtggctttggcttaggtgggggtgggcagagagctgctccccgtcactagtcattgagtgtgaggctcctgaagccagtttccacttaggcatcattttcttcataaatgtgtttctctgtggtgagtgaggagagatggtgtcattttcttattttgtgcatttagaaaggctgagatttacaaaactcattttgggtactcgtcactaattagtttaatctgggataacaatggaaaatgaaagattgcatgtttgatcatgcacagcaaagaaaaaagatttataatgaaactaaatatcatgaaagaagagaaggatcagaaaactcaagtgtaggaactgagttctgtgttgcccactgatctccacacccagcccccaaacacacagaggtcctgggtctctgttctagaggccagaactttatgttgtccgaggttctttggaaaagaaattttctttgacattttcaataactagcaatgtgcacattttggtaaaagagatgaaatgatgctttatgattagctttagcaacagaaaagtaaaaaggtgcagagaaagactaatatcttcactttttttcttgttgagcaataacttcctactccaaatagaatattgtgaaataattttaaaacgaaaagaaaaaatgttgcatccgatttctgtaaacattgaaagcatttcccagatcctgcttaccacagaatgacgttctacttcaatttatctgcttcagaagagatgaagagaggaatgaggcttgccagcatttggtttggttagctcccagggcacctatgtattcccaggttgataccatcaccactaaagtgattagacaatag

SEQ ID NO: 26476 - DNA, 1109 bp, Homo sapiens
ttttataagattttgtgatgttaagcttcaaccttgcagttcatattagtttgttcattttgatgaaagaattggcagattttaggtatatgatgcagtttgattttagtctagaaatacataatcagctgttagagctgatctcagctaatttgccagaaaaaaaaaaaatggaatgtaaggaatactttacagtcacctttggaaaaaacaccgtaatggtttggaatcacacttgcattatacatacatagtagtagtagctaactttcattgagtacttcactacctgctgattgctgttctgaatgtttttggcagattaactcatttagtcatcttaaaagccctgtgaggcaggcaatatttgtatatccattttacaattaagaacactgaggcatagattaagcaaattgcccaaagtctattcaactcaaagtgcagagccaggatttgaaccctgacaatcactcccttccaagccaccacactacggctgcctgcctacatgtactgctcaatagcaacccatagagaacttatctgcatcatagcccatcacccttctaatctcagaagtccagtttagggattcctcccacctttttggggagggagaacttgtgagctaggaggtgaatgatgaagcaaatggatgatacagatggtaagtttgtgatgtttggaagcagcattgatataaaaatgtggctgtactgaatgattgtacaactcttaaagctttctacattttacatatacagtcatctctcagcatccgaggaagattggttccaggatggctcaaggtcctgatataaaattgcgtagtatttgtatataacctatgtacatcttctcgtattctttaatctctagattacttataatacctgatactatgtagatgctatgtaaataattgttatactgtattattttcaaattgttttattgctatttttattgcttttccctgaaatatttttaatccacagtaggcggatgcagaacctctttatacggagggtcgactgtgtaggagtgagctagtttcagttaaagcagcggtggttggtactcatctctcacctgcccccacgtag

SEQ ID NO: 26477 - DNA, 1069 bp, Homo sapiens
caaatgtgaatcatttacatcttttcctgtaactgggtcatcttaactgttgttattgcttttgattcactttgtaatttcatataaattttaaggactgtgataatcatttcagatatatgtctttttatctgatttacctgatctatgtaaaaattacttttccaatctgaagacccagaaagactaagaactggcactccaggtaccgtaaaagggtggaaatttgtgaggctcatcagttggaattgatgccgtgtgccggaacagtactgatgactgatctttggagtgtatgcgtgtctgtgtatatgcatgcatttgactaaaacttgccaaagaagtaacagtccagtattcatgttctcaaggtatgtttgcaactgacagtttaaagcagtaacagcaagaagtgtacagtggcaaagtctgataaatatctatagatttaggttcatctccctttcatctttcttattatataaatgcactgaaaaacacttgaagtagaatgacgtgattgtggagagagagctgaggagggaagcagacagctcagcttgttcctttgtgatggatgtctttgtgagattagggtgaagtttctcattctgatgcgtgcagactgtgcccactacttgtaagacacactgtcagatctccttggaaaaactgagcatatgagtcatttacttgtaaaaacttagtagctctgtgttcttaggaagattaaaaatgagtgtttgacaaatatttttctaaagccaaggttatgaatagaaaggacatggatatgcatttgcatgctgtgtattcatgtacttgtatgccatgctttatagattctaagactcaccttttttacatttcaacatctctgcagttgaaatgcaggttgtaagttatggtgtcttttaattactgtagtccacttttttcaaatgtcaattaacatctctgtaattttcaggcagctcacaatcagtggtatcttagattgcatgacatacagtttatgtctgaatatttataggacactgatacagagagatgagtgtgatacttctct

SEQ ID NO: 26478 - DNA, 1083 bp, Homo sapiens
tgcctaggaaaaccagagacctttgttcacttgtttatctgctgaccttccctccactattgtcctgtgaccctgccaaatccccctctgcgagaaacacccaagaatgatcaataaaaaaaaaaaaaaaaagaaagtattgagcctctgaagattgcctttcgtctgcataaacaatggactttttatataacttgattcccctatggagtctgctataatgatctcgaagaatattctttacttctgaatgctttcagtgctactgaaaagaaaaaggacttgagaagttagagagggtatcaacatcaaagtgacttcttcccttccagcaatggtaggaacaggaggaccctaaggcatttcttagtttttgtccaggtcctgtcaaaaatcttagctaatctccctgatcacaggagtaaaagtggatgaacaaggtgattctcctgccttttaagagtcaggctcttagaaactgttttagagaatttcacttgtgtatcattaatcccttaaatgaggtagtatcaatatggcgataattggaacttgactttagaaaaactgtgacatataactcaggtcccttgataatcagtgcctgtgatttttcctgaatgacagctatgtgtttagcacaggcaatatggaccattcctttgtatctgtagccctcagaatttgaacatctatgttatacattcttaagatgcaaaaatgttctgagacattgtccatcaaacccttgggaagtcgatccagacgaagtgtcgtattcacatactgcctttgttcatattgctacggatatttcaagattcatttgtcaggcacaaagttggtcatattttaacatctgttactccttcactgttactgatggaaagatgaagattctgtgtagtgaatacttgattggagtgttgacatttctgacagaactggcaatttttgaaattgagtgaggcattaggtagactgctttgtggattctatattactttcctatggtttatatactattcttgctaattgtgcaaaactgggagggacttcaagaaaaatgagaacaatctaggc

SEQ ID NO: 26479 - DNA, 1179 bp, Homo sapiens
gccactatacccagataattttttaaattttttatagagatgcagtcttgccatgttccccaggttggtcttgaactcctggcctcaagcagtgctcctgccttggcctcccaaagtgctgagattacaggtgtgagtcactgtgcccggcctcttaaaagttaaacatacgtttaatacatttacctggtatgacccagaaataccacccttaggtatttaccaacaagaaataaaaacataggttcacaaaaaagacttacataaagatgttttagcagccttatttttaaagccccaaactggaaacaatccaaatgtccattaacaggagaatgggtaaacaaattatcttaaaatgtcatactacttagcaataaaaaaagaacaagcaactgattcaggcaacaatattgatgactctcaaaaacactccaagtgaaagaagccagttgcaaaaaaacgactttatcctgtgatttcatctacatgaaatccagatactggcaaaactcctctatgatgacagacatcagacagtggttggagagggagttgacaggaaagggacatgagggaacactcgtggaagggaatgtctcatgtcttgttttcagtggtggttacacaactgtatacaattgtcaaaactcatgaactgaacacttaagatctatgtattttattctgttaattatatctcaatttttttaaaaagcaaaacaatctaccttcccctgctaaaatgattacacactgatgaataatccaagatggaaacctagaggatgtgagaagatgttgtaagtgagatttcttgggagaaggtgatagctgcctccaatgtgcacaaatacgtctgtgctataagaatccctagaaagaatgttacagagagtgacctcgagtcaacaacctactaaggaaatggaaatggaaagtactgtatatttccacttctgtgccagcagatctagggacatcaccggagaggccattttagagtgactagattttggtgagggtgggggagagatggggacaggctttgctagcagtaaatatggcgaccctcatgcctcatccagtggagaaggtggtacatggagatccttcctggggtatttgaggtgttcttcagcttgggagtcaaacgatggatgaaagatcagttggtaa

SEQ ID NO: 26480 - DNA, 1046 bp, Homo sapiens
tgatatttgtaatatcgtcaactttacctttgtcttctcaacaacaatttcgtttcatcatccaacaggtttttgacaaatgcagacatttataaaaagaaaaatttgccagaaaaatgtattttcaagtcactagctgaaatactcccacgactctctttgcctcctacaaagtacagctctgattaatttcattgtttctaaaatgacattcttttaaaaaggtgcctaatctcagcctctttttaggtttcattccatatgatcatttgtatacttctatttaaaaaacaataaacacagaaagaattacctatcagagaactggctactagatgatgtttttctcatgctctatgtgatttgttcaaaaattgggtataccttaacttataagtgagttgcatttccaacaattttattccaaacagttcgcttgtcatttggttatttaaaacttgaaattcatttcataaataaatagttatccttaatgatatggtccccagcgaacctgtaagagtctgtaaaagtaacccactttataattcacgtatagttctctactaacactgccattgaaccaaatcaccacatcagatgtttcttggagagaggggtgagttttcagagttagatttccaggaactcgtctttgctttctttgggtgagtgggaagacagggttcttctacaatctttcaacaaggctttgcccttttatggcaggggaggggtttcaagaagatgggaggtgcagcttgtgaagtcacagggatcagggagtttgtgctggagcttcctctgggggtcccctgagagccctcttcacttctagacccactcacctgttttcttgtgctggcctcagagataaactcgttcccttttccccctaattaaaataaaatcttttccttttaagagccgagggttcctagtactgcttctcatgctgagcttaccactactagattactacagcctcacagcttttctttactctccttcagccctgaatcaagcaaacatctcttgaggctggc

SEQ ID NO: 26481 - DNA, 1066 bp, Homo sapiens
aagaaggcactgaagttggtaatgtatgtattttaaggattgtcatcagcactgttgaacattcacaaatggagacattaccaatgatgcaaatctaggtagacagggtatacagaacacaaggtatacaaagtatctgtacaggttagtaggcacttaacaaatgtcagttcctttatattcctttggtcttggcagtctcatgacacctctctgtcttttgccacagcacattccaatatatttttttctgtttgggtatgtgtagtaaaatgcaaccaacttctttggttcattttgttatatacctactgcctctctttatacctctcttcataccatcctttcttattggattattataacagcctttaaactgcttccttgcctctgaatttgtctcatatccaatctgttctcttcactgcaacttcccctccatcccttcattctcagagtagtttttctaaaatactaatctgaccaagttaccttcctaataaaatcttttgatggctctacaagcccctcagatctcagaaaaggcttattagactgttcatgactggcccctggtcatctctccatgctcatctttcactccatactctggctataatgaactttgtatagttctccaaaatagctacactctcttgtctttgcacctttgcacctgctgtgcagactgcctgaagtgtcccctcccattactctttgcccaactcttatttgtccttcatatcttggcttggacataagtttctctggatgactctcccatgactcttggatgccctgagaactgaaacacactgttatatagttatgtgtcacttaacgacggaacattttgagaaatgcagtcttaggcaattttgtcattgtgcaaacatcatagagtgtacttacagaaagctagacagtatagtctactacacacctacattatatggtatagcctattgttcttaggctacaaacctatacaacatgttactgtactgaatactgcaggtaacacaatggtatgtgtgtatttaaacactgaaaaggtacagtaaaa

SEQ ID NO: 26482 - DNA, 1030 bp, Homo sapiens
tctgtaaatacaccgttaaaacagtcatgcaaatttgtgaggtctgtatactgagaggaaattacactaagcctgtataaaccaagttattggaagataaataatttggtgagatacataacaacatgggattgaactaaatttgtttgagctctgtagattcacagctttagagagacattgcttctacagaattggttaatgaagcaaaggctggtgaatagttaataaattgcttaattttgatgctgatggaacatctgaatctccacgtttacatgaataaatataaagttaaaatttgttttgctgttagataggttgctattttaacagattcagacacaagggaattttccaaatgccagctaatactgtagcatcaagaagtctgtatatgccaagggcagaggcctgcttagtggttttccaaagagtggaaagcagaaagcattaacatttacttacacaaaatcctttatgtaactcttctaagatttttcaacttaaaaactttaaaacgttctgtatgattttagtagatctgaagtttgcattcagctattctattggtatgcctgggcatattctaaaaggaaaaatgattcactctgcacttgtgtagtttttcacatgactaggatcaatgaggatggtataaaaataccaaaatttactcattttaatttcatttttgtgtacttttatcatgaaatattacaaagcagaataatataaatgaaacctttgtgtatatatgactgagctttagcaaaccttattttaaattgattttttaaaaaggaacaatggtgtgtataaagttatgcaaaggtaggggtcagcagaagaaacaattacactgcacaggtttttagttactctggaggtccatctatggcttacggggaaggaagttttatgatgtttataagggtagtttatgtaaacccgtaacagtaaaaatattttaatggtaggaataaaagtgccttttaagtgcaacaatcagcttttacggtcaaaaagt

SEQ ID NO: 26483 - DNA, 1050 bp, Homo sapiens
catttcttggggccaagttaaacttattcagggttttggttgatagatcataatgactatgagagtggtttggatcttttgtttcatccagctactgcaaaacctttgtcatggcaacattcaaagattattcaggcattcatgagtcagggcgagcacagacaagccctcagatatattcagacaatgaagccaacagtgtccagtggtagcgatgttatccttcacctcactgttttgctttttagtaggtgcatggttgaagcctggaattttttgcggcaacattgcaataggttgaatatagaggagttactgaagcacatgtatgaagtctgtcaggaaatgggcttgatggaagatttactgaagttaccatttacagacactgagcaggaatgtttagtgaaatttttgcagtccagtgccagcattcagagtcatgaattccttttagtgcaccatttgcagcatgccaattatgtgcctcccttgaagctgaaccaaactctgaagattaatgttatgaatgatcgtgatcctcgtttgcgggagagatcactggctcgaaattctatattagaccagtatggaaaaatccttcctagagtccatcgaaaattagccattgaacgagctaagccttatcatctgtcaacatcatcagtttttcgattagtttctagacccaaaccattatcagcagttccaaagcaagttgtaacaggaactgtgttgacaagatctgttttcatcaacaatgtgttatctaaaattggagaagtttgggcaagcaaagaacctataaatagcaccacacctttcaatagttctaaaatagaagaaccatctcctatagtgtattcgctcccagctccagagctgcctgaggcattttttggaacaccaatttcaaaagcatcacaaaaaatttctagactgctagatttggttgttcagcctgtcccccggccttctcagtgttcggagtttattcagcaaagctccatgaaatctcctttgtacctagtatcccgttcactgccctca

SEQ ID NO: 26484 - DNA, 1047 bp, Homo sapiens
agaatatatgaatcagtcctatagaatgttaaatatttataaaatggttctgtagtacaccaaggttgggagcacattcattccttcttgttgtcttatgatacaaaaaaaaaaaaaaaaaaagcaaaagtttatttctgggcttaaaactctccctctaatatctctctctcttttacccccattccccaaccattcttctctccatccctctcctctcctcttcctctctcttctctctctctctctctctctctgtctctaactctcgctctctcttgtatgtgggtgtgtgtgtgtatgagtttccactgtggattatatacacttgctagagaatattcatttcttttttttcttttttcatctgatgtatattcaaacattgttctttataaccatttctacctcattgctacatattgtacatgtagtatttatttgttgtctttttttgaatgtcatgcatttcgtaagaaaaagacttgtccttgaacttgaacagtctacctcagaaagactgtctttacactgaacagtattagcaacctaaatgataagacgcattagtgaagtgtggcagggtagataatgcacgagtacttgggatactgatggacttttaattgtattcataacacaagactgcttaaaagaacttaaaagaaattatgcactgtgtaggtcttcatcgaggtcccatttgggacattatatacagaatagagctttattcctatgtgcccatctctgagaaatgtgttagcattcccaagtattttacactggcaatctggctacttaagacaaacaaattcaaacaacatttttatattttgactgacaccctcagctcctaaatttaagagaaataatggtacttaactattttcaactatagtcttcagtgattgaaaatgccttcattttaattctgtgactcctgatataaattaagaaaaacaatgcagttgcaagggcctgcacaacactgaaaataaaccaaaaattaaaaatggcacttcccaaaggaattaacaaacgtgg

SEQ ID NO: 26485 - DNA, 1133 bp, Homo sapiens
ctctgaaattttatgatgcttgatctttactcccctttttttattttttatgttgctaaaaactgagcaattgaaccagaatttaatttactgtgacattctgtcaattaaagctgtgcttaaatataaatattccatattaaaaagcagtgcctttcattaaggatacaaaaaataatacttaaatacgccctctgcttttcgcaagtgaataaatgctacaatcgtgttctgggtctaccctgtgcatcccttgtaaggaaattctaatatccacattaacttgtaggttcatattgatctcactgacaagtttacttttgcacagtgctgacctattttctgacttttagacattatatttcatttccgccaacatgctgtgttcacttgaaagcgtctggcaagttttgacaaacccagtcttatttagacaactttggaaaatccaatattgacccacatttttttgtggctagtaagatttaatgccaaatatatgactgcactattgtgttttacactcatttataaaactgaaaataaattgaagtcatacatcttggcttttagctttaagtgacttaaaaattagaactctgagtgacttaaaaattaatttgagatgcaagtggtcaaaaatccatgtatttagacagaagctgaagtcgtatgtgattttcatttagcctcacaaaatccaagatttgatctcttaggaaattgggcatgttgaagaaatgaagatctgttggaggagatatggctgacctttgagtagatagtgctctcctgtgattctttgattctgcatggcagcattatgagctcttctataaactagcttaataatgagctctattctgaccatctattctggaacttggagtgggggtggggtaccacatcctcagaagtgaatgtgtacagtcggtgatagtacaactgagtaatggggcttcatacccttggcctctttttgactgctaagaatttggagaaggctattaatgaaggtaaggtaatgagccagtccaaatccctcactgtctggctaagagattgagccattccactttacagcccctaattcccttcttcccaactgcagcaacatttccaacagggacaaa

SEQ ID NO: 26486 - DNA, 1031 bp, Homo sapiens
cgcccaggctagagtgcagtggcatgatcttggctcactacccactccatctcccaggttcaagcgattctcttgtctcagcctcctgagtagctagaactacaagtgcatgctgccacacccagctaatttttgtatatttagtagagatggggtttcaccatgttggccaggctagtctcaaactcctgacctcaagttatccacctgccttggcctcccaaaatgctgggattacaagcatcagctaccacccctgtacatttgtatattgtgtaaagtggagtccaacttcgttcttttgtatgttgctacctacttgtcctatcaccatttgttgaaaagactgtttttgctcgattgaagtcttcatgttctggtagaaaatcagttgcccataaacatgcatttatttctagactctcagttctattccattgatctataggtctgtccttatgccagcatcaccctgacttgatcactgttgctttgtagtaagttttgaaattgagaactgtgactcctcctgctttttttaaataagattgtttttactattttgggccctggcaatttcgtatgaattttagaatcagtgtatcaatttctacaaataagtaatttgggattctgatagggattgcactgaatctacacattaatttgaagattattgccatcttaacaatattgagtctttcaatccaggagcatgagatattttttccatttattttgatctttaatttctttcaataacattttgtagttttcagagtatatgttttttactgaattttttaagatttattcttcagcattttattatttttgatgctgttatacatgaaattattctcttaattttattttctgattttatccaacatacaattaatgaggacctaccatggaccaagaactgtcttagctgctggtgatacaaacatgaattatcttcagcacctgcccttgaaaacttggagttttggtaggatccataatgaagagtctgccatacattatta

SEQ ID NO: 26487 - DNA, 1081 bp, Homo sapiens
ttgggcttaatagaaatagttcagcatgttatattgtgtgatctgtccctaaatagataaaagatttctgtgttttgaaggaaacatttatattggttaatttgctgcattgcctgcaggaatgttagtctgtaggaggaaaacaactgtttcctgacaaaattttccctaactctgctaaaaactcatgttttaacagtaaaataggaataatccataaacaattaaagagtaatatcttcaagaatgtttactatccctcagaacatctaagattgtgagacacaaaggtgtcctttcttacatgaagaatggctcttccttaattccctcttaagccgcaaggctatggatggagtgagcatgcaaatgtgagcctaggcatttactccctggatatatagtccctgcctgctctttgagagccactagtctaacgacaatagaaagagaatgtgcactttcctttaagaaattaaacagcactgtccacaatgtgcaaaagactgtgaaattgaaaatgtgtccctggagtggataaaaaaataataataagtggcaactcacaaacagactcttggcaaataatcaattatcttctgaattactatacaaaactatagttcatttcaccagcccattggggaaacagtttccacacaggagacagtcagcttagattggggagttgtttacaatttacttccagggtatcttcatgtaaatatcaacagaccatagtactggtgtgacgcaatgttagaacccacgttattggtttgttgaactaactacgaaatagcaaattcatttgaaggaaatctgttgcttgttgcatttttgtggctagagtgttgactcacatagcttaatttttaaatctggagtaacagttaaactttcctgaagattaaagataggtttagtagatttttgctagggcagcgctgtttcatgaacctgagttgaatctctggcctacgagtagatttagagctggtttaaatataggagaacaggaaaagaaatgatgctttactactggctgcccttataaataaaatcagtagaattaagactg

SEQ ID NO: 26488 - DNA, 1111 bp, Homo sapiens
tggatagataatgggaatcaccgtgttatatagtagttccagttccagactgatcttgatgctatggttggttaaatattattgatgagctaattatgctcctaaaacaaaccaacagtattctttaaaaaggactctccaaaaataaacagaaatacagacaacagtcttgtcgtaaaggctaatgtctttttttctctttgccaaatttgttttatgtattgtgcatatatatcaaaagaactgctttagatcaggtgtttaatgtattttgaggaagatattaaattgctgagaatacttcattcattacaaaataaatatacattgtggatgaatttaaaagctagacttttaataagttggtgaggtgacaagtatgttaactagcctgattaaatctttctacaatatatacatcgaccaagacatgatgtcatactgcataaatatacataatttttatttgtcaactaaaattttttaaaaagcagacttttataagtaagctatcgataagctaaacactggaaaagatgacatgtagaataattagaatttgaatgtgaggctgtttaaataaacatagacagatctggactcagaaatctatgttcatatagcactacatgctgtttagttgatgacttcattgcactatatacttaccactaactccagtgggtagctattttgcactgttaaggtacttgtttctttgttgtggggggtttgtttttttacttctaagtgaccaacactcatttaaaaaacctctctcactctattattctaactcaaagttgccagccacattgtgtgctgtagtattaacacagcatcactttagtatttgacataatgctttgtggcagctaaaatttaaaaaggatcacatttattctaatatcattatagttattgtgatgtacccaagcagatcactctagttttgctaaagctgagcttgctgtccatcagaattaccttcttgcacatctttttctatataataaaaaacataaatcttgtaatattaattcttgttttttatttagatacttcattgatgtaaaaatgtttaaatatcttttggtccttggaagagtgg

SEQ ID NO: 26489 - DNA, 1011 bp, Homo sapiens
ttgtatgtatcttaacaattgagggggactgacataactggaagaaaagtgcacatattttaatgttggcatcacccaaaacaaggacatctttagctgctagattgaaattatttacaattttgcacttactttatggtaccaagtacaagtattctagttacacttgtggttttagagagtatttgctgctcatttggagtctcaaatgcaaaatataaccctgtagctattatgtgggtttgcgacactcccatggggaccttgggctcataaaccagcgaatggattatataatgctgcataaatgctgtatttttcatctgacagacataatcttgatcctatatttttatgttgcctaactgcttcagaataccacttttgaagcaacccatcaaaatggaaattgcttctaaaacatgtagcaataaatattggtcaaggctctgtgtaattcagattgactcaatacttgaacactactcgattgaaattctctactgtttttaaataaaaggttgataatttccattttatggtattgtttgatccttttctttgttaggcatatatttactttgttaaaattaaaattttattttctgattgtctaaggcatgcctgatagtcaatcaagcatttcagtaggtatagataaaatattgagaacttacattgaaagttaaaccacatatggatcaagacatatatgtgatatagatcaacaaatatatgtggtacctatgaaaccagatgagcatcactttcaaacttgcagtatagagctctgtgtctaacatgttatctgaaagacttgatgccagagctatgattttgctccagcctctcataatctcactctctctctgtgtgtgtttctgtgtgtgtgtgtgtgtgtgtgttcatttttgtttttgagataaggtctcaatccatcatccaggctggagtgcagtggtacaatcatggctcactgcagcctcgatctcctaggcttaagtgttgcac

SEQ ID NO: 26490 - DNA, 1066 bp, Homo sapiens
aagttgcagtgagtcaaaatcctgccactgtactccagcctgtacaatagtgagaacccgtctcaaaaaaaaaaaaaaaagaaagaaaagaaaagaaaaaaaattatgacacaatgtgcttagtgctgtgtcagggaaagcatagccctttaataagcgcttaaattctgttaatcctctgtatctatatcctagtctccaaaatggggatcatggctgggcgctgtggctcatacctggaatattagcactttagggaaccaaggtgtggggattgcttgagcccaggagttcgagaccagcctgggcaacatagtgagaccttgtctcttaaaaaaaaaaaaaaaaaattagccagacacggtggtgtgcaaatgtagtcctagctacttgggaggctgagatgggaagattgatgtagccagggagattgaggctgcagtgagctgagactggaccacaggactccagcctgggcaacagagctagactttttcttaaaaaaacaaaacaaaacaaaacaagacaacacaaaaacaataaaacaaaatgaggatcataacactatctcacaggattataagaaggaataagtgacacagtgtatgtgaactttcctggcactctctcaaaattaatgttgaatctccacaaagtgctctgagaatatgaaagaggaggcaaataactcctggatacttgcagcgatatttcatccaagaaagtgacattaaagttgggccttaagtgataagtaaacgattgtgaggtgggaaaacaggtagaataggttgctaatttctaagtcatttacttttttctagtctgtttcatggggtaccaggaaacactctgaggttcagaagcacctcaccagatttactcctagttttgttgaaatatatgattgtgttataccacctaacatctgctcttattaagaattttttcctacctaggaaactattgttaccattaacagtcttcttctttttagatcactgtttcttttcatgtctttattcagcttcttcatccaaaaacactgttttttttgttttgtttt

SEQ ID NO: 26491 - DNA, 1327 bp, Homo sapiens
aggccacaaatgaagtgacagaataaaatccattgaagatggaggtatatgtcctttaaggcttcttttggaaactaatgtgtttactgccattatggaagttgaaatcattgaatactttgaattggttttagaaaaatttgatgttaaattttgtatcaactcagtaaatgcttgctataacttcctgaccaaactaaagccccaaacaagcaaaataaataaataaataataaaaaaacttttgcctaagccctacaccagatcagttagatgagattttaaactcctcagatgattctaatgtaaaccaaacatttatatatatcaagagatcttaaaatttttaccttttaaaaaaatgtcattcttcctggtttgaagttagaaaaatgaagatatctattcagaactgaatatactaatgacatgtacagatagctcatcatccggctgaagttcaacaacctatctagacttttgaaaacatttctgtcagtcttgcaagaacatctcaggaaagtaacgatgatgaaggacagtgtcagcagaagcccacagtcgaagatcattttgttaccttgggtaagccattcaacctcactgagccttagtttttagtttacttttttataaaagaagagatgattgaggtgatccgatgatgactaagatttcttgcagttttgtatactccatgactgctttgtcatggaccagtgaactcaagtaacttggaccttgctagtcgtctaaaagatgcaaaatatttttgtttctcttaagaaagctccaaaaattatcttggaaacaatgtagaaagctcaaggaccatttattactttgttaagcccatcagaagagatgataagcattcattaaatatgcttactaattggttgcatgcaaaagtgtcagcaattctaatatcttaagagttgatgggtattagttagctaatgcttttctcttgtaagagatttcaatagagtggcaatcagattaacttaagcagtggagttagaaacctcaaatccttaaaatatttagtatgaaaggtggacttttatcaaactgaaagcaatacttttttcctgtactttatcagcaactagtctttgtccaccttctttttgcttcctggcatgttcttcttcgcttgttgaaatcctactaggactttggtatccaggtcagttgttgcatcatccatgaagccttctttgaggcaccctaattaggattgatttcgacgtctacttaattgtcccttagaacatttgaaatgtctcctttagatcacttaccatcatctttctcctactat

SEQ ID NO: 26492 - DNA, 1067 bp, Homo sapiens
tttaatgtcaccatgcttttttttcttttgctatcacttgtttgtatattgcagttttgattaatatattacttgaatccacttttatcggttttagctgtcatccagaagttgcacgttactagtaatgcactatatatatataactgctgaagtcaaatagtatgtaaattagttaaactcagtgtgggttttttttttttttttttttgaaggagggaggctgggcaaaggggagagggcaggagtgttgggaaagattactaactaatgaaagtgtatctatatatatgtacacacacaggaacaggactggatgaaaattttatttttctcaatctattaatgcagtttgactatctgctcttgatgtttgcactttgtggagtaatcagttcttctgagtgtggtttttttttggggggggcgggtaagtgaagaggtgtcttttacatgaaaataaaaattatattttgattgtccaaagtccttgatgtcttttaaagagtagggataggtttttcttccccctttccattcactcgtctgcctgtcagcgctttttacttttaacttgtgacagaattaaataatcaggcactgaaattgacttcgtttgaaatcgctctttcctttctttacaaaaaaaaaaagtcagttaaatggagtgagaggggattttcaatagctcttgtggcagtgccctgtgtacactttgtaatattcaattaagacagagggaacaacaacaacaaaaagatgttaaagtattttgcataaccaaaggatatgtccactttagactgttttttttttttttttttttggttgttgctatgtttaccccatgaccgttaattcctcctgaaaagagagaaagaaggaaagagagaatatgaaaaaagaaataacagtggggcaaagctgccaggggtctgtagtgtggccgtggtcactgctctctcctaacacaaatgtgaatacgaagagaggaactacaagacccgttgcgcgacatacacgtctggttggactctggtgactattgagctaaatacacaccacac

SEQ ID NO: 26493 - DNA, 1049 bp, Homo sapiens
aatctataaggatactaatagtgaaatccttgtttttttctctttgccttcccccttttcagtttcttaccaggcaatatcaagaaggaagccaaagattttgaaacttgaaatactaaccttccttatcacttcttcgagaccatctgggaatagtttttagattctgtgattcttttgttcccatttttttgtaggaaggattttacttgttcctaaaaaatgaggaacaaaacatcaaataaacattacaattatactaactattggccatctcctctaactgacctttatgacaacattgcgagaaagatttttaaagcaatattcataaatgcatactttagttttaaatgaaagctgtatattttttggtgacaaagtatatgaaagcattcatgaaatgctaataaaataataactgaaaaagaattatttattgaatttttaaagatttaacttacttttagctaatgcaagcctaattgctaaaacactgaaacttagaacattaatctgatgttataaaatactggtctggtttccgcaaaggcttggaaggcacacaggacttctaagtagaacagcatgagtaaacacacttgcctttttcaacctctcagaatggccctgagtatttctgatttaattttgatttttaaaaagactttgtgttttgaatttgaatacattttctcaggttgtacccagtttaaacagacaatatcagaaaatgtactatcttgaataccaaactcttacaaattggccaatttgtgcttatctttgtttgtgtctctaacttcataatctaagtgtattattgaggggctcagattttgtatgtaattgcttaatttgatcttaaagtatgagtgaagaaacattattgaggaaaggttgacaaagggaaatcattattttcttgtttccttctgaaaatgggtcttgggtgtgtgtgtatgtgtgtgtgtgtgtgtgtgtctgtgtgtaaatctaatatgacatgaaatctgagaatttcagacacattcacggttactacagta

SEQ ID NO: 26494 - DNA, 1062 bp, Homo sapiens
attttagagtatggtgttaggtaaaaaaatctatattttgtttactcgggtatagttagtctttttagaaagtcttattctttattgattttcagtggcatctgttgcatgcatgcacacacgaacacacgagtctgtcagcacctttttaaaaattggctaactacagttttattatatattagtgtattagtccattctcacactgctataaagaactaccaaagactgtgtaatttataaagaaaagaggtttgattgactcacagttcaactggctgtacaggaggcatggctgaggaggcttcaggaaacttaaaatcacggcagaagggtgaaggggaagcaagcatgtcttcacatgatggcaggagagagagagttgaaggggaagtgctacacactttcaaacaaccagatctcatgagaactcactatcacaagaacagcaagggggaaattcgccctgttcataccagatccctccccaaccattgggtattacaattcaacatgagaattgggtggggacatagagccaaaccgtatcaattaggtacaccaggtatgtgaagatccccctcattgatcttgtttgtctgcctttcttggctacaattgtacattttcttaactttgaaatagtttggctagcactgaaatgatctgttccttaaaggttatatagaatttttttgtaaatcaaaccgtctaggatttggccacaatttttagcagtatctctttgacaactgtctttcttctatagcaattaatttctttgaattttatggagtcaatttgtataaattatattgtccagagaataatctatttcattatgtttttttgcataaaattgggggaagtagtctcttatgattcttatcatttctctggtattatttcttattttgtatattttggtaccttctccctttttccccctagatttgtttcagtatttatctgttttattgttttccccaaagaccagattcagaacttattagttttatcattttacctttttttttcaagttttaatttctacttttatat

SEQ ID NO: 26495 - DNA, 1024 bp, Homo sapiens
cttccaatgtggaaagataggaaagggtagttgggaagtcctgaaggaatgcagtcctttagaaccacatgtttatttcagaaattatcatggcaaacactgcctttgaaaagatccttccagtgctcacctccttttaatgtggaccacagtgacgccatttcaccccgtctttcatgtgatgttttacttctgtgagaaaagctttatgtccagtgcacttttctttcccgttggttttgatatcaagaatgacaaaattcttggggagataatcctaaatgtcagttttcgattagtaagcctagcagatcttgcattggaaaaaataaaaatgggtgaagatctttgccttaaattctttattggagtttaaagtaattgatggcctgactccctccttccttcctttccttattggcagtaatattatttgttagtatgtagtatgaaaattggtagatataagcaatatgacattattaaagacaattcctacattaaagaagacaatgactgtagagacatgggggttcagcatgtttaggggctacattgttccaataaactgcattttaaaacaaattattaactgaaagacaacttccttaggcagaggaactatcttgaacaaagtaattcaccttagataatgaacatccagcacagtgcctgagacataaaggatgttgattactgaggggctctgtatttaaggatgtcttcacttgacccctactcttgcttaatcacttgcttgtgtatagaattctaaagtcaactttgaagacattgatccattgtcatctgtcatccagttttgcaaatgaaagtttttttgccagtctgatttcttgttatttaaataagacttttttgttttgattcgttgttggtttttaactttctctctggaaactgtgcagtttttctcttattgttgctattatgatagttcattaaaatatgttaaaaaattgtctttaaaaaataactatttctgctctgtacttaataggctcat

SEQ ID NO: 26496 - DNA, 1048 bp, Homo sapiens
tgggccttagagagtgggaagagaaaatgtatctaaacttatatctcagtaacagcttgataggacattgtcactagcagtgccaccactaggtcctcaccattgctgctggcatgaacagctaccactactatgactacttgacctagtcaagttttactgcctcctccagaacaacctctaactatcccaatatgtcacttactacagatccaacattcctgcattgaatatcctgttggtttactaagagacatgcctatatcttagttcatggggtgagaagagaggttaaatgttctttcccattccctagagggaagtggggtttttgccccaccacatttacacaacaaaattgctcccaagtagaaaaggggcttagattatatgtagacaaaaataaagcaaatacccactgaacatattaatctcattattcaataattaaaatgattgaatgggtgaattaagagtgaattagttcatataattgctttaactcttttcatttataaaataagggtttgacctatgatctctgatttttattataactttaaattcttttttaaaaattattgtcagccggacatggtggctcatacctaaaatcccagcattttggaaggctgaagtgagaggatcacttgagaccaggagttcgagaccaacctgggcaacagggagacactgttcctacaataaataaataaataaatatttaaaaattagccaggcatggtggtgcatgcctgcggtcctagctactcaggaggctgaggtgggaggatcacttgagcttgggctgtcaaggctgcagtgagccattactgggccattgcactccatcctgggcaacagagcaagactctgtcttaaaaaaaagaaaaaaaaatattgtcagtattatttgcagagtctcatccacatggtggagccatatgcccaggacttggcagtacccactgcacgaatatcatgaaactcctaatgaaccaagtgggctaacattttgatgttccaatgacttgttttgtgtgtgtgt

SEQ ID NO: 26497 - DNA, 1028 bp, Homo sapiens
aaatggcacattgaagtgtgattctcatgaaaatacctatgacatctacattaatacacactggaaagatagtaatcagtgaacttctgtgatttccacatgaatcaacagtggaacattgcttaatccaccactaaattacatcatgtttaatttatgtggaaatgtttggaaatgcttaaaatgtcagtggtaaatcattttacagtcttaattaaacacttttctatgataaattgctctataaacaaagtaaaatactattcttacataactatcaatttattgtgaaagacttcaaccccaaatcattatagtttcttctttgtatgagccaaagcttgtatccttcaaggattcattttcctgtcatgtggcaaataattttaatataaaatgcttatttccatcccatagctggttatcatttttttaaactcacagtatttatttcttaatatataaatatcataatgagttatagagtctccaaaaatgattaattcttaaactttgacactctttcccccaataataaggtactgaatgtaatatactaaagagtaatgttctcctcccaaactccattacttttattataaagaatatttaagaaaggagttcaatttcacggtagaaactagttgaaatgtaatttttatgtttggcacatgaaagattttatgttaagctgagacataaatgttttgaatcagaaaaatactatctaaaatcaataacttcacaggtacagtctctataactataaaatccaggaaatgagagtcccattagggtttaaatcactatttgattaaatgtttcaatcaaacccattttgtaatgttttatatgcacacttacctaaaatgtagtattattcaagagctatgattgctgtatgtaatgtaatttagttaaaatggatgcaaattcatatgattccagttacatatgaacttaaaattagatgtctgctgctttttgtatcattttccagaaaaatgagtcaacaaccaattaggaaa

SEQ ID NO: 26498 - DNA, 1070 bp, Homo sapiens
cttggttgcaatagcagaagaaaattacgcatgaatgtttaaagagatgttagaactatgttatattattcatgctataccttcttttagcacttaacataattgtagtgtaaaagctgtttacccaatttttcccatgagggtagactccatatctatcttgtttgccctctatccccaatccataacacatcataacaacaggagcttttgcccttaccatatcttcatctaaatgcttcattgatgttaatcatttaataaaaaataacagtaggtattattattacctctgtcttataaatgaggaagctgaggaacaagttatccaagattacatatctagtaaacagaaagccagaacatgaacccaggcattttgactctagagtcctcattcttctatattgcctgtcatattaggcatgcaataaatgtttgttgaaagaatgcatgaataagacagtaaattttggctgggcgcagtggttcacgcctgtaatgccagcactttgggaggtcgaggtgggcagatcacgaggtcaagagatcgaggccatcctggccaacacggtgaaaccctatctcaactaaaaatacaaaaattagctgggtctggtggtgcgtgcctatagttccagctactcgggaggctgaagcaggagaatcacttgaatctgggaggtggaggttgcaatgagccaagattacgccactgcactccagactggcgacagaacaagcctctgtctgaaaacaaacaacaacaacaaaaaacaaaaagatagtaaattttatattttagcttgactaaatgaggcatagaccattagaaataccaattctaccttcctacaaatcttataatagaggtactcaatagtatttatagcataataatatgacaatagccagcttcattcttgatgtaattgtagaattctctcaagtttctaaagagatattttttaaaaatttggttaggtttaatttgcccaaagttgttttcgtttccatttaaacatattctgccataaacaatacacaaatatataagcacagaactcttt

SEQ ID NO: 26499 - DNA, 1079 bp, Homo sapiens
ataaaaatagtaggctttgtgggctatgcctatatagtaggtgtggtcaccctactccattctgctgttgtaactaacacaaaagcagcctgagacgttatataaacaaacgggcatgactattttctaatacaactgtatttacaaaaacagactgtgggcccattttgacctgcacattgtggtttgctgacacttggtttagttcatccagtagagtgttagatctatgagaacagatatactataatacttgtactgtgattccagtgcctagagaatattcataacctttggatgattaaagaatttgtactacaccttttaggattttgtggacttcctatgcagatatttacagtctgttttctaaagccaaaaagtggtggtggtggttccaaatgcttcattcttatgagaactttgtaaccaattcataagctaaagactgccaatgttatattacaaataatgtgttgtgaaggactgctcttgggtaaggaaaggactcctcctcctgaaatttataatttggaaacaatttggtaaaaacataaaagtagttgttgaactgacactaggatctatgctctcttgactatcccaggactttttaactattacaattttgtctgtttaaatatcttgtagttcaatttttttggagattatttttgttgttgttgttgttgttgtttttattgttattattattatgacagggtcttgctctgttgcccaggctggagtgcagtggcgcgatctcggctcattgcaacctcaacttccagagctcgtgttgttctctggcctccacctcctgagtaggtgggactacaggcacacacccaccacagcaggctattgttttttttttttattttttgtagatacagggtcttgccatgttgcccaggctggtctccaactcctgggctcaagcagtcctcctgccttggcctgtagcttgacctgtagttcaatatttaagctgcttttccaaaaactatcttgtagacttgtttatctattgaagacaagcattctaagaaaatcctcaaaacaataacgggtaatga

SEQ ID NO: 26500 - DNA, 1121 bp, Homo sapiens
cccagaacagttcctaaaggaagcctgtactcataaagcagtccctccccattccctttcttcctcagcccctggcatctactaatctgctttttctttttttaatgtgaataatatgatgtcaccgattgcaaaataatggaaagaaactggtttgatctttcttgctcagttgatataaaataatgcttttctattcggtttgttagactaatttttcagttaggtgatttaaaaaacataattaacagttaatttagggatgaggagctctactgaagaattttttattaaaacattagtaattttattaaaggagcaagtgaaactcacaaaattaagaagaagtagtaataaaggccaggcattttcttaaactttcataatactgagaattaactgcaagaatgaagccagccatcaagatttttctcacttttgtaatttgtgggaatataaaattgcaaacataaaagtaaaagacaattcaaagtaatgagaattagaagtgttggctggataaaaaatgtcctaagttatgagggtaaaagttccattttttttttaactggatagccttctctgaggctaaagaaaaaacacttaaaagaaaggatagctttattccattttaaaaaattcaacaacacattgataatgtttttagggaagcatgtttacaatttctctaaaaagcagtaatgaggtttgaataccttgttatacttttgagatttgttgaaaatagatctactttattggttttctctgtgtatgtggtttctttatgctttgttttgtcttgagcaccttcacagataaagcctttgaaataaagtcaggatctatgttttaatttagggcacaatttcaaattaaatttgacttttagttcagtggaaaagaatgtagctctatagtcagactgcctaggttcaagtcctgcctccaaggtgtactactgccttgactaattcgctaaatagttcttacccttatcagtgaagtatcttgtaaagtatccataaagatatgtgtctgtggattgtgagaaaggggaaagagcacctcagcagcactttacaaagtgtctggtctgcagtaagtgtacagtgaacatg

SEQ ID NO: 26501 - DNA, 1049 bp, Homo sapiens
tttttcagtttgcctccctccccttccttcctccctctctttccctcctttaagcatgagttttagtttaaaatgttattcccaacttgtaaatctaatgggatgttgttcagggaattttatagactttcaaaaatagttatgtatcaaaatactgatacttcaaggactaaaaactctcagtattaaaataaactatctcagacttttaatttgttacagattttctatatctaaaacctgaacatatgtatgttctaactttatcagatcacccaatggaccttatttggaaagtcaacactgtctactgagtgaggcaatggaagctgtgccacaatcttctcttgatttcagcaaaatccctctctcacttcaatcctgtgctttttcctgctgtattgggccaagtaaactcagtttttccatatttccatcatctcttgccttcagatatattactggcaaatacacatacacatttggatgtatgaattgttcaatcttagcctacattatagaggtgcaggtttgatctgtggacttttctgtttaaagctattatcagaggacccattctgaaattatgatcgatgcttaccatgtgccagatattgtgccaaatgttgtgaggtttacaaagtggaaacattttactttttgtttcagtttcttaacaattttaatttctctacaaatacacttttcttttgtcactagcaattatttatgaatcttaatctgctatctaatttgagagttgactaaataacaaatataaaacatgctaagtattttacaactgttttgcttaaattttgttttaatttttaaactctaggttctaagctaaaatgaaatttcatatttacttcaaatgcagctacaaagaatcagaaaatacattttctttttctccttttgaatgcttaagcaataggacatgggattcaaatgactggttctgtccgtaggagcttcactgtagcccagtcttctttcagcttctggatgccattattctgccagaaatatacagcatatccaca

SEQ ID NO: 26502 - DNA, 1035 bp, Homo sapiens
agaaaaaatgactgatataattaagaagatatttagaaacgaatgtgcctaggaggaaatggaccaaaggtagaaggagttcttatccagttttttgagtctaaaagtcaaaatgtctttataatttccagcaagtatttttattgttgttgttcaagatactcatatactcaagcttttggtgttctaatattagtatgatagttgttatgagacttttttttatgactttgctgtgctaaattttttcccccatctgctacagtaaaaacaaactaaaagtatgagagaaagaagtttcccatgactatttataaaaggccaaacgtcttcagttttgaatacaaacttcatatctgaggaatgaatcctttggaaaagattctcaaagattggctagtctttagaaaaatgatagagtgagcatgggtaatttatttcatttaatttaagttcactatactgtttataaatttaaatattttaaaactgtttactttagatgtaagaaatctgtggagttgaattttggagcattttggcgaagtgctttaattggaattgtcggcctggcgcggtggcttacgcctgtaatcccagcactttgggaggccgaggtggttggatcttgaggtcaggagatcgagaccatcctggctaacactgtgaaaccccgtctctactaaaaatacaaaaaattagccgggcgtggtggcgggcgcctgtaatcccagctactcgggaggctgaggcaggagaatggcgtgaacccgggaggcggagcttgcagtgagccgggataacgccactgcagtccggcctgggcgaaagagtgagactccgtctcaggaaaaaaaaaaaaaaaatgtaaaggcaggagaaatggcctattaagctcaactcatagaaagttgaacacttagttctatttgtagcttgtagctatttatttatttatttttgagacagggtcttgctctgtggcccaggctggagtgcagtggcacaatctcggctcattgcaacctctgcctt

SEQ ID NO: 26503 - DNA, 1046 bp, Homo sapiens
aacctacccaattaagtaagatgattgctctcagagtcttatatttacaccctataccatacattgaatatgtacacactgtttgctttatagcaattgcctctgaggtaattgataaagaacacacatattctatataaagagaatctaaaagtcattcatttgtgtacttgcttatacatgatgttgctgagtaagaggtagcagtgagtgagctcttatgtcttcctcatcaatcattacttaaaaatcgtaaagcatggttaggagaagacatttaagtttactccaatgggagaggacacgaagtactccccccgaccccaaaaatcttgactttgaagatagcatttctagtttttattaatctgaataaaagctttgaaaatgtgatatggctttaattttttaacttcagttcttaaaatatgctgttttatcttgtttagtttttataacaaaatttgacaatggattatttttcagaacacccacttttgcaggaggacttttttccatatcaaaagaatattttgagtatattggaagctatgatgaagaaatggaaatctggggaggtgaaaatatagaaatgtctttcagagtaagtttatggaaattaaatatagcagatatattaaacaatgaaatatattgtgttctaatcggctggtacatatgattacagatgtgtgcactctactttttgtgctttctgaaacttaattgctggaaattttggaataagaatattttcttttaatatgtaacttaatatatttattcattgtcgccagtgtaacaagaggaatcagttaaactcctgtgtccaggcagtaacaccaattaatgcacttgtagctactgaattccagccaagataaatataattaaatctagtgcttcaggaaatgagttgatcatcaagggagttagaatggaaaaacatttatgaataattttaaaggacattggacttaactgtttggaatgaatgagcttgattttttctatacatattataagttaatataaaaaaaggcttt

SEQ ID NO: 26504 - DNA, 1091 bp, Homo sapiens
ccaggctgatcttgaactcctgggctccaacagtcctcccatctcagcctcccagttctcggattaccctcatgagccactgtgcctggtctcacctgggttttcatctcataggagctctgagagcttgggcaagttcctcaccttctgtgaacttcagttttcacctctcttctctggggaggtcttagaggaaagagactcagagactcacctgcaggatactcttaggaataatgctggtaagggagggagaaaagcaggattggactgcaatgaagtcacaaggaaggcttcagctgatccccaagggactgtgttgatgggatggcctcccatggcctccctttaaggcaaaggagacagacattggtttcccctgagtcaatctgccaggattgggactacataagaagagtgagatgcttgccttgaggacaaaatttagagggcgtcaaaaagctcagtagccaagataaataatattttaatgtattattattttttaaacctaaattaatgcaaaagtcagcctttatttaaaaatttcagtattttgttcagggtgaacttttgcattggttagtattttttaaataatgctttaaaatagagagtgttttggggagccatattggagcctcaagcaaagagaaaaatcagtcatattgattatatctttatttaaaattgtgatattttgataattacagaacctttgcattttttatttttaaaatattacattaaaatattgtttgattactgagtttttggctcctgcttaaatttagcactcaaggccagtttttcaccctagtcctggtcctgcattgtacacaggctgccccactctctcttcaggaggaaatatagtcttaatccaaggccagtgcttggagaggggtttagctatgagccattagcagccaatactcctggcatctggggaaatgagtgccttgattttgaataggggcatggtgcctaccatagtatccactgtgatactgtgatgtcgacatataataagattgttttgtcatatagtcattcactcattgggatagtaagattgtcatgaaggacat

SEQ ID NO: 26505 - DNA, 1024 bp, Homo sapiens
caatagaagtcataatgggtaaggaccatcatctgcaggtaaattattgttactcgtctttgacaggtgaaagaactaaggagcctaaatgttaaatctgaaatacaaactgctcaataaggattttactgaaatagagttttattttttctgtttctatacaaaactaaaacatgactgtttgaatcccattaaagataaagtctcactaattcttggaattgtgtgcatatggcatctgaatagttgtcattatcttcaattatcttgaccacacagtgcttgaccaagttttcttcatagtagcttgagggtacttgatgtgttaaataatgacctgtaatcacagttatctgtaatggagctagaaatagaatccacaaactagttcttatgtagcattttctgctttctgtatgtttttggggcatttatgtttatgcatcttatggtctaaaattttgttttcttatagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagagtaggtgattgaagagtaaaaaataattattgacctttgttgcataagctttccatatagatattgttgagtgttagtccatttccaaggattcctgtgtgatttttgaaaattaaatgtttattcttaccacaatcaggaaacaagcattaataataagaaaaaagccatttgtcctttaaagtttaaaaaaaagaaagatttatgcaatttcaagtttcagctgtagtgatgccctacttaacggaaagtgtttttggaatgtcaaacgattgcctgtgattatccatctcatcccagaactaatgaaaattgcagaagaac

SEQ ID NO: 26506 - DNA, 1016 bp, Homo sapiens
aatgaagacaatgtgtttcagaggaagaggaaaatgtgaacaaagtcagggaggcagaaaaacatagggtatgttcacaatcctatttgtcattcagagggaccaaaaaagaggtatgtgacaagaaatcatggaagaaatgctggaagatacattaagcccaagctgaagtgtttccacttgctttcattgcatcaccttgaaccataaagatgagatgtttataataacagctgtattgtccacatccaagtcttgtcctttgcaatctaaagttactgcaatttagagttattgagagacagagaagttggctgtaggtcttaggatgtctgcaccagaaaaaaagacctaatgcagggattagaactcaggtttgcttttagaaactgttcttcagttcactcaggagtaatcaagttgtgaagaaccgatacgttctaatcaaactcaaagtgtaagagaggttatttttaattgtgtagtgtagagggaatgtgggaccttttcataggaccctcctcctcttaggctgtgctaggacctggctgacaaatacatagcaggcctctatcttctctcctctcctggcccacctgaggtgggctgaggtggggagagggtgaggctcagtaattggtaacatcccacacttcttcataacctacaaccagttggttggatttgacactcaaaccattttgccaccccttacctagaggaacagattatatcttggaagcttattgatagatacagaatttgaggcaaggaagtttttatatttctaaaagctgtttttataaaaccctgatgtattgcccttctctattccagagttatttcttacttccaaagatcagttggacattgaacattttaccactctccttttgcagtattccttatgagttacccaaatttgctatcttatagtatacttttattatagtaatggtatcaccgttcctcagtcacaatttcttaccctttgtttttgtttttattttgagaca

SEQ ID NO: 26507 - DNA, 1031 bp, Homo sapiens
ggatgcaggacttcccatgctaacagaaagtcacaggcaaactgggatgagttggtaaccctaatcctcggttactttgtccatacgtctttattacttatagtattttactaaaaatatttatgtgcatatttgtgttctttattacactgtagactcctcgagttcagggatcacaccatattcccaatatcagacaaaatgccacacacatggatgtggcaacatagatgtttattggttgaatggatcagtgaatgactgtaaaacaccaagtcaattaaaaacacagcaggagaatcgcttgaacctgggaggtggaggttgccgtgagccaagatcacaccactgcactccagcctcggtgacagagtgagacttggtctcaaaaacaaccacaaaattttaagtaaatttttattgtctatgtgatatttttaatcttaagagtttttaatcttgtgttgtatgctttattcttactagtaccttacatacttatccacagatctattttgttggaattactctaaaacatgcatctccgttcattttatgtgtacattattggttatcctcagtaactcatcttgtactttagattaaggctctattttagcttatttcagaaatgtaccatacaaatttgacctaatttaagtagttgaaaaattcctcttctagatctaattactgctctcacgacagattgccccttttctctctcagaatctccagatcgccttgagctttccccttccttcatactaattggttaacatgtctcctcagctctgtttgcttgatagctagctaacacatccagtctgtcgtatcctaacccactgctctaatgaagacccttatcacctctcatctgaactagtgcagattcccaactcatcttccagcttctaggttctggctgctccaggtcatcataggactagcatatcagttctaaaaatcaaaacctaccctttgcttaaaatttaagttagtgcttcaggataaagtctaaaatcatagca

SEQ ID NO: 26508 - DNA, 1048 bp, Homo sapiens
aatgaacattttatatttaaattctgatatcacattactaaattgtgattggatgaccattggataaaagttggttgggtagacagccattataagaagaagaaacagtgaaaagaataaagtagtgttctagtatcactttaattatcatactcattattaattgaaaggaaaactttgagggtctaaaacatgccgggatgaagagtggggaatgtaaaggtatgagacatttagtttagcatagtgagtgttctaccttctgtttaccactgggggaaatctgaattctttaaaaaactggtttacaatactctaggggataatgaaagtaattgaattgagcaaatcacaaggcaaatctagaattcgaacacttactgccttgactctgtcagttctagcaagaaactgtacctctcagttatctttcctttaacagatatatttctctgataaaacttttgaatagataatacccacttgatatgttatccatttagaattgtataatagtttcataattattttgctgaacaagagccattatttgcattgtctgttcatagatcccagggaaataaattagtattagttaagtcataataaaggtattacaaaataagttaaatcaaagaaattttagaaaaatgtatatagcttggttagttatactaaaattaatatatgtttattttaggtaaatattatttttacacttataaaatgatctgctgatttgttttgtttagcctgcaagtcctgggcaacctctttgtccacttctcaggcgttgcatctcagtcctggagactgtagtaagaactgttccaggtcttctgcaaacagtcttcctaatagcaaaagtgaaatatttgtcaggtagagtataccttaaaaacttttaacctttttattctgatgttgataaaaacaagcgtaaataaattaagcactgtgtatatatagagaatagtcacataaaatgtacattttatatatgcatagataagtaattttaatccaaaatagaattgcataacttact

SEQ ID NO: 26509 - DNA, 1066 bp, Homo sapiens
gttaaaaaaaaaaaaaagaaaggaccatttactggtcctccttctgctccctagattgacatagggcaagtccagttgcttagagcaaggatcattcctcattcattaaacagaccttcagatattggcaattagttttcacattccactaaacaactccaggtttccagccatttatgttttatatgaaatagttttgagaattctgtgtgtgaatctgatgatattctttattttgtctgtgcctctcattaagtttactattccaaacgtggatttgacctgcaagaactagagtagaccttttcctcccttattctggaagtccatccaactttctttttataaatcacattacattaatgacctctgttgaattaacagttaattaaagactttcagtctcttacttgttgtacttttggactcaaatgtaggactctacatttattcctgtgaaattttatcttttcagattcatctcataattccatgttatcatattccttgtggatcatgattgtcacctattttagatggatctttattgtcatctgtcatctgctttatctagctctgagataactattactataatgttcttttccaagcattaacagttttgagtataattgaagatgaaaccctatgttgtactaccagagatttctttccaaattgatgtggatttattagtcagcactcttattacagatagtaagcagatacagacatcctaactttattatattcagctcacattcagcacagggatatcagagcaggcactatcaagcgttccattgctgaaagcaaacttcttagcattgtccctgatctatagcttcagtaactgtgttaacatgggaaataaggaaaatgaccttcccttagggaacccatacagactttttgattatcatgtccttttttaggctttcattactatttattttttaaacttaaaccctcatagaattgtaccaggggttgacctcagactccccagtcataatccattttcccttgcttggaagttggaatacatttttttcagtattaatct

SEQ ID NO: 26510 - DNA, 1032 bp, Homo sapiens
tttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctc

SEQ ID NO: 26511 - DNA, 1034 bp, Homo sapiens
caaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatg

SEQ ID NO: 26512 - DNA, 1026 bp, Homo sapiens
gaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagca

SEQ ID NO: 26513 - DNA, 1033 bp, Homo sapiens
tggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaagga

SEQ ID NO: 26514 - DNA, 1050 bp, Homo sapiens
atcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaac

SEQ ID NO: 26515 - DNA, 1030 bp, Homo sapiens
gggcagcagcagaggcggcggcggcgcccgcgcgagctcgcccagctgcactagccgagcagccgcggcggcagccgaagcacccgagcccggctgcgcttccccggcgatggctctggcctcggcgactgacaacgcccggcagccaatcgctgcctcgccccgctcggcggggggagaccaatcagagcggaaggcccaaggttttcctccgcctttgctcagcgggcttgtttccgggagaggcagcgacgctgctggggtttgggatgggggaggcgcgggaggggcgcaggatgggggactcgtggccccggagccttaggtgaggagggaaagccgggcccgcaggggtgggcctggggcgctttctgaccgccaggagcccgcggcttggcaggaaagggcgccgcggggtgactttgtccccagagcctcgtccctgcggttcagcgtcttggcatcgctggggcgaggggggagcggggaggggtcgcgggacccgagtacgaacggcgcggctggagagcgaatcccaggaggtggtcgccgccttgaaggaatcacgcgaacagtcaccagacagcgcccccgtccttctccctttggcagctgaaaagagtactacttcttaggcttcgaaccactcctcatagtaatcagccacgaagtgtccccagctagcaaagaggcacacggagaaatgtcggagttgtaggcagagtggaccttccccgtcttccctccaaataaacgcccctcacctccccaccccaaacgcaacaaacaaacaaacaaaaaaccttgagaatggggaaagataatttaagcagccaccctaattggttggcttcctttttttcctttttctttggataatcaagtctgaatgttctaatagttttttttaatgtgtgtttgactcaaacactagcgaagtaatgttatttagcaataaaagaaaaagaaaacaaaagccacaaaatgtttttctgcaccactctcccctaaattgtaatgatcttccctt

SEQ ID NO: 26516 - DNA, 1049 bp, Homo sapiens
aggagggtttctttgttggtatcagctgccagccggtttgagatccacttggcagagctaatttgaactggtttttggcctgatcttgcataggacactaacatcccaataaactgcagagattcaaatgtatttaccttcattcatcaacttggttattttattcaggaataaaagatcaaagtatttcagcagcgtttttcctcgtaagctgctgctgcgcatggtccctttatctctcagctttttatcattattttcatctcagtgcctttcattactttttaaaggaaaacgtcaggggcctgaaaattgtctaaagaacagcagtgtcatgatactgtggttctttacctccctgcacagtggtttcactcaggggagcactgggacactttaaaaaattaatgcctagggccgcaggggtgcgcctccaggaatgaatggttgttgagagcatgggctttgagtctagaccaggggtgagtctgcagcctccactgtgtgatcctgggcaaattaaccccagagagcctggggttcccaagatgtgaaatgggtcctgttttaggacctaatgtctggtcttacgacagatattcttatttaactgctcttggtgcagcctgggctttgggaatgttaaaaggacttcatggtggttccagtgttcagcaaaccctgagaagcattccacagggaagataataagtaggatttccattgttggtatggccaggggctgggagatcagattcttctcttcacttttaacaaagtggttcaggcatagagggcatttcagctcaactattatgtgctttgagtttgatgtatttttttttagtagtgttttattgttgtaaaccttgagacaggtctttatttttaagccatttttgaatggactacttggcagttttgtaagtaggtgaatcttcctgctttcaatgtggaatttttgaaattgcattagaaaaaacatgaaataagatacacttaatttgcctttgaagatagaatacaaattttgagaacatgtaattaac

SEQ ID NO: 26517 - DNA, 1011 bp, Homo sapiens
gggttgtgaattagtgtaggctagagctctgcttttgactgaacattagagagcagactggaaatagatgacccagaacaaggcagtaaatcatccacattaactgagaaactaatgaaaggactgaaatttatacgaagaatttatggccactcatgaaatcagcccaaatcagaggaactattagaacacttttatgttttaagaaaatgggtactgtgttcatttgctgtaatttgcatgtagtcagagtgccctgacatgataaatactggctttggtggacaggattttacagcagagctttgcactccatgagccaatgtttcttgcataaatgacttgatgattttagtgtctaaaatatgttcagaaaactgttgaaaggccacaggaagctttgcgatgataactattctggaattggtgccctggggtgtacccgatatgtgtgtgcttgcttatgtgggcaaaagaaagaggagaaaaagaggaggcagatgggaggagtgttggtaaaaatgaaactgcagatcactcagaatggaagtattaaaagggcaacaaatgaagataaaatgatgcttgcaattatggtttataaagagaaataggccatattgagtacataatttttcttttttctcctctgcagctgatggattaaatgaaataaactaatctgcagaaaatccatgtatctaggttgttgtcagtcgaccttagagaaaattaaaacttgcgcagatttcttactactttctacttaaatttttctacttgaaacacttttctcaaaatacttgtatgtgtactattttatcttaaaatttttttatcttaaaaaattcaggtaacttcaatacctaactactgaagcagcagataattttactcataaaaaaataaaaatgacaaacacgacattctcccataatttcttcagcagtaacttctccttccctaagcaatagcccttatttgactttcaggactttatacttcaggtgt

SEQ ID NO: 26518 - DNA, 1105 bp, Homo sapiens
gctcacgcctgtaatcccagcactttgggaggccgaggcaggtgcatcacgaggtcaagagatcgagaccatcctagcccacatggtgaaaccccgtctctactaaaaatacaaaaattagctgggtgtggtgtcgtgtgcctgtagtcccagctactcagcaggctgaggcaggagaatcgcttgaacccgggaggcagaggttgcagtgagacaagattgcaccactgcactccagcctgggtgacagagcgagactctgtctcaaaaacaaaaaacaaaacaaaagaaaaatatatatataatatatatattttaaatgttttaatgatgaaatcaaatatatagaaaagtgtaaaatactgtagacttcatgtagtcatcattgagatttcattgttgcttaatacctctcccatcatctttgcaactcctcttaaaatatttttccatctggcttctacttacccaatttactgttattctgtatttatatagttgatttttgtgacctgaaggatttaactttgttggggcccatccagagtctctgtagctgtactggagacttctctccagggagccctaaaactaaaaccaactctttctggcataatttttaagtttattaaaattctatgaaatgaacctcgaaagcattatgctaagtgtaagaagccagacacaaaaggtcacgtattatatgattccatttacatgaaatatccacaatggttaaatccatagagatagaaagtagatttgtggttgctgggagctgggaggaggtgggaatgggggagtgactgcttactgggtacacagttttccttttaggtgatgaaaatcttttagaactgactagaggtagtggttgcacaacattttgaatatgctaaatgccactaaattgttcacttaaaagagttgattttatgctatatgagtttcacctccacacacacacaaaaaacaaattctatgaaataatatttaaatgtttgcattgtagcattgtatatacatattaaaatcagtagtattgattttttttctttttcactggtaactacatcatgagtattattttctgtatactcagttt

SEQ ID NO: 26519 - DNA, 1042 bp, Homo sapiens
gctgtttgctctgcagagtgctgggaaaccaggcccaaatgaatgtgcagtgagagcacacgtgcacacacacacgaacacaaacgtaagcacagacagagcacacagattcagcattagtttgatcacacacctaagggttacatatattttttgaagttatttaagaacaatttatttaagaaagacagactaaagtaaaatgcatagaattcttgctttgacagaatatcattttttaaatctgataaaagcacaagagagtgcccatactcctctgcgccaaactcagaggaattaagcggaggaaagaattcctagaaaaaaaagaattcctagaaaactaaatcagaagcttaagctgtgatgtccattcataggattgaatcctctgccagcccagccactccctgtgcttatctgtctgcagattctaacatagaatgaccagctctccagggaaatgttggtagacctgtcatttgtaaagaacttccgatttggggatggggaaaaggagtgtttgaaaaccacctttcaaaatgtgggcaaatgttatttccaagaagttctagcataaaataacatctgtaatttccccaaagacgttctcagtttctgtgtcacatgattatgactcattgcagcagtaaaccacactgtaagccctgattttctaattaactttgttactttgtatttagttaggagttgtatatcctctttaaaaccattagtacagagatagaatccaattaagacctgtacttaacttcacttgggtgaaacaagagcttgccagtggattagttgtagatatctactaagtcagtagagtcttgcttttttcaattactttagattgccttgttttaatttatgttaatctgtcctttaactccagaatcaaatatgcttgcagattacactcagtctcgccacactttctgatcagtccctacttaagacaaaaatatatttctagtggaagtaaagtaggcttactttggtgcaggaaacctagtctttgtgatgacttaca

SEQ ID NO: 26520 - DNA, 1046 bp, Homo sapiens
ggctggtatctatgccaagtgattgatttcattttatttactttatttggaaccgttgaagggatgatgtcttcccaaaccattgtaataatgagtggtataagttagtgttccagaggccgagaacaaatttagtttttaccaaagggacaaatgttgacttttaaatatttgtcagaatcagatagtatattagtttgctagggctgccttaacaaagaaccacaaactgggtcgcttaaacaataggagtttattttctcattgttctggcgcctagaagtctacgatgaagctgcccaaaggtttagcttctcctgaagtctctctctatggcttgtagaagaccttcttgctgttcttatgtgatctttcctctgtgcgggcacatgtctgtgtcctaatctcttcttataacgacacctgtcctgttggattagggcccaccctaatgatctcacttaactttaattacctctttgaagaccctgtccccaaatacggtcacattctgaggtactggctgttaggctttcaacatgaatctgaactgtgtgttcagcccataagaaatgagaagggaaaaggcttcatgtggtggccacttctcagggccactctgtgttaataagagttgtgtgggcagaacagcagtggggcttaagaaggggcatccctgggaagcagataaggctgagcttcagatttcccttctcttacttgagggaatcttcagatttaaaaagaaaatagattttgtaaaaaactgacctggaaacagtgtcaggtatttgtcgtctctttaaatactgtcatgcaaatcataccccttctggtacccttgcccttctgggagatgtcaccctaaaaggggctttccaagctctgctctcagctttcaggcacccactccgctcttctccagggcaggccagaggagtttcagtcctgtgagtgttagtcattggagaaccatgtaaccccaacctccaaaaacaagcagatgcattttttctttctttttgccttgagagaatctttggatt

SEQ ID NO: 26521 - DNA, 1047 bp, Homo sapiens
aagtaaaatgaagctaaaatgagattttaaaaatatcttgagagtggaaagagaattgggcagggaacccagagtgatataattacaatcactgagaagaaaatttagccttcagcttgttagcaaccaggaaattatagttgtctatttagtcctcctctcttgacaaaagtagacctataggattaaaagattatatagcgaggcaagcttttgcttgataccaaattcaagtggaatttatctcttggttctttctataaagaaccttggataacatggcagagagcttgacctactgttgcaaaaaatgttcttgagttattttttcttagattgacactccttagaagtcaagggcttatcttcattgaattacagcatacaacataaagtaatttcttcagagcctaaaccaagttcaggtctgttttctttccactgatcaactctgagagaagatcttgagcttaaagttaaggaaatgtttttagcagggaaagaatagcagttagtccaagttaggagttctgaccaccatctaaagtacccatttgctgtatgttgactgaagggaattcttaggtttacagatcagatgagtaactagcagcattaccattctcattggaaaattcaaaaatctgatgtcacttagacagacgagcctccacttgcagacatactgtagagaaggaactttggggatagatcatgcatttttttttttaaagagccaataattctttccccaaatatacagtggacagcatacttgtaaaccatacagtataggagaagtgatattagcctgggcaaattacttttcaagtaggtgtgatcaatggcttcctttcccataaaccttgtgtatcctttggaacttttattattttaaataatataataatattttataataataaatagaataatattattaatacctctccaagagttggactttaggagttggaaggattgcatattttttaattatagcaaatatttctcaccagcaataatattagttttagcatattaatg

SEQ ID NO: 26522 - DNA, 1026 bp, Homo sapiens
attaaaaaaaggatgagttcatgtcctttgtagggacatggatgaagctggaaaccatcattctgagcaaactatcgcaaggacagagaaccaaacaccgcatgttctcacttataggtgggaattgaacaatgagaacacttggacacaggatggggaacatcacacactggggcctgtcatggagttgggggaggggggagggatagcattaggagatatacctaatgtaaatgacgagttaatgggtgcagcaaaccaacatggcacatgtatacctatgtaacaaacctgcacgttgtgcacatgtaccctagaacttaaagtataattaaaaaaaaaaaaaagaaatatcgaagtattagtcacccactagtaattaataatttataacaagtagatagctcatccttgtttcatttgtttatcatcatattctacttggttgatggaagccagtgaagactaaatgttattattaataatattaattaaacagatgtttaatctgtgcctgatttccacttggaactgtgttaggcactgtgggaatttcataaaagtaaagacagctcgctagctggatgcttttcatctctttgggggtcggggaaggggtggtatttgcaaggacagtttccttaggtagtgtttcctagcttatatagcgtcttaggttatataaaacttttcaactgttatcccattattgatcttcttttgaccagtggttttggaatctctttttgtcaaaaataataagtacatgttttatgactttctgtcaattttgcattatatcctaattttctacataaaaagtgaaattgactttatctttaaatttatagtttcatttgggttcatttaactgaggagggcatttgctaaggcttctattaaagtaacactcttttttatagtagcatctcagttaggtgacatgaaaataaacagttcacaaccctggctggaaacctttaaaaatgcagtgtctagactcaacccacagattctgatttggta

SEQ ID NO: 26523 - DNA, 1043 bp, Homo sapiens
gttctgtccagttttgctgttttctaaggctcttggctcccctctcaagttctgttctttaagccatccttctttttccacaagaaagagtcagtgtttgcagctaaggagccttctcagactgcttcctgccagcaaaagtttaggatctgaaggcctctttttattttgtattctgtttctttttgtctaacttggcagtattttgtagtacgatatcaaaaaaggtagtgggttttctgtgaatcttgttgggttcactccattagtgaagatccatgaccacaagatgctttgtctaccatgggttccctgtgagacagctaaggggcagtgccctgtgattcttggaatccctgttatttaatgcagaggttctgcaacacaaactattaagatcctcagaaggtgttaggtacgtttgaaggtgtctacaaggcaccaccttagacctttctgaattcttaaaaggttgtgcagtttcaccctgggtttgatttttgctctgaaaccatttcttggctcaagaattgtttgatgtgtggagagattgggaatgagaaacaggtttatatttaacagtttattctttagctcatctctctctgctcacatcttataggcagtgagcagaacccaggtgtcactttaagtggctgcctggaaatctctttagatagatcattgagttcattaggtgcatttccgcttcccactttactgtagatgtcagtgttgctaaactctctgtcactgcacaacagggtcctcctttcctctagcttccaggaacatttccctcacttttctttaagccctcactgacaaccttcttaaaacaacagtcatttcattatctcgcactgttgctatgtgtcaggcattcagaaagggcttgtcctgactcggggtctctcgtgcttgctgtcagccatcttggaagcaagtctgattgtcatagggctaattgttgctttaagtcactcagttttagggtgattagttacatgtcagtagtgactggagtgattaacatgctgatt

SEQ ID NO: 26524 - DNA, 1014 bp, Homo sapiens
ggcagagctattgaattttgcatgagcttcctgttagttgcagaacaagttgttggtgctgtttaaaagattatcagtaaagaagattaaggagattttttaccttaaaaagattaatcatgtaaacagaagcaaatggctttaaattaacattagtgtttcctatttattcttgggttattgccctgcactgtagtgtgtctgttttctgagttccttttcttccttcttaatttctgtgactttgaaatatcctggttagtgatcatggagcccactgttctttgtcacctagaggagattgttaattatgtgaatggccttgcctgggtaaggtccctttgtgggttcttggttgtatgtggtgttatcctagcatagaccaggagaggcctctgagaagttcctatctatcctaatccacctgaggatccaatttgatccttatattttaaaacataataactgacttctcttctgaaactttctttttcagggaaggactctgctgttagaaatgattcctttattttgatcttaaatttttatgaaacttgttaagcctttacacagtaacttacagtttgagtaggcaagccttctctagtttaaacacagtttccataattgtacccattctttgtagctgctcacttcattcctttacatttgctgaatttgccttgaatcttttccatatcaatcacttttctcatggagccaggaatgaagactgctattagccatcttgaattatttattgtaaaagggatgattattttgtcatacctgtgtactatttctatgtaaacatctcatttgttatttatatttgattcatagggcttgttttccttccaaaattttttaatctttcattgagattatttcttcaacctccatttgggtgaaatgctcttagattctaattttgttttccaacatttgcttatcttccccttgaatttggtgtcatctccagtaaaattttttgacatcttcaagaaaacagaa

SEQ ID NO: 26525 - DNA, 1892 bp, Homo sapiens
taacgagagagggaacaacagctgttaattgaatcaggtacaaattcccttacctggtgctcagactctgtggttggttgggcccctcaacaatctcacccagtacttccctgcttttaaaaataatggcctctgtggaaaagaagctgcttgtaggaaagaactctcagggtcccctgaagctatgggggctcctattgctccagactcccacccagccacttaggcatcagtgtctcttttaactcattgtagctacattttaggaagctctgaactctcaaacattgatcccgttactctctgatcaaagagagtcaatgttgttcatgcacaactcaggttccttttcaaagagaatagcagatactgtagaagtttgaggtaggtgaggcttgggtactcacccacagcttcccttacaggttttagagaaatcaactttcagaccaaattttgcccttcattagcaagcaagcccctaaacagttctcacaatttgttctgtaagctcaaggaaatcccagttctttttcctcataggtgaatgaaaaattcattagaggcagacatgccaagattccagatgcagtttttgctttatccttatgcttgctactaggaatccaaccatccacagaactggctagggtatagtctacagttggactggactggattgttttattctgttcatgcaagagtaaggagtatatctaaaatattttagccactctctggtgctaagaacctttattttcagcagtgaaagcccatttctaacatgtatcatacctctcaacaggtcactgttttccctaataataacccctttggacaatcagtcacctggcttatgctcatctatatttagatttggataatagaaatacttccagcagctgcctctggcatcctgagtcgagtgctatcagaacccccccagcactggacattcttggttagaatgccagctgaccacctaggttgtggtatcacaaacataatatcacatggcatatgttgaagtattttaggtacattttagacatcataaccacacagttggcagactttagttttgcggactaaattaggcaggagaaatcgcttttctatttttttaaaaatgaatttgttgccaactacagtaagaaagggagctttttcataaagattccaatgtttggcttttttgggaaaactgggatatccagcaatcctgggtctacatttctctatggcaactttcttctggtgccaagcagcaggggcctgccttggaccttggtgggagggtgctgacagtgggctccagggcttcacacagggcccagcactcctaaagtctcccgtcacagagactgagcatcaagggcccttgtcactgagactgtagctgttgtttttcaggaccctcttttctccattgtattcctgcctggctgctgtaggtgttttgagtttttgacccttgcagctgtcagtttttcttcttggctccacacttgtgctttgctcatgccgtttctttgtctggaatttgtttcctgttggacttgctcatccaagtcttcacctcatcttgaaggctggctccaagacccactttggagatagtcttctatgaccattatggttatagctcctctgcttctacacagacaatatagtatttgattttatacatcttatcctacttaggtgggaatattcttttttttttttttctgagacgggctcactctgttgcctagactggagtgcagtggcatgatcatggcttactgcgtcctcgacctcctgggctcaagcgattctcccatttcatcctcctgagtagctgaaattacagttgcatgccaccgcacccacctaatgaactatcatgc

SEQ ID NO: 26526 - DNA, 1033 bp, Homo sapiens
aagttactgcatgtatcatatgttgattacagatttttaggacatttaaatagtgttaacctgtgtttacattctgtggaatatgatttaacacttgattgtatgtagtacacttgaggacacagtagccagtctaggcccccagtggtcattaacttactgtccttaccctttgctggccatagtttgtatcacctgtaaaatgatgtgcttaggctctcaaatttccttgcaactctaacaagtggataactttaatagagaactctatgacccctgtgctcctgaactgtgcttctcacagtctttcccagttcttttagtgggagaaccattcttctattgaatgggccagaaatcttgatattcctcgatccttgtcgttctcttggaccctacatcctatccaatatgttagtaaatcctatggttgaccatatttcatcagctccctgctgtcatcctggtccacagacccatcagttcttgtttggattattatggtggtctcctaaaaggacctcttcttctgcctttgcccctctgtggtctgttctctacacggcatctggattaatgctgttaaactaagttgacttgtattatgcctttcctcaaaaccctccaaccccttgccatttcagagtgaaagtcaaaatccttaaggtggctcgtgaggccttacaagatctggcccctcattatgtcattgatttcaactcttacatcttcctcttcagtcaaatcggcctccttaccttgcatgctgctgccccgggatctttgcatgggccgttccttctttctggaatactcttttccttacctccttcagatcttggctcaagtgtcacatcagtgagacttccaggcctcatattgtaacccccccccaccccatattttgtattccctgccctgctctgttttctttattgtacacatcagcgtactctctatcagtggctctctcaaggtgtgctcctagagcagcagcagcagcataaacttgataaaaatgcaaactcttgtg

SEQ ID NO: 26527 - DNA, 1857 bp, Homo sapiens
atgttgaaccctaattaccaatgtgatggtgttaggaggtggggcctttgggaggtaataagatcatgaggcctaaaccctcatgagtagggccagtgcctttataaagaggccccagagagctgccgtgcccttctaccatgtgaggacacgaacagaaggcaccatctataaacaagaaggcgggtccttactagatagtgaatctgccgatgccataatcttggacttcccagcctgcagaactgtgataaataagattttgttgtttttaagtcacccagtctaaggtattttgttatagtaggcccaatacacaaagacagtgcttatgtgtgtgaatgtgaatttcccttccctggttttacataacagaaataaaaactggtactgagcgaaagcagcctggaactctagaaagttaccatcaaaatgcctcacgtatgtgcatccattcaaatcaagcttatgccctgggtttttcactgtccaaggtacattggtagaactttgggtagcatctcttatttactgggagggagataatatccttatcagccttgaatacatcttcattttaaatctgcatcttgaacactgaaaaccccatgactaaaagtgctaggaaaacatgcaatgaaacttaacttgcttctgtcacttaggcgttatccattaaggagctagaggaagatgggcaaggtggttgagtttttacacccatagctgctaggttctttcattttccttctgtggcctttggccctcataaagtgcactttgatggggagggtaggggtttaagagttattttttgtgttgtagggaagagaggctgctgctttgagcaaggcacccgagcagcgctggagtcagcttctgattagtgtgggaaagcgctgaaagccccggaggcatccaatcaggaaatgatgtcatcacatttatgagcaccttggcccagagcatgggctctgacaccagacagccatagttcagtcctggcattgctccttctagctgtgtaaccaagttatagctttagcttctctgtgcctcattttgcacgtttgtgtaatgagaatatactgcggcattaaaggagttaaaacacattttattttagaatttgctaactcattgctttcgtattgaaattgggatggtgtcctctaattacttagggtgtggtaagctcacggtggctagggaggtgcgaggccttaggcactccatctgacctcctgccgtgttattttgctcttttctttttcccatcagtttcctcaatatcaccagagtgaagaatctgcagtgtagatctgactgtatcttcctcttgcataaagtttataagcattgttgatggaataaagcattgttgatggaataaagctccagcttcctactaatggcagatgagggacctgcctgtttttctggtcatgtctgcaagtgctttctgctgtgacttgaaatgcttatagcttcttgttcagggttcccctttcttacctgagtaacttcttttcatgacttattcatgaagaattctttccttgagaaacctttcatgatcatttcctccaccatgcccacctgcaccaggttaagcccctcaccctggtggtttgcaagggttctggccatactctagctagcctatgacacagcactgacattgggcctttactttcccatcttcccttcagactggatacttcccagagggagaaactgtgttgttcatcgcagcattcccagatggtacctgatacatggcaggtgttcctgaactttgggtcagtgcactctgcctagaggcacgggagacaccctgtctcagcagcaggttat

SEQ ID NO: 26528 - DNA, 1052 bp, Homo sapiens
ggctattcttgacaaagctggtaggctggggatgcaatgaatgtcttttacatgaacacacaatatcaggtgagcacctttcgtgttcaaagcctctattttgttattggccctagagtaaccttaaaggcctgggataagatgtagccacgcccatattaactcttgctttacccatgtcgttgaaagtctgtctcagcaatccttttagctttcatggtttcttgggggagtgttcttggcattttttggctagacagtcattccctctactggagtgaccctgtcattgcagagacgcgtaagatgagcccacttgtacccatcacctagtttcaataattatcaatctttggcaattcttgattcatctgctgccccccacccccaccccccgactctggtgcctctcctcatcgtggaggctggattttgttgttgagccatctgagttagtgctttgtgtgtgcatatcttgtcctcatgagtggaccttatcccataggctaaggacagtttgaaaaagtacttcagttaaacaagtaacagctaagagacatctgtgggcaaagatttcaaactgtccagccccaagcagtctagttgttcagagtgcaggctctggtgtcagctgacttgatcgaaattctgaggccaccacttagtagctgtaccaccttgggcaagttaccaaaccttcttaagactcagtttccttaaagaagggtaaaaatataaactacttcatcttctttcatgaaatcaaggtccagtgatcttaacagtggccaacacataataggcaagcagtaaatatcaataactgctgttctaccatggctgctgctgctactgctgttgctactattactactattacttctgttactacgactaacaggatcacagtgatactcccttgcactgactggagatcatgtgaccctcaaattgtcctgcaagagcttcagctctgaggagagtttatgacttatcaaaaggtaatacttattaattatggaatttggaagctaacttgccattaatcttgc

SEQ ID NO: 26529 - DNA, 1047 bp, Homo sapiens
caaaagtgaattgagatagagtgacttaaaagagtgaactgaaaagatttaaagccgtgcccacttaacttgtgcatatgtgcatacaggccataatcctattgaatgatttattgcacttgaaataggagtcaggaataaaatgagaaattcataaaatgttaagaactcttattccaaaaggggtgcatgatacttcattgaaaatatgctactaatgttaatgagtcatgtgtcagtatcatatattgttcaaaataaatacaaggtgctgttcagcatagtaattgctcttattttatttcatgttgctaacacttgtccagttcctgtatttacaagccccacattttttagcttcctcttaaactaatcagcaaagtgcataaaaacccttaaagcaagacagtgttggtattatttctaaatgtcctttagaattatgcagttaggtcacctcctttcctttcaaagcatggatttactctaatcctgggaatcctaatctagtactagcagactccaaacttttgatcatcacttacagtaaaacatgtcatactaaagcttgggcgtaagtgaaacaaaagtttcataaagcagtttttacccttattacattctgatgcttcccttaaacaatgctggcctccacccagttagttgattttgtgaccagtggatcctcactggcaatttgaaaaaacaccaacctggtgcacagaatggtagataaggaataagtatgcctagggtcctaatcctgtgctttccaattgctgcaggaaacacatccctatccttcacaggaccctgttttctcattcataaagtgagggggtgggttggacttgatgctctctaaggtgcctttccacctttaactttgttcttggtctcttctatagttgaagggaaatctttggatttagagtagaatctcccaaactgtttaatgaatggttaaatccatccatgttgtgacaatgatctcaggtcacaaagcttcataattctgtctagagatgagaagtagccagtcgttcc
